United States Patent 8,781,750 (CELL-TYPE-SPECIFIC PATTERNS OF GENE EXPRESSION) - sequence listing, part 3

SEQ ID NO: 35661 - DNA, 80284 bp, Homo sapiens
gagtggctggcggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggtgagtttggtacttgggaaatctgcggtcggccagccaccttttgtagcacagaaggtctaaggaatttttaaaaaggaggggaaaggagagggaccgaactttttttttcctttctgttgctaacggaggcgatggtgatggtggtggtggttgtgggagatgcagtgatccaggattagaagtcgcatcgtttgcaaggcattaaacaggagcgcgagtgcacgaaggtagccttaggtaacgcgccagacccggtctatcttttattgtcagtgagagatgctgcagcgtcggcccgcggggtgcaagcaaatggatgccagattgaatatgcatgcctggagctcggatattgttctctgggctgcgtgctgcgaggctggactcctccagcagcgatggggagatggggacttggatcctccccgggtcttccgcccccacccaaaaagggctttctggagccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgccccccccccggttttctcgccctgtagttcggggctggggccctggcggggattcgggctctttttcacgtctcttttccgccccttctgccgctcaggaggcgtccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaagcagtcaggatgtgtttttagggctggatataaggacgctctttggttctggttttccctttagccatgggcaccccggcttcctctccgtgcacaagggcacacccatccgcgggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgcaggaggaaggagtggtgactctggggagggaggatggaaagcagatttgcagcaagcctcaaataatttgctgtcttcgtgaatgaacaaggcagcttcattttgacagtgtggggagaaaaaaaaattaaaagcaaacgatcaacaagacttttttttttttttttttttttaaagagcgcccccccccccacaccctttaaaaaatctggttgcattatcataggacctatagcatggtattcctccctccctcaccactggcagcctcttatgtaagagccttctggaaggcactagagtgaacgggggtgtggtgtttcactttttttcatggcatcatgttggctcgggatattcgcggtgatggctggggcaggtaccacagtgactgtggaggcaggaggtgaagggggaggcctctccttgccttccaggtgatatttattccatggaagcttagagatctgggagagaagtggaggtcattgtagacagaggacaagtgcactgatttgagtgacctgggcaagtggcctaacctctctgagcctcagtttccttatgtgtcatgggaatagaacctggcctcatctacctcacagatttctttcgaggctctgatgtcatgatgtgcacggctttgtaaaggtctttacacttaccttatacaggtgcaggaattattgttggctattctcctttgactttccaaagtctacgtgaggatcagggaccctgcagtgtacaaaattaaaatgatcttattggttttcagtatgttagagagacaataaatactttctgaaccaaggtgtgtgtatttatgtgtaaaattatcttttttccttgctctctagtagcttatctcttttttaaagattttctatgatttccttttcttggtagctgctaaagagaggtagcacttgctgagaatattgttttgtaactgaattttgagttaactattgccaaaagaatgtcattctttgaaatgtgttgcatattaaaagggcaatgtatggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatcaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcagagcgatcgtcttctgatcaaaggaggtaaaattgttaatgatgaccagtcgttctatgcagacatatacatggaagatgggttgatcaagtaagtgtaactcatgatatacagatgtatttgaacactttccagacttcccaagtattagataccattcgcatccaaagtatcaaacttcaggaacatcagagagtgaccaacttagtatctgttttaaactggttttgattggtggtaattagtgaatttgaaaactcaaatttagggaattcaaagcaacaattaatgtacacccgttgcattaggtattatgtaatttactatttttaactgaggtgatatgatatctttctgttgccagctcaaatacttggtttgtgatatgttgaatatattaaagttttgcctagaatgtcattgtttgggttggattgcccaaaggacgcaaacgtgaaagacagtctcctctattgagacagcacatctgctttcttcatcaagaatccaagttggaggggccaaagaaagataccaagttaattactaagtaatacagacaaattactgcctaaatcctgagggaattttaggttttattctaagtggcaactagtgcaaataagactgcccttgtgtttattgtgttaatgttacaaaggagaagcaacagggcagttcctgagtttgggtatttttggacgccagagggttaaggaagctgagttcatcccagtatctgcctgccctttctactggggtagctcccggggctctggagaaatagcacatctgtttgaagacaaacactgcagccagtgacagcttttaaataagcagcattcatcaagggatagctgtaaaccggtccagaggagtggaaaactggagtggctgtgactgttgcctgggagctcacacccagatttatgaacctaaaatagattttaacatttccacgtttaatgttttctccatgtgtgtttgctgtgacagtctcagctccaggctctcaaatgccatgactttgatgttccattttcccccaattataagatggcacgatctggtctggtagaatgacactggcccagaagtgtgcaggcctgtgtgctgtttttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccttctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaaaagcccacggcacagagcggaggatagtttataggttagtgaaagtagctgtcagatcccatttgagtccacatttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcagtaagaagcttaaaaatcatcattgtagtgcttaggaagtgtgagagtttgcaaataagtctattgtttgattctctccttctaaaacttgctgtcctgagccacagttcaatctaccaaataagggggtgaggatgtgttaaccatttgtcttatttatttatgctcattttctgtcaaattttaagttctcccattgaactagagaatatggttctaaggagtttggtaagatgaatgacttcttgctttctctccatgtggacttttgtcttccttgaccctagaatgtgatttggttttgaaaacacggcatttgaagtcatcttcaatgccaccaactttaagccattgagcataagtatttgattgagattttcagaaaaattcctaagagtgcttctttttagaatgaggatgggctgcaacaaatgaaatgctgaagcaggaactcctgttcctctgatatgaaaatcaaatggagacgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgagacagagtttctctcttgttgcccaggctggagtgcaatggtgcaatctgggctcactgcaacctctgcctccccggttcaagtgattctcctggctcagccacccgagtagccgggactacaggcatgcacccccacgcttggctaattttgtatttttagtagagacgggggtcttccatgttagtcaggctggtctcgaactccccacctcaggtgatctgcctgcctcggcctcccaaagtgctgggattacaggcatgagccaccgtgcctggccgctttgtgctttttgtttaactaaatctgaactgtattcacagcactgtgacacagcacacataatattaagagtttgcttgtgaactgctagattccagcatgcccactgattgtccttttgaaaaatgtcattttgtttttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttgccccgcattttaaatcacaactcatcctctggcgttctctctgtcctggccctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttagactattcgggtgtcagccgggaaggccaagtcagggtgatcatctgcctcagtttggagttcacagggagaccctgcaggcccctggattggtcacagacagtcaataagccattaaaaacaatatttctctggctgggcaccatggttcatgcctgtaattccagcactttgggagcctgaggtgggtggatcacttgaggtcaggaatttgagactagcctggccaatatggcgaatctactacaaatacaaaaattagctaggcatggtggcatgctcctggagtcccagctacttgggaggctgaggcaggagaatctttgaacctgggaggcggaggttgcagggagctgagattgcaccactgcactctatcctgagcaatagagtgagactccgtctcaaaaaaaaacaaacaaaaaaattctcgagtgaatggtcagtgtcatctatcattggagagggaaatgcccccagccaggagttaggagtctggagtgctggcccccttctgacactgacttgccgtgtgaccttgagtcactaccctactctgtgttctagctgtgtgtctccagtgagggatttgtgctacatgaccctggaagtcctttccagccccctacatttggccattcactgaaactcattcactgaaactcagagagattttgcctctcatcaagtacatgttgctcagcagatacagaaagtccctgttttctctcacacttgctggaaagaatccctcagcccaccatctcctgtcctgcattcctgggtctgcctcttccctccacacgctcgccccgtgcttaggcccccactcttgttcttgtttttgactctttcctgccttcccttccccaccacaggagcatcaccttcttgccaccaccccgaatttctctttcgtcttccccctcagaggctgtggccttttttccattcatccagatgggttccttctgtttagggacgagggacatccccctctgagtgcagcacctggcccagggagctcagaagagtcagcagatggccttatgggcaggtggtccggaaaggggagtgaggagtctgaccgcctgctctgcttccttggccagaatgctatggcatttgcacggaggctgtgtgatgcgatctggctatagagtggggcatccaatgagcgaacctcaaggaataaaagtcatcagagggggcagtgtatggttagcattgtgacccccaaatgccattgcttttatagcctgagaaaagtactaactacttttgcaaataaccacctatgtttactgacctctgtagaatttctactagcctgcctttccccgggggagggaatggtaataatacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactcagtgtggagcagggggaacgccctttgccctttccacccagtggtgggtgggcagagactgcagacataccctgcaggcggcatccagaccggctgaggggttgcgggggcggccgcattgctgcttggggaaaaccctacggacttcccagggccttcatggtcatttgagttcaggatctcagagtttctaggaagcagctgggaacagttacctctattttatagaggggaagactgaggccggaaggacagacacgacttgccaacacttaccctgtgcgtcggtgcaggtggccaggtgtggaacatacacctgtagctctggcctcaccgcttgccctggggccacctttgctctcagcctcagtggcctcatctgcaaaatggggcaagttttgacaaaggtggactgtggtggcatcacaacagcatctgcccagtagtgagcactcccatgtggtagctattgtcattccatccttgctgggtactgacaccctcccatctcttgtacactgagctctactctcccccgcatggccggagaaacaggctgagctgccgtagggcttgacctgagtattcactgagagcaggcgctgtctaggcgtggctggcggactgtgtgctttgtgtgttgcttctgggggcggcatcttgaaacattacacttcctgggtcccaccttacctggttaaagtagcaaatctgctggtggggtctgtgactctgtattcgaatctggtgcttggggagctttttgaaagcatgactttcaggggtgcatgccggatctgcacactctggatctccagggcttgggaaccactgctctgaatgtcatttctgctcacctgaactccaggctctctctagaggaggtgcaccctcaggcacaacatacccagcaggcttcctggtccctgggtagcaccgcacagcagagatggggactggactctagcagggaggaggaggggaggtgctgctgccgcagggctggaaggggccctccctcctgagtaccagccttgtcacttctcccctggctgtggctccctggatgtgcatcaggcacctccatccaactgtccccagttggactccctgtctgctccttgctgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctcactcctcagaggcactctgttaatgcccatgggtgaatgaatgagtgagtgaatgaatgaatgactgaatacactgacgatacttgatatcctgcttcctctgagtgatgccaagagacttagtgtcacaaggagggaggagggtttaggtatccgacgtggactgtgttcaccctgatggaagctgtcgcttgctcagcagtggctccctctgcagccccagctccctgagtccctgtggtcagatctggtcatggtgggggagggtggcagaaagaggaagccgagagcccaggcatggcctgtggttgtggatgggacagctccctctgtctgggctgttcttcagaagagggtgggaacagcagctctctcattggtcctcttgcgagaaagcctgctctccaagtacagagggtcacaacatggagaaatcacatggtcccagcaccacagtggacccagcagtcattcccccagtgccttgggcttgtcccggctcttcctactgagcctccccatggaggcaggagggctgggaggaaggtgaggtggcttcctgaagggacgtggctcctgaatgtcactgcggtacatccacggcttgtcatttgttcatccatgtggcatgtgggttgctccctccttatggcgagtacacacgtgtgaacgcatgcacacactgtaatatggatgtgtctgtaattgatactttgattattccctttgcagcactcatttgactcgggttagaaagtgtttacaaaaacgcccgaccacatcagacccaagtttcaaagtccaggaccaaagttgttgccacaaaatctgcctgtggcctggcgattagaaagccacgttatccaatgggccattggtgtgggctggttctctgtgctcctccccttgtcccctcagtctccacatggttgaggtcacacatttctcctaaggacacgggtgccctctgcaagcagatgccgggagcctgggtccactcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccacccccttggcatagtttgggccgatctaatgcctggcactgagcagagcggagggatctcctaatgcctggtgcggtacaggggaaggatggcggagcatcctcagagacagcacagctcttcccaaaggtccagcacgcacactttaccgaatgcttttcttgtgaagggagtcattgggttgggctagccaggtaggctgggtaggcctgtgggggttaggaacttctaggcccttccagaagcaagggcatccccaagtgggtgtctagactctgtttcgtggacattgtggcagttatcatactgtcccagggtttcttgcccccacctggccctgggagctggcagttacagtgctggaaatgagcctgactcactggggtggtgatcttccaccccttcaggtgccctcatcccagttcctactctgcctatgggtgttttacatggagagtcacagcactgggggtttcccagagcctagactctgacttgccctaaagctgggtcacacagactattgggaacttcctgtcgatcctgctggcctgattgacagctggaaccgggagtggaggtggggcccatgggaatgctaggctccagcaagttctgcctgacctttggatgtgagggtcaggcattcagtggtcgggtctcagggttccttattgctagatgaaagcttccacgacacacatgtgtctaagtgtgcccttgtcctatgtcctggctgagtgagttgggcagagacttctgaggacagcgatcgtggcctctccattttcctaaggcccctgcatgcctggagctggctgtgggggcagccagagaagctgcccaatgagtctgatgggagccagacccgttactccttctactcatgatagctttagcattgttgtcccggggcaaccctttctcatgtgaaaccttgcgtggaaccccctccacctgagatatgagactgatgaatgcagaactgctctggttggaatggtgggtggcaggtgggctgtgggggagtccagatcctctccgctttctctttgtcatccccccatggcagcccctctgcctctggagaatcccagagcttggggaagcacaggatggaaaccaacccatcctggcactgcctccccctctgcccacctcccctgcaaagcttgcaatgcgattggtcctggtgtagcctccgtgttgagttgtaggggaaagggtgtttagtaagcaggcatatacccacggagtcgcttaagaaaacacctaaccacactgtaagtttttagtagtttcgtttaatatccctctctctgttcaagacaggaaccagggtagagcacctgtttcattttccctgcctaggtttgggttggttttcttagctttttatgacagcccataataggtgagcattctgccctttttaaaaaaattaatggtgcagagagttttatttatttattttttagaaacggtgtctcactctatcacccaggctgtagtgcagtgttgcgatcatagctcactgcggctttgaacttctaggttgaaacaatcctcttgtcccagtagttgggactgtaggtgtgcaccactacacccggctaattttttacttgttagtagagatggggtcttgctatgttgcccaggctggtcatgaactcttggcctccgttgatcctcctgccttggcctcccaaagtgctgggattacaggcgtgagccactgtgcctgtttggtacattagtttttttttttttgtttttttttttttattaagacggagttttgctcttgttgcccaggctagagtgcaatggcgcagtcttggctcactgcaacctccacctcccaggtacaagccattctcctgtctcagcctctcaagtagcttggattacaggcatgcaccaacatgcccagctaattttttttgtatttagtagagatggggtttcaccatgttagtcaggctggtcacgaactcctgacctcaggtgatccacccgcctcggcctcccaaagtgctgggattacaggcatgtcccactgtgcccggccggtacattagttttaaagggaagattgactgtgggtggccaagggatttgtgttttctgacttaaccatccatggctctgaccccaagtcacccattaagggctgtttctccctttttttttcctcttcctccccaagctgacctttctctcttcttaagaagtgattactgatttctttaggttttgagggttctgtctttgactctccgtgattgttgggtgaagccatttgcttaaattccttgcttttagagcgtcttaactgccatggtaatgataaaggggagtgacagtgagtagaaattagagttctttctggttaacccatttgggaggtagctttctttgaatatgactaagtgttccccctaatgacagagaggatgttgctgggggttgggtcgcggtggctgaggctgctgtccagttaagagaattttgcaatgaactagggcagtggtttaaaaaccttgactgcacattagaatcccctggggagttgtaacaaaatgcagagaccagaccttctgacttaattgttctaggtgggcctggcattggtcgttttgaaagcctcaaggtgatagctgggattaagaatcatggatcccagtgcttgttctgatagttggacttctgttgaaaccgaatgaatgtctgccaagattttccgaaacccagagctgccctctgctccctgctttgtcctgtcctcttcacgaagggagtgggatcacactgttgctatctggccagggtggagtctacagccagatgctccccagaagcttaaccatggaggggctgagctaattgtcaccagaaagagcctcctccttcagttgctgtccttggtgttcgggaaggttttacttggctaattccctaaaagggcactggttaggacttggagtaagtggtgatgagcaagagcagggctggctggtgggacagggtgggtgccgggggcagaggggaactggaatgtggactgctgtccccagcctgtggccacctgctgtgctggtttccctgagaaaaccctactgtctttaggttgaatctgtagtgtttatgacctaatcactctctaatgataggtcaggactggaatctttccttgtggggagcctgtgagacaaaaatcaaaagggcctgataataacatagaatcatggactcttaaggcagccattcacctccttcccagccccgctcccacagctgggcacggtttattggaccaggcttcagaggatgggattgtaagtaactcaacaggacaggatgggagcgctccaagaatcagatctaagtttaacttccctttctagtgctttctgtctgagcgtgatcatcctaatgtgtttctagatggctatttccacatgtgtaaagtggagacaatcaattcttatgtcttacgactatggaaaaagtgagtttttttgtgccatactatttgaaagtaatcattgtgacacctttggaacaagtgtgaaaagatctccctctctctctctctcacacctgtctgtatccatctttatctttttatcatctatctctatctatctattaatatatatttatctatctagcatgacctgggataggtgaattctatagccaggtggcctccagaagcttacgaaatgatcgtctaccaaatctaccatctatctatttccctacctacctatcatttatctaatctatctatatattgatatatatctatctggtctatatctatcttgatatgacatctgtctgtacctatggtctatcatctctatttaatccatcgtctctatatctattgattatcacttatctgttttacttatcctaatctatcattaatctatcatctttctaatctatctgtatatatctattgtttatctaatctatcaattgaccattcatctgttcatctttcatataccaaagatgcagttgcatgccacctgattccagatgggttatctcacttcactgtcacttagtgagatcaggaagaagtctcaaggattgtttcaacttcaagcctatgtacatgagtttgcgttttgaacatagcaggaaaaacaacgatgtataagaagctttcttattggctgggcatggtgacttatgcctgtaatcccagcactttgggagattgaggtgggaggatcacttgaaggcgccaggagttcaagaccagcctgggcagcaaagtgaagccttgtctctaccaaaatcaatcaatcaatcaatcaatcaataactaaaaataaaaataaaaaattagctgggcgtggtgacacatacctgtagtcctagctgcttgggaggctgaggtaggaggattgcttgagccccagagtttgagggtgcagtgagctatgattgtgccactgcacttcagtctgggagacagtgagaccccatcttaaaaaaaaaggtataatgtagcttatagggcttataatcctgtaagaagacttcttatgcaagaaaataaaaattttacttttcgctattttttttttcctcctccaaataatctctggagaatttggagcctgattttcttgacaacacatctggccctgcagatgtaaagcagtgttcccagaaaacagcccgtcaaatcaataactcttgctatctttgaattttcagccttttttggcattcaaatgaggccaactttataagtggccattgctgtgctgttgaattcaagcccctccgtttttcatggtggattccttgcattgtctgctaggggggttgcattcctcgctgaaccagacctctgccctcttccccgctgccttgcagtttgctgagcttccaggcagggctgcagggtcgtgctgctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagttctggcagaggcgagcagcttctttgtgtggacaggcatatctcatgcctttttgcttcagctgggagtttgttttttttttaattactgttatttatttatttagtaccttagctcattagctgcagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactttgcacagttagatggggcttcagccctctttgtaggatgaacgtttaggttcttgtccaaacgaatacacttctatatcctactaaaaatgattgcaggacagcagtgcaaaccagggctgtcctaggcaaacccaggcatctgtcactctaaaggacacaaggacacgtgttgagtcctcttgtcctccagtgagctcgggaaggggatgaccctagcagttgctctctggacctctccacagacctgccgggagtcatgggtaggagttgtgtgattctgtccttttcacaagagatggttagaagaaagtgaggagtttggagggagcagataattgatatcatttatcgggaatctgtgggacgcaagccctgcatacaccatttctaatccttccatcaaccccgaagatagataggcttatcctcctgttataaatgaagtaatgagcagtccagagaagtgaaatgacttgcctgaagccacagagcctgcaagtgcgagggctgggattccaatccaagctctgggccaatggcccttgcatatcctagaatgcgagaggaacgtttgttttgtagcagttagacagcctgctcatgaaagctgctttgtgcccagccttgtgacaggtgctttacaacaatcccagacacagcacccaccttgagtttgccctcaggtacagggctcctatccatcctggaagaacagaaagattttggtgttcaagttttatcctgcccttccatccacctgttatttaaaagtactttttctgtaatatataggcagaaaatgatcagatatcatacgtctcctactaagtgggaggctgcacccagcatggaagatgctcaccaagacggtggtatattgggtgtctcttctctcctacagaagccctgggttgatgccctagatctccccttgcatcccagagggggatttggagagcaatcaagaggagtaactgatgccatgcattcatcaactgaacttaatccttcttctgggaggcccgggagccttcttccatgcggggccagattgagctgatttctgtcacgtaggctgctccgaggttgccttgcccttgcctggcactcatcttttgcatttctctgaatcgctttggcgtgggcttttatgaggttcattaggctcagcacctcccatgtctgcttgggaaacaccacgggcagatggcatttttcttttcttttctttttttttggatacagagtctccctccgttgcctaggctggaatgcagtggcttgatctcagctcactgcaagctccgcctcccaggttcacgccattctcctgcctcagcctcccaagtagctgggactacaggcgcccgccaccacgcccaactaatattttgtatttttagtagagatggggtttcactgttttagccaggatggtctcgatctcctgaccttgtgatccacccgcctcggcctcccaaagtgctgggattacaggcaagagccaccgcacctggcctcttttttttttttttttttttgaggggcagagacaaggaggaagatcagacaatttctcagagttggaattgtgttctgggtattgtttttctcctttatggagataatccagggagaaacatgaagtgtaatggaaagaatttgaggcccaaccttcttgatgatgcatcttcatggagctgggagaccttcgtgccagggtcgactctgctgcttattagctcaggctcggtgccccacggcttggtcctggttttctgaatcgtcagatgcacctggatcagcatgtcttgcataatagggttgctttgaggatccagggaggtggtggctatggcagggcttggacaaattacatgtatgggggagtagccccttcaccccagttttgctcctgaccgttgaagctttttatattgacccgtggctactgtggtattcgaagggctaaatttgttttgtgacttttgccttcagcagccatcgcattacatcatctaccttttcttgtgttcttctgtcgtcgagaatcaattaaaatggtcagcattgctatgaaatggtttatttttttgtggatgttttagagctcctcctctccatctcctgaatttcttttcttgctaagcctattcagctctgttttttagagagttcttttccctcctgctctatgaaaacgtattttccatgttaaaaaaggaagatccatgttgctgtacttaatgcttcatgttttagaatgttagtgccagcagaaagcaccaggagacacccgatgtgcccccaccttggtgagcacctttccccccaggcacagtccctgcttacgggagatttgaggcatttgatcattttttcccgttagcttacagcacaaagtactttgaaataaagattggctcgcagggcaggttgaagcttcaacaccaaaatctctctgttccttgtgggtggatgggagcctgacacctgattacaagctccaggtgaagagcaggtttgagacttacaccttgtttattgcaatctttctttcattttgcaggcggtgggggtgggggaatgaaagcccagaaagggatgtggcactcgggcaggacgggggctgcttctgtgccttttccccactgtgcgtattcttagctgcgcaagtgtcgtgcatgtgcgtttggctcacacccagcgggagtgcccttcttgtgaaggaagctcgttctctaccgaaaagctcacttttcagagaagagctggagaaggcctgttgtccatcttagtcctgaaatatgagttttcattccatggcaagtccttttaatgaaagatggactggagaagctgatgcatagaaaagaaataggttcttttatgtagagggggaaagtgtccactctgcggtatttcctgggtcctgtggcttgtaggcatttgaactgttttgtcttggttctgagagagtcagatgattcagaagctgtgttctgctgaacattcctgccttcttgacagaaatcccctatttttgtggtccccctggcaggtaaaggtggcccctactgacttgtaggatttctgtccatgattgtgtctgaaatgtcattttttctggttgttttccctcttcatgtattagcttggctctttcttctcctctttgtctttaaggtaatttgcaaaggtcacactattcttgcttcttcttagaaatgtcataagggattttcaaagaaagaaaatttctgagtaagagtatctccctcccctcccctcccctccctccactcctctcccctcttttccccttcccacttcctcctttcctttctttctctcgctctctctctttctcatttatgttagcttacatgagtatactgactctaaaaatttttgattctactactgcactccagcatgggtaatagagcaagaccctgtctcaaaaaaataaataaataaaaataaaaaatcttaaaaaaatttagatatgatttgtataccctcagattcactctctgaaagtgtataactcagtgctttttagtatattcacagaattgtggaagcatcactaccatctaatatcagaacattcttaccaccccaaaaagaaaccctaccaattatcagctgctccccattccccacctctccccttgcacccctagcccatggcaaccactacatttctatagcgttgcctgttctggacatttcatataaatggaataatacaatatgtggccttttatagctggcttctttcccttagcataatgttttcaaggtttatccaagttgtaatatgtatcaatacttcatgactttttatggtcgaataatattacatttatgagtagaccacattttgtttgcccattcatcgatggatggcatttgggttgtgtccactgttttggctattgtgcatgaataatgtacatttgtgggcaagcatttgcgtgggcgtgtgttttctgttctcttgggtatataccgaggagtggaattgtggggtcatgtggtcattctatgtttaattttttttttggccatgttactggcaaatatatttaactttctgagcaacagtcagactgtttcccaaagtggttgtgctattttacactcccaccagcagtgtgggagggccccggtttcttcgcatccttgccaacacttgctattgtctgtcgttttgattatagccatgcgagtgggtgttaggtgctgtgtcattgtggctttaattttaggctttattttgaggcccgtgtactcattcactgacccctagtcacatttatcttgacctgtgatgtgagaacttggtttgggtgtgttttccctactctgcactggctcatctggtgtggcaagtgcaaagatgtttgcagagatgagaatgagtacctgcaaccaggggtccccagaaaggcagccctcttagctctccccactgaggacccttgagccctccctctagggctcaccatttgtggctggctggaatggctacctccattcccttgagcctggcaccgctcctcgagatttgctctgatctcaccgcatggctgagagtaaatcctgttttgctcccttttgtgagccttcttctttctgcttcctgatggggtgggcagataggtggttccatgctggggagggaacttggcagaggccctgttagcctcttcctccagtgtcacccttctgacagcacacagcctgcggggtccaggcactctcagccatgatatggaccatctccagggccagtccattcctgccgctgatggagattccctcctgatctccagagggcagaggaatcagaatagtttccttctacatttgtagtttgcaggaaccattgctcacagctgctccctccttggatgctataccctcactctgtaagatagggtgggaaatgtcgcctactttacccatgagagcatcgcagaagggagaggctgagggacttacccaactagtatgaggctgaatgaggactcagatgatggtcatctggctccggggccagcacttaatcctgctgggtatgttcctgggccctctctttttttgtttttgtttttgtttttttttgttttgagacagagtctcgctctgtcccccaggctggagtgcggtggcgccatctcagctcactgcaagctccgcctcctgggttcacgccattctcctgcctcagcctcccaagtagctgggactacaggtgcccgccaacatgcccggctaattttttgtatttttagtagagatggggtttcaccgttttagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgggttgaaacaggagaatttttactgagtgtactcaggcccagctgacttacgtttaaaagactgggcctggaacaaagacagtacttgacatttatatatattttataaaagggggtgggctagcttgaaataagctcatagtggtgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagtttttaggagcgtattagataatattattaagacttttttgggtctgggccatgcctttgctgcctttgggacaagttagcttaatacaggaaaacttatttttttttaattttatataaaaattctcctgtttcaacccgagatctctctcgtcctcctaaatcccgcaacactaagtgtggttcccttaagtgcactggattcaaggtgactttgtccttgcttttggatgttttggatgtaacagcgatgagatggcccctcccagagctgagaatggagagtattatgctagacacctgaggctgcagtgatgtgggctgatggaggggtgtcaaggagaaagcatgtggtcaccttcatggcaccatcacagcctttggtttgtttaaacaaagtgaattagtgttgtggtttctgctgctaagaaaaccctgttcgtttattcattcacctattcattccttcatccgttcatttattcatttattcatccattcatccattcagctgacatttattggccatctggcaggtgctgatctgggcattagaagtacagataaggtcctctttgcaaaaaacttcttgtctattgggaagacctacaaagaaaagatgaaaatgaaatgtgaagattgctgtactaaggttccagtggaacagagaagagaaatctttaaaatctgcctgggagagccaagagaggcttcagccaataggtcctatgtgagctgacccttgaaagccggctcaaattttaccctggggtggatttcacccatggggtgggcaggagaagggagtgtccacccaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccctattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaaggacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaaggaatgggtgagaacctgcctgcctcatcttgagagaggctgaggaagcacagagctgggaaggtagccactggtctccatggccactatgctttgaacatacctttgctgcagggccgatgaaaagttggacgttagctatcttcatctcaacctactccctgtcaagtcttgctttttttttttttgagacaagagtcttgctctgtcacgtaggctggagtgcattggtgctatctcggctcactgcaacctccacctctcctcctccggggttcaagtgattctcctgcctcagcctcccaagtagctgggattgcaggcacatgccaccacacctggctaatttttgcatttttttttagtagagacggggtttcaccatgttggccaggctggtctcctgacctcaagttattcacccacctcggcctcccaaagtgctgggattacaggcttgagccactgtgcctggccacgtcttgcatttaccatgggaaattgttagcgtggtcatcatttggtctgctttagtagagagtatcttttatgtttctcaaaggcgttatgttctgcattgtaaatgtgcggaaatcagtcacccagtcacctgaacttccatttaacatcaggtccctggccatgggacttgggcaggagcaccagggctggcccatcaagtacctcaatatattgctccctgatgagggaggggccagaatacatgttatcactactgtttaacatggttccggatatgttagccagtgtaataagatacgaaaaataagaagtaataataatggggagaaaatataagattattactatttttttttattgcccaggctggagtgcagtggtgtgaactcggctcactgcaacctccagctcccgggttcaagtgattctcttgcctcagcctctcaagtagagtagccaggattacatgcacccactaccacacccagctaatttttatatttttagtagagatgggatttcaccatgttggccaggctggtcttgaaatcctgacctcaagtgcctgcctcagcctccctaagtgattattactatttttagatggtttactttagccattcaaaggaattaaatgaagaaatatttgatctaagaagaaagtttatgaagatgactgacttaaaaataatgtattaaaaattaatagcttccctgtatgtcataaataaccaatcagaaaacataatttaaaaaatccatacacaatagcaacataaaatataaaattactaggaattataagaatacattcttatatatggaatccaagaagagtcttaaataaattaaaagaaatgctatgttagtgaacagaaaaacccaatactgtaaagaagtgtatactttagattaattttaaaattgaaaacctcaaaaggtggttgagtttttgttttgttttccatttgaccaaatgattcttaagtacaggtgaaagattaaacaggtgataagaaccaaaaaatattcaaaaaggtcataatgaataaggctgggagaccactactggctagatattaaaacaaactgtaaaaatataataattaaagctgtgtggtactagctccagaagagacagctatataagcaggttaaagtagaaaatctgcaaatgtgactaactgtatctaggtatttagtatataaaaaaggctacatttcacactcatggtaaaattgtaaaatattcatagtattatattagaagttaactattttgaaaaccaaagtaaacatcttaccttagttcgtataccaaaatatatcccagatggattaaagaattacatttaaacagtaaagtcagaagagaccagaagaaaatacagatgaaaagccatataatttagatatttcagcaaaggcagaaatcagaaaagatggagatgcttgactacatagtaattaaaaacattactaacagtttaataataaaaggataacgaagtaggacattcgacttgcaatatatgataaagggttgatgcatttaaaatatgaaattttaacattttaataaaaaaagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttatctgttttatttaatttcttttatataaataatacttcaggcaaatatgataaacttaataaatgtcaattctgaggggggaagaataaaggagttaaataagtagaagttgtaatacccagtgttggctaggttgtggttaaatgaacactcaaactgcggataggtatttacattggcatggccctttctggagggtaataagacagacagtatctaacaagagctgtaaaaatgtgtaaacaaaaaaattcatacgccttgacctagagtaatctatatgtaaacatttagctctaaggatgttcattgtagcattatttataatgaggaaaacaggaaatgagctgaatgatgaaaattggtgactggtatagtaaattaaggccatccctagaaaatagtagtatatagtcattaaaatttattttgggggccgggtggtgcctcacgcctgttatcccagcactttgggaggctgaggtgggtgaattgcctgacatcaggagttcgagaccagcctggccaatatggtgaaaccccatctctactaaaaatacaaaaattaaccgggcatggttgcacgcctgtagttccagctacttgggaggctgaggcaggagaatcacttgaacctgagaggtggaggttacagtgagctgagattgcgccactgcactgtagcctgggcaacagagtgagactctgtctcaaaaaaaaaaaaaaaatcattgtggggctgggcgtgatggctcacacctgttatcccagcactttgggaggctgagatggaaggattgcttgagcccagaaattcaagaccagcctgggaagcgtagggagaccctgtctctacaaaaaatttgaaaattacctggacatggttttgtgtgcctgtagtcccagctacttaggaggctgaggtgggaggattgcttgagcctggcaggttgaggctgcagtgagctatgatcctgccacgaacttcacaaagcaagaccctgtgtcaaaaagaaaaaaaaaaatcggctgggtgtggtggctaatgcctgtaatccccacactttgggaggctgaggtgggcggatcacaaggtcaggagatcgagaccatcctggctaacacggtgaaaccctgtccctactaaaaacaaaaaattagccgggcatagtggcacgcacctgtagtcctagctactcaagaggctgaggcaggagaatcgcttgaacctgggaggcggaggttgcagtgagcctagatcacgccactgcactccaacctgggtgacagagcaagactccatctcaaaaaaaaaaaaaaaaaaattgtggaaaatatttattaatatgaccatgttcacagtatattgatggaaataagcagaccatgatttcattatgtctgatttgatacttttttaaaaaacagctttttgaaacataaaaacattatgatgctacttttgtaaaaagtgtatatgtgtataataagtagataggaaaaagattgtctagacatacatcaacatagtaatagtgactttttttggatgattggatgagtcatggaagattttattttttttctccattctttctggtgttccagggttttggcattgaagtacttttgtacttagaggagttttataaaaaacaaaagttccctttgagggatactttgcatctggactgttatctcttacccacatcattcttgaggacgaagagaaaatacctgtgaggaagtatttacatttgttacggtggtgctgggctgagtttgtgtggaccctggactcccagctgtccacacagttataaagagtaattaaaagctccctgaacaacaggtcccttatcagccttaaaccttattgttcagatacattggcttttattcatagtcttactaatcaactggggacaaaaaagacccattgaaccattagccctcagcccgagatgagaagcgcatgatggtacaatggccgtggttcagactcagatgttatgctatgttttgaattcagtccaggttcctaggaggaaaacacccatcaaattatgttggctttagagcgatctcagtcaacagatgacatcaccgacttttccttccctgctggtctttatttggaggggatgcaagaattgtgcaaccttggaataaacagaatagagacccgactcctcactcattgtgtttctgagtttagtttcaatccaacagcggatctgtttttttactccatgtaatgggactgttgctgcagcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggcgcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagcatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatcccccctgctctcccctggcatagaagggtgcatctcgtctccccacaacagcactggaaggtgctagaacacttggagaaaactagttctgtaccagggattatgttcagcaggtttatctcctcaaggcacccctaaagtatgtttttactatttaacacacgattttgtaggccctactgttgttagctgttcgtagatactatttcagaacaatgctgtgagtagatactattattaggtccatttcacagataagaaacctgaggccctgacagggtaaggagtcctaaggttctgtagctagccatggtagagctggggtgtaaactcaggctttctgactccaaagttcatatttttaatccctatacagtgaagtaggcactgttgccatttctattttgcagatggggaaactgaggcactgaggagttaagtactttgcccagggtcctagaactagtcagtggtagagccaggattctacccagacaggtgagctctggagccaaagccctgagcatctgtagtagattccttgtggctttctgtcctgtccttgttccgagaaagttcccaggggacagttacggaatcactgggtgcttgctgttctcacacgcacagtttctactggctctctagcatttctttcattagtgagagaatgtttcagcccagcttttcagatggtggagttgaggcccccttgtctgagctgggtatttgagagccagcaggcttgagggcctgtgaggtctctggaggacacggtggtggtggggccaggagaagtcacttcttgggactttggaaagcctagaggaattccagaaatgaaacaccacacacttactggaagccaagttcgtgtttctcccactggtggaagggatatgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttggaagaaacctataggttcttccacagggaaattgttaaggaaatgatggtagattctccgcaagaatggctcccattaaaaattgaattagtaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacttaagttacccattgcatgtgtttccagtgacagaaaaggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttgaaactttctgaagagaggtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctggaaggaagggacatcctcattccagggcccaggccatgaggaaggaagcagtgggcagggatgcaggctgcaggtgtgggcagctccaggtgcccactctaggcttcaggatgagtggctcccttcctgcagtgggtgcccatcctggcaggtacagtcaccagagaggcccgcctgcttcagctgcataccatggggtttttcctgagactaaagagggtcctgctccttatatccattgaccagtgagtgatgaggaagactgaatgctgacggacgggaggaaggaagtcaggagaaagggagaagggctggccaggaaggaggagagaggaaatgacagaggagagggagagatcaggagccccatgcctgccagccagggaaggccctgctgttgcactcttcagaaccccaacttgggacattttgaatagatgttaggagtgtgagtggaatctaatgagtgggacagacctcccaagtgagcattgaatatgagggcgggtggggcatggtagctcatgcctataaccccagcactttgggaggccaaggtaggaggatcatttgagcccaggagtttgagacctgcctgggcaacatgggagacactttctctacaaaaaattaaaaattaactgggcatggtggcacgtgcctgtggtcccagctactcgggaggttgaggtgggaggatcgcttgagtcctggaaatcaaggctgcggtcagccagattgcaccacagcattccggcttgggtgacagaaccagaccctgtctcaaaaaaataaataaaagataaaaaataaagaaaatgagggtggaggaagaagagccagcggaagattcttctgagacatgggaagtaaatttgcaagattgctgtctgggagctggacagacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttgtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcctgccacccttaggctaaggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttctgtggcccaggccctctgcctggcacattttaagtaatgtgagcggattacttaatcttactgtctgttcagctgaaaactagggccaaccctggctcagagctcagggggccgttgcgaggattaaatgagagaatccatggaagatgtttagagtcgtaccagacacataggaagtgctgaataaatcagaatggtttttactatgactctcacctttcaatgtttgtgacttaaacttatgttacagttagtcatttcactggcgtgtgctaaccaaaggtggcctggcccctccgcatccattaggagggcttgagtttaaaatccaggccctgtgagtctgcagggaggaccgacgggagagctgggtactcctgggacttcagtgtccagtggatgctggggttctcaggttggtatattgagtcacatagttccatgactcccttggaggaagaggctaaagttgtctagaggcaggtgtgatgtttggtctgtcctgtgtgcactgagcaccttctgtataccagtccccctgcttgcttcttccagacagaagaaaacacagatggcaattggtcatatttgaacagtgcctcttatagcttacaaataccatcttattgaacactcatgaaaaatgctgggatgtatgttatttttactgtttcaaagatgaaaaaactcaggcacagacattctaaatagttccagctcttaggaaaatgcttctttagcattgcgggagaaacagtatatttgtacaaggcaagtagttcaccctgtaaggcagcacgtgctttggaggcacctaaatactacacagtgttttatgcatgggcgtttttcttacaaaggaacatagctttatcttcctgggggtgtttatcaaaccacatctatgtagcagatgctcttcaagcatttcccatattccctcgtttacaacaccctggaaccctgagttaattattagtcccatttcatggctgaggaatctgaagctctgagagtttgaacttcttgtctaaagtcacatggtgaggaagtggtagaactgacctggaccccaggtatctggctctggtctttccaatagtgcctcttcagtgggtatcccttaaattctcaggggcaggtgctttctcctccttttatgccctttttttcagagcaaaaccacgttatcctaactgccaagcacaacccacaaaggctcttatctctccttcaaaaaaagccattccctgcctggttgatgaggtcacctggcattttgcagggcattttgcagggtagatgccagctcgggaaagccacatagataagccagtggatggcttgtgttactgcctccctgatggtttgcttttaattcaagtcgattcatttatctgagatgaaaaagggagaggctgattcacacacattgaaaagcagggaatggtgctggagaatgaggccgtgactatttggaataagatcctggagatgggcagtgctgatagagtaaatatccagggagcaggggaaggtgtgtgcactgacaacaggagttttagcatctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctcccttctattccacgtgtgtaatcccaagatgggatcagagggcagggtggagggttacacatcctctcccctccctcctgctccacgtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggtatgaaggttctctctgtgtcatttcttaaaactccatgtgagtctatagtgagttttaaaaagaaaaagttccagcctgggcagcatagcgagacctattgtctctacacataataataataataaaattagacagtgtggtggcgcacgcctgtggtcctagctatttgggaggatgaggtgggaggattgcttgagcccaggagatcaggactgcagtgagctgtgattgcactactgcactccagcctgggtgccagagcgagacgccttctcaacaaaagaaaaaggataaaagaaaaaaaaattaaaagtagggtcatttaaatatggcaaactccaaacgggtcttctctttgaagttttagggagcagcttatttactttgtgtctcacactttgctaatatccaaaatgcagaacattagggaaccgcttgaggcaggaggggaaggaagcactgattctcgctgcagcatggatgaaccttgacgacatgatgccaagtgaaagcagacagacgcacaagactacatcttttatgattccattgataggaaatgtcctgaataaacaaatctatggagacgggaagtagattgatggtggccagggtttgggagtagcaggggtaggagggaatggggagtgactgtaagtgggtaccaggtttcttttttgagtcatgttctaaaattagattattgcaatggttgtaaagctctgtgagtgaactaaaagccaccgggttataccctttaaatgagtgattgcatagcatgtgaattatacctcaataaaactgttaaaaaaaacagtagggtcctttgatagttttaatagaagtcataataagaggaatagtcctttttcagagactgcttgtaacttgcaaattcaggccactgtcctggggcatgttcctggctctcataaaccagattcacaggcccaccacgcagaccatgagggtgtttccagtcactcatcttgagggaaggaacacccagtgtgtgccaggcattttgccaggtgcttttacctacgctttattatgtaaactttttgcagccctgcatggtatgtggttttacgccttttttttttttcttaatagacagtctttatctgttgcccaagctgaagtgcagtggtgcagtcatagctcactgcatccccaaactcctgggctcaagtgatcttccccacttagcctcccgagtagctgcgactacaggcacataacaccatgcccgggtaatgttttttttttttttttttgtagagttggggtctcactatgttacccaggctggtcttgaactcctggcctgaagcaatctgcccacctcagcctcccaaagtgctgagattacaggtgtgagtcactgaacccagctcatgcctatctttttatagatgagtaaatggaggttcctggctgggtgcggtggctcatgcctgtaatcccagcactttgggaggccgaggttgggaggaacatctgaggtcaggaattcgagatcagcctggccaacatggtgaaaccccatctctaccaaaaaaaaaaaaaaaaaaaaaatacaaaaattagccgggcatgatggcgcgcgcctgtgatcccagctactcaggacgctgaggcaggagaattgctcgaacccaggaggcggaggttgcagtgagctgagatcgcgccactgcactccagcctgggcaacaagagtgaaacgccatctcaaaagaaaaaaaagaaaagaaaaaagaaatggaggttccaaaaggctaaaccacagtaagggagtactgcagcaaaaactagaatttgggggctccttgacccccaagcctattctcttttcactgctggtatagtcgggttgccaaggctgccctcttggaggggccgatagctcagggaggtcaccagaggaaaggcctgtgagctctgtgcaagtcattttcaggcttgtgtcctcagtggggactctactccctccggaagtgagtatgacattctgccctattcccttggagcagctcttcccaggagagcttcagtggaaagaaaactgtgggaaaacatttggaggcatttcatggacacgtttctgagtgttatgagctcttgaaggaagcatgtttatttccccaaagtgctcagctgtgtccgggtcctgagtttttcaagggtttataacccccggagctgaatttggatatgcaaggaagccatgggattgcagccagggaacatgctattttttgtaagtgatgatgctgttgtgtagtaaacaggcccctcgtggtaaatggagagcagtgaatggaggtggagggagaagttttgggaaaagatttgcactcagttaatgatgctcaaggtagttcaaggcagactcagtagctcccgggttgcttagtagaaatgcagattactgggtcccagtctggacctgcagcgtcagaaactctggggtaaggtctgggaacctgtgttttatttttatgttatttttttgagacagggtcttgctgtgttgcccaggctggtcttgaactcctgggctctagtgttcctcttgcttcagccttccaaagtgctgggattataggcatgcgccactgcacctggccagaacctgtgttttaaggaacactggagatcattactgtgcaccctgaagtctgaggagtctagcaccagatgatctgacgacacatcattgggatgtggagtcatggttccagtcaccagcctgaagttgtccttgtctgtcaccctccccactttgtctaagggtgagtggaacagacagaaagtagactagtggttgccaggggctgggagtagcaggctaggagggaatggggagtgactgcaggtgggtacagcctttcttttttggtgatgttctaaatctagattgtggtgatggttgtaaggctttagatggcttgcttgagccttgcaatgggaatgagtgccttggcctaaggagaagggaagaaaatcttgtggaggaaatgagcttttatttttttcctttttttttgaggcagtctcttgctctgtcacccaagctggagtgcagtggtgcaatctcagctcactgcaacctccgcctcctgggttcaagtgattctcctgcctcagcctcctgagtagctgggattacaggcacctgccaccacacccagttaattttgtatttttagtagagacgaggtttcatcatgttgcccaggctggtctcgaactcctggcctcaagtgatcttttgccaccagatattaaaatgtatcaaaaagctgctctatttagtactgattgagatgaatggagcaaaatagcccaggaacagaacctggtattgtctctctgtaaagtatgagtgaatttaaaacattattagatatgttatctagtaataataatgataaagtattttttaaagtcatcatgaatcaatagaaggaaaggattattcagtaactatgagcatgtgggtcttagtgtcaccagtacttatccttcttcttaggagggatttgtttttttaatcttaaaggaaatagatatgttaaacctatcaggcttccttatttacattggctagagagcctaactctaaatttagccaatgtataagactaaatgtcaagtatttatctatacaaacacacacatatgtacacacttgcatccacatctacatacacatattttacatacacatatacacatataaatacacacgtacatacatacacatacatacatgcctctttcctgattttattttaccattatttttcttccgctttatcttgcattactctttctggtttatcacattttcttgtattttatgtatctctataaaccactttaaaactttttgggggaagaaagtggactatagataaagaaatagaataaggtataatatatagaaaaaaggcagtaaaaatacacccaaatttgaataggttgattttggggtggtggtggtaatgggattattaactttccctaaaattttctgtatttttgaaattttctactcaaagaatcatatcatcagaaaaaaattattatttctgctcattccctttgctggccagtgaaaggaatgcatttccataagtgagggtctggcagagcagtgttgaggggaggggtctttgccgcagcaaaagctggtccggttcccaggagagcccctcctttgctgcttgacctgattgcaagtggaatgtgagagccagaaggaaatattccatcacttatttagagcattcatttggctcttccctgatctaggcgttcagtacctgctcagagggagtttacattctagtcaggggtcagagagtaaatgagtgaaatggattcagaaacgatgccaccctgggatggtgacatatagccccagtgagaaggatgaggagatgcccaagtcaagagcgaggggaatgggtttccagagagagagagggctgcttgtgcacaggcttggagttgcccaggggttgggcaggtcaaagtgaagaatggccggggtggccattgtgggtgagcaggtcagggataaagagtaccttggagagatcaactaggaccggatctgactggccaagagaaagagtttgaattggactctaaggatggtagacagctactaaaggatttaataaggggaatggcagtgtttgatgaaaggtttaagatccttctagctgcttctgaagggtgatttgtagaaggacaagagatgaagccaggggagtgggtagggagattctgcccaaactgattgctacacagtgatatttttatgcttttcttttttttctttctttctttctttccttccttccttccttccttccttccttccttccttccttccttccttccttccttccttccttccctctctctctctttctttctttctttcttttatttttgttttgggtgttgatgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgtgtgtgtgtgtgtgtgtgtgtgtatatgtgtgtgtgtgtgtgtgtgtatatatatatttttttttttcttgagacaaggccttgctctgttgccctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagttgatcagaatttagcagtatctgcaagatttgaaccatttcagaaatctgagctctctagcattacatggactgatgttttcttagctcagaactgcttacctgtgtgtagaaaatctaatatttaggaagaataattcattgctttaagtgttcagtcctggtttttatttctattgttgcacaagtttgatttgaccttggacaaatcatttcagtttgtattttagtgcttgtgtgcagaagatgggtagtaatagtcctggtaatcctcctgccatcatgttaactgggtgagagctcttcaagacctaggagagataatagcaggtgcaaagtccctgtggtgggaggcagcaggtagatattttaggagctgaaaaacggtctgtgtagctggagagcagggtacaagggagaggtggtccagggtcatgttatagaggtaggccagggccacactggttggggttttgcaaaccttactggggacttgaatctttatctgaagagcagggggaagtcattggaggatttaaatcagggaatgacataagattgatggatatgctatctcctttaatcctcataacaaatgtatgtgctaggtaatatccccgttttaaagcagcacagaaattagggcagtggagattaaggagtttaccccaggacaccatgcaggtgaatgatggagccaggaaaccaactcgggtcagcttgcatccaaagtcctcagtcttccagatcagcgtacctccatagtaatataacaatgactgcagttttaaaacactttgaactcttaagatgaaagatttcccttaaattacaaagtggtattatgctgcagaaatgtgagcggtaatgagagagcaggtaatgcccgggaacttttgaaaggcccggtccgtgtggctctgctccagcaccttcaagttccctgccgtctggcggggggcgtctcataagctgctttcaacacaaagaagggtttggctgctccccggccatttgacactgccattgtccataaggactcgttgtccgtgaaatgcacccaaagcttgagctttcaggggttttgggaaatcagatctgggcagtgcatgtgtggtttcgctggagacatcatccaatgccaagtttctgctttctgctttctccctcttggataatcagctgggttacatggattcttagaagctggttgtagagatcaccatctcgattttgaacccaagaagccttattcagggttcaagtgggaaaatacctgctggcccacggcccttgaggctcttggtgatgatgacatatgtctgtttctttctagttgaccacgttgttcctgagcctgggacaagcctgctcgctgcctttgaccagtggagggaatgggccgacagcaagtcctgctgtgactactctctgcatgtggacatcagtgagtggcataagggcatccaggaggagatggaagcgcttgtgaaggatcacggtaggttgcactgagtcaatgccctctgcagatgtttccgcttcagtccatcaactggcacagccctgggaagaaagtgataatgcttccagatcccatttgtgcctcatgcccatgcctgcccctgggaaggagagagggctttgggccgcagcttatgctgtttggaggtggccttacccagtgcagtaacatgagccttcattgatgataagagaagatgaggcttactgctgggacctgttcttaggtgacagctgctcacagcttattggtttgtgagcaccgtgctctctagccagggtggggagttgaggctgctgagagagagatttaccctcaaaagataacaaatacatatctcagtgaggatttgacagtctcaggagagtgttgggcagccccttcctacaaacctggatggatctaggatagatttgagggctatgagacacttcaaaactgagtgacaacctgagagggcttttcctttccctagaattattttggagaacaaatttccagggattgggaagattcacagagaggcaggaggaatctttaccacctcaaggtgcctctgggactcttgtcaacaagaacctcgggggtttgcggggaagagccaggccacatcatcttcctgggtctcgctgggcttggctagagaccagattaacttcactggatcttagtgttcagggaaacacctattgctttagggttctggggacttccaggcttagaaacaccatgtgctgtgagtgacatggcaagagggaaatctctaggtactagaatgatagaaaatgccccggaatgaaaagcaagagtcttgggtttatttctctgatcttccacagactaactgtgtgaccctgggtaatttgctgaaattttatgggtctcagttttttaaacatttctcatatatgagggtcttggactagatgtcctctaagattctttccagcacaaagcttccacataaaagaaaataggtaaactttgacttttctcacttttgatcatgcggagactccaagtggtttaactgtggatacttagactgaatctgctccaaaccaggcaggagggttaccatggtaactgttgcctggcaacgggagaagggccaggatgtccagaggcatttaactcaggcagctcccagcaccccccaggtggcttgaattaaactccaaggctgcgaggttgtcaggacaattgtttaaaattgtgatgaatgttgggcagggatgtttggtctggtgcctagggaggcaagaactccaagacgccaggatgagaattgcgacatctgcttgttgaactaatggaccttttcttacttaaaaaatcatttgcttaaaaatcagcatggaaggcagtctgtctgccaaagaaaagacatttatcacagttcttcataggcagaaacttctaattcattttcttgttacagtcgcaacagacttgtttggtagaggcagcttaaaaaattaactgtggtaaaataaatataacattcaagttaccatcttaaccatttttaagtgtgtgtgcagttcattgttttaaaatacactcataatgttgttgcaaccatcaccaccctccatccacaggtctctttatcttgcaaaactaaaacgctacactcactcattaaacactaactctccactgtccttcaccccagtccctggcaactgctgttgtactttctgtctgtgaaattgacttctagggacctcatacaagtggaatcatatagtatttgtccttttgcaactggcttatttcatttaccatgatgtccttaaggtttctccatgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacacacacacacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtgccctggcccccagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatagaatcgcctaggtgtcctgtttctcatcccagaaatgcctctggtggggagatgattgtctttgtgaacaggaagatggaagtccctgtctctgatcccacccttgtctctctctcagatttatgaagtactgagtgtgatccgggatattggcgccatagcccaagtccacgcagaaaatggcgacatcattgcagaggtacagggctttctttttcgtcatttcttcatcacctggagggtgagaggcaggctcaagaaagggaagctgcatctgtagcttaacaccaaggtggaaaagcagagggacctggtgttcccttgctggagctctgctcagtctcacccatggcatgaatgccagtgacacacgtgcctctccgtgtgtgccacagaacatctaagtcagttactattgcagagagaggccatttctctcggtgctgtaacgcagctgccttgggtggggtacgggaaccctcacgtcacacacaggcattttacaccgtggctgagggttgcaaatgcaccagtcgtcagcatcccagggaacagctgaatgggttttgggaggctgtaattgatccatcctgctcaggcgggactgggaacagggcagtgaacccttctcttcatgaggtcttgggatgagggcagaacgatcggcagtggtaattttccatcttgcccggataactgcatgcccgggcctctgccatcagagctgtgcaaaatccactctccctcacagcctgactttctctaaacattgcaggagcagcagaggatcctggatctgggcatcacgggccccgagggacatgtgctgagccgacctgaggaggtgaatgttcaccaagcggaatgcgtgaatcagtgtcccttgggcactgtgcagagcctcagggaacctgcttcctgcctgttgagaagggggcttctctgatgctgactgtggtctttctgagaagctgtgggtcacgtgtgtgtctgtctgtctacgcaggcaaagtgaagtgttagattgctcctgagggtaaggtggtgtggactgtttcgccagaagattcttctttctgtctgtaattcttcaagcccttgcttgtatagacacaaacagttcttcattggcatcctgcaatgtagattttagtggttcacaacttatggtctccaatatcttaccaaaattcaccaaaacgtagttggaaggatggaaaagctcttctaaatgcctagaaggcgtgtggggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcctgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacatagacacacatgtacacacagacataggcacacgcagacaggtaggcacacaacagacatagacacacatgcatacacatagtaacacacacagacacatagacacacagacagctagacacagccatagacacctacacacacacacatacacatagacacacagacacatacagacacagacacagacatacacagacacatacacatgcagaggcagatacacagaactgcatgctccaagacactttcagtagcatttgaggccctgaggacattttcctctccccagatgacagaatggaagccgtgacattttcaggattgcacgttcctgcttcaggccagggatgcaggcccttttgtagctatcaaccttctcatgcgtgctaaaggctgaaagggtggcctggcacaggcccgaggatgagggaggcaggcaagcccctgtgtcagctgagggaagccccatgctgagaccgtggctggtggacagtgattgcaggggacagcttgcaggcgagagcaggctaagatcagccgaccataaacatgcctgaggctgattttattttattttattttattttttttcctttttctggagaacggggtctcactatattgcccaggcaggtctcgaactcctgggctcaagctatcctcccacctcttagcctccctgagagctgggattacaggcgtgagccaccgcgcccggccgaggctgattttatgcacatttgtgtgcacacagatccacgtgcacaagcacacacacgtgcacacactcacgttcacacacatatacatacacacacgtccataggcacagacatgcacgtgtacacacacagacacattttagcatacgcacatgtgcacaggcacagacacgcacatatgtgttgtacccacgtattttcacatacacatatacacatgtacaagcacagacacgcataggtgtacacacacattttcacacacacatgcacatatgcgcttgcacacacctatgcaggcaccatccccctttgcagacaccgcaagggttcgtttctgtggtttcacttctccctctgggccggcttctgtgactgccctcgccagattccccaggatccacctgtcgggtggtttaaaccatggcagcataagccatggttgctctcagccctgacctccctggaattgggctttgttcccagggctttgttcccagggctttgttccgccctgaaacagtcttgggattgggccttggaaatgcacagagtccgggagaggtggagggctgacacagttctcacgtgagccctgttcaaagctgccttcatttagtgctcacgtgtgctggacactgtgttcctggcccacatttcagttttgtaactgtcctgtgcaggaggtacaacatctccttcccacaactccagggatgccattcatgcaggctgcatggctgtattcagggagcaccatttacattctactgcccatgagtggtggtaccagagctgtgctgcagtgggctccttggttatctctctttagatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccctcactcttcaagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttataatcatggtggaaggtgaaggggaagcaggttccgtcttatgtggcggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggcccctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgacaatccgggcagtgcctggcattgtggggatgcaaaacagataagaaagtgatcctttctgaagggactgtggacaaggcgaggagaaagaggtagacagaaagtgagtgtagagatagaatttgacagtggctctgagctgtaagactgatgtctgggaagagagtggggacttggagatgaggataatgaagaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcgaaaccccgtgttgggacaataaatggagtagtcacctgtatctctgggaggtgctgagggttctagtggagtccatctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatgaagttgtctcagctctgctaaattagattaccagttaatgcaattacagaatttaatcttttggccaagctctggtggagacaaggtaaccaattcagttataggggctcagttatttcttgtgaaaaataacagtgttctgtggagcagcctagactgaaataccatgaacataaaatgaaatcatttatatgcttagcaaacatttttgagcacctgctgtgtatcagacaggacattgggagctattgggggcagggcatggaagatactaagcagtgagtaagccccagtccctcccctccaagagttcaagccagagcccttttgctgggatggagagggagccagtgatgttctgagatctgccttccacaatttcacctgctccttcccttgctgattggtgattcctctgtaggatagaacttgatccagggagtcttgcctgatcagatattccacagtcatcatgtgggatttgaaatatcattcatctgaacatccgatgtatttatttatttatgagatgaagtctctcgctgtcacccagtctggagtgcagtggcgccatctcagctcactgcaacctccgcctcctgggttccagcgattctcctgcctcagcctcctgagtagttggaattacaggcatgcgccaccatgcctggctaattttttttttttttaatttttaatagagacagagtttcaccatgttggtcaggctggtctcgaactcctgacctcaggtgatccacactcctcagcctcccaaagtgctgggattacaggtgtgagccaccacactgactggaacatccgatttaaagcgccagattatttactcaagcagttcttcaatcttgtgctgaaggtcgtaccaggctgtggctggccatgtctgtgcttcacacacagggggccattggtgtagacaaacggggcccactccgttcctagagccctgtgaggctgcattgtttcgtgggtgatgctgacttcattcatgagcatttaatgggagcccagcacaaactccacatcactgaatatcttgactcaagaccctgggagcagaatgaatatatggaattgagagcaatcagtgtctgtgtgtggcggttctcaaacgttagtaagtgtgaaaatcacccacattgctgggtcccgccctcagagtttctagcctgtgagtttctagtccagggcagagccagaaaatctgcatttcttacagactctgggccagtgctgatgtcacaggcttgctgcctgcacctggagaagggtcagaagggagttttcttttctttttcttttgagacttagtctcactttgttgcccaggttggagtatggtggtgcaatctcagcttactgccacctctgcctgctgggttcaagtgattctcctgccttatactcccaagtagctgggattacagtcacctgctgccatgcccagctttttttttttttttttttttaattgtatttgtagtagatacggagtttcaccatgttggccaggctggtcttgaactcctgatctcaggtaatccacctgcctcagcctcccaaagtgctgggattacaggcatgagccactgtgtccagccacaggagggaattagttcaaccaaaccaatgttgagagacacaaggcaagtcatactcctttgaattgtcccctggggtaggaccttggagaccagcagcctcgccttcatcttagcctctctctggggtggaggataaaggtagcggctcgtggggtgggctgagccacattctcatgctctgctgctgttttgcaggtcgaggccgaagccgtgaatcgtgccatcaccatcgccaaccagaccaactgcccgctgtatatcaccaaggtgatgagcaaaagctctgctgaggtcatcgcccaggcacggaagaagggtgagtgctgtggccggactggctgatggcaggtggggaggtttggaggggaggggggctcctcactagggagggctccttttccagaccctcatgccaagtgggccacttgcaccatgttctggcattaacctaattacagccgggcaaggcaggagctccagtttcctcctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccagacactatcacatccagatgttttggtgcttgataaactctcttgatgcattctgaactggggctgggtctctggtattactagggtgtccactgtaactaactgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttctttcttccttcctttctcccttttatgttccctcctcccctttgcctgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatgacttccagacggacccagcgactcctggccctggttctttggagtgctcctggggcctctgtccttaggctacacatcaaatggttgctgcctttctgtcttctcctggcaccttgaaggaattgccttttagaaataagaaagcattcacctaaaataatgtaacctactcagaatgagctttgagttgttttctaggagatattgtggatgacgatggaatcggtggccttgggccacccagacacgcatttgcaagaaggcagcgcatttgtgggaatcagcctctgtacagaaggccggccacagcactgctgcccccacgtagtgtggggatggttggcatagtgtctgaaagggggaaagaatgagacggcttattttctgtattttactactgcgctgtacctagatgatgatgatacgtgagttaggctaacatttcaacgtaattttggatagagaccttgtctaaagtttacttcatattcaaacctgtccaaatgagaagacggaggggtcctacatgtcccagactttagttgggggaggtggagtcgtgggccagccctgccgcaggcctcctcctctctgtccctcagggttcttctcaggtggagttgcggagctggagtgtgttgttgcggtgcccagtttggacctattaccccaactcagtgcctggtagcccccgttgttgttttttttaatttattttattttatttttgagatggagtctcactctgtcgcccaggcaggcgtgcagtggtgccatctcagctcactgcagtctccgcctcctggactcaagcgattctcccgcctcagcctccttagttgctgggattacaggcgcccccccatcacacccatctaatttttatatttttagtagagacggggtttcaccatgttgaccaggctggtctggaactcctgacctcaggtgatctgcccgcctcggtctcccaaaatactgggattacaggcatgagccactgcacctggccacccctattgtctttataaccttgacacactgtgtgtcttatggggtgagcagtaggaggggactttagtctgttcccttccagagccttctgagtgtgagtccaaatgtgcccacaccatggttcccaggatggcatttgcattcaaactgttacccattaatctgtgaaagcctgagctttagacaaacctgagctgccagaaaggaatttccagtgcattcaggtgctaatgagcaggaatgagaagtcctagctaacttcctaggctcttaggctctttcccatcttgctggaacttcctagcaactttgggaggcagccctggcaggaatttttatattttgttttactttgcagctgagtaaactgaagctcagagctcatgtatagtggaattggggcttgactgtcaggcatctaacttgaggccacaaatatccgtgtaaatgtttgactgacttaccttcatgctttgagattattttaatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggtgggttcttctggccccctgaggcaagtgtgtgcactgccacagccccctttctgatgctgcatttcttcctctgtgaatggagagattctgaattcattgaatgcattttcatgatgtgatactttaggcctgcgtaccaggaaaataaatggtcccaaccacagttagctcctcgacttgcaggggaaggatgctgagtggaaagtcacattgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggtgaaacgaatgagaactgttttcacgtgcctgcttgagccagcacgactgcatcctgccttccctgagagacacgctgagagacacgctgcttccatcagccgctctgtggctgttcagcaggatggcgtgttcagccggggagtggtgtgtcatcaacccaatttggcagctgaggcaatgaacacagagccaggaccagacgacctgggggcatttttactcttgaaaagaacttagacattgatcaacttaataggctcatttcatggaagaagtagaaatgcagaaattgaaaatcttgccctggttcatgtagcctgtgggaattagaaaccatgattccaggctcctggccacctctctttccatggagggccccttgtggggatttcttctctagaatgggctccctctgaccacattttgtccatgtgtgaaatccagcatgactgctgatgccttccatgtgtgagtggtggccgtgggcagtgcctgatgacctcatctgatggacattcttttccgtcctcctcctcacccctctcccataacccgggtgcagaaacattcaggacattaaaccctgggaacctcaatttgagataagacctcttatgtcctgtgggtcaataggagtgactcaaacgttatgagaagcacatggtcgcagggcctgtgaggaccacctcagcttggggatgagtccttagttaagcttatgcttgatgttgcaatcttgaacagaaaagggggatgagagaggagagaggacagtagagaaagggggaagatttattttaaagaattatatttaaggaatcaactcacacgattgtggggatggcaagtctgaaatctgcagatcaggccacagactggagaaccaaggaagagctgatgttggcatcggagtccaaaggcagaattccttcccaatctatgccctcacttttaacggcagatggtctgcaaggttgggaattcaatttgcattgtaattcagccactgccaggatgagatcctacttctggttttcagccatctcagctctgcatctatgggacataagggcagacatagaaacttttgattcattcatgtggtgcttgagctgggaatttgaatccctgaattcattcttcttttttcccccactttgtctagtacaattaggagcaaccaaccactctcgttatacttgttaattttacaaaaatgtttaaggtatctgctacacacccacctagaaccttgcctcttagaagcctttgggagtatttaataatattttctgtgtctctattgtcccatcatgccctgtactctcctctttttactactggacgtagaatcattagtgcctttcaacccaatcagatctgagaacgaatttcagaaacctcagaacccattcagaaaactcatttttaagatgatgttcttctagaaccactcttgctacgaaaacctgacagcacagtccccaggctgtttgttagggtctggcataaattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctggctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactgcccctgcccctgaatgtccctatctttgcttagctgtggcccagaagtccactcagcctttgtctaaagaggcaggttctgctcagcagtggcgttgagagctcagaccccattttgggttttctagaggcagaaggccaagttcattctcttgaagtgaggtagatattcctgtgcacagagagaaggggaatccagctcctcatagagcagctccccaccccaagctgagttgtgtttcgcagggagagataagcctgtggtcagcagcattcatccccatggtattcaggccactttccaagaaccagcccctccttgtacttaagtttctagaggcagggccgaggagcaggcacagggagaggatgagcgtcggcaagttacaggaaactcaggaaaatgtttatgtgtgtccagggattttcagagactatccagccattctttatctccaagtgcctctgctctcatgaacttcttcatgtggacaaaagcaggaagcctttagggccacgcatctcttgttttcctgtgacttacacagccctcacctttgtgcttagatggactgtggccagcgggacctccaggcctggctgggtcaggagagttttgcttaaccagatctgtttgatccttgaaccaaaagcggggagccagagagatcctttgagaactgatgactgctgctgggtcctgcccagccatttgcattttataaaggtctttggcagcggccaaggccttctcattatgtggtgtttttccacttcgggatgaaccggagtggtttgtgcagccacctgatagctctttgcaccagcttctgcatgggagactttgagcaggccaggagccaaggggaccctcctaggccttccgagcacctagcactggcccttttcttccttggggcttccttctggaggaggtttccctgggtttggagtcctccctcctgctgggggtgggggcgtggttgctggtggcctggagtgagctgcctgctgtggcctccagcactccccagctgaacagcgagtcctttgtgaaattcctgaggcaggagggggcagctgtgcagagccagctctcagagtggccgacagggagggtgttgtggtgtatcatcaagtgataaggccttcggaaaggctgtggagaggaaggaaaacacattcctgactgtggtgtgtttgcccttgagggccctgtgtttggggaagtagagaagcttggctgcattgttgtggggtgggagttagccctgtgctggggggagctagtgagagatgaattcagctgacctgggatcaaattccagcttggatgcctttaattaataacatattagaccatttaatcaatttaacacacgtttttggagtgcctactatgtgcaggcaggtaaatgatcttcaaggtgtctccatcaggtggaaagtcaaaaattcagaactgggcaatgactggaggggaggatgggattctcaggtgaagggtgtgagacccgagttgtgttttggacgatgttaaaggaggagatcagcttccagtagtgaagagcatctgatgctttggtgaggaggattttcttttaagtccttgaatgcagaagggctcctttggaagattttatgcaagagaatgccatggaaagattatattatagtggatcactctggaagtgtcatgcggaatgaatggagaggtaggaagcggggttgggagagcaaacgtaaatctaaggtccaattgggaggctctgttggaatgagctggcgagagatgatgagggcctgatttaaggaacgattgtattgaaggcactaaggtattggcattcagcgaatgtacatgagtctcaactttctggtttacatctgaatggacagagaagaggacatgatctgagcatcagggagttgatgtttgtcttggacattgcattaatatagttaggctaggcttccagaaactctgaaatcccagtggcataatgtccagtttgtttctctctcacagagtcagctgtgaagatggtggctgtaacggacagcttcttccaggcagtgactcagggatccaggctgtctcttgaggatatctggggggttatgtatttgccctgaaatacttcgccctggtgatgtcatgtgtgatttcctcccgcagacctttagtcagagctagacactgtgaagggctaggaattgtgaaaagattgtgtgaatgaacaggaaggttaaatttgaggtgccataggccatgcataaagaacagtccagatggcacctgggaccggatgcctggacaccatccgagcaggagattaatggaattgaaaatcagcaacgtaggagacagaagccttcaggatgtctgggatcctatagggagggtgtgttgtttgaagagcaggggctgaaggtggaatcttggggagctcatgacaggctggcagaggtactgaatttctccaagtctcagtttcctcatctgcgagatgagcctgatatttcctataaagggatagtgagtgcactgggtgctgctgggcaggcagtggctcctcataggggtggttcccttccccctgcattgtgttggactgaaccttgtgtgttctgtttgtcaggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctggtgagtcctggcgacttgttcacacttcacattctgtctttcttcagaccagactgacctgttaggcgaaaacaacatggtggccaagagcagccataaaactgggagacccttgttcaccaaactaggttggctacatgagtacagggaattgtcattctagcaccattttgggaggggattctggataaaaacctgggccatgttgaaagtcaagccaagaagggagaggaggcgtcaaaaggactccacttgggttggtgtgatgccattcatgagacagcccaccaaataggtgtaggcgcacagcatcttgacgaagctgcagcaccacgttatgcattttctttgcagtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtaaggagcgatggcctcactccttggtggctctcagccttccttgtcctcctcatctgggggccatggggctcatggaggccttgaaatgacagacagtggaggacatcctagaagccagtacttatatgacaatatttctgagggttggaaatctaagacctcttctaataggtcatttcttcctaaatattacatatatatttctttttaaaacaatttttaaatttttttcagacaaggtcttgctctgtcaccaggctggagtgcagtggtacaatcatagctcactgtagcctcaaactcctgggctcaggtgatcctcccatctcagtctcctgagtagctaggaccacaggctcagaccaccatgcctggctaattttttttttattttttgtggagatgggggtctcactatgttgcccaggctggtctcgagttcccgggtttaagcaatgcctcggcctcccaaagtgctgggattacaggtgtgagccaccacgcctggcttacctgtatatttcttatcattatcatcaatggaacagtaaagactgaaaacctacacagctttagatgtgactctgggtcagtcaggaacaaacttccttagcaaccaggtgacttactcagttaatcctcgtctactcttggaaatgggctcaatttccttaaaagtgtcttttagggctctctggacttagcatgtcttctactgccagcttccagtaggcctgctatgaacatacactgacctttagaggatctttgggctttttcattttaatgttttaaaatatattaacagaataggttttctgttttttagtgaattgtttagattatatgaagaatatatccttatttccagaagaataaggaagtaaataaaagtcactgtgtttcagatataaccacaattaacattttggcaaatgtctttccattttttgctactacacaggcacacacatgtatatgtgacatgcgtgagtgtgtaaataatattggcatcatacagctgggcccactcccaggttcatgcctataatcccagcattttgggaggccgaggtgggtgaattatttgagcccaggagttcaagaccagtctggcaacatggcaaaaccctgtctctactaaaaatacaaaaattagtgaggcatggtggcaggtgcctgtagtcccagctactcggtgtgggggaggcaggaggatcacctgagccttgggaggttgaggctgcagtgagccatgactgggccactgaactccagactgggggacacagtgagaccctgtttcaaaaaataataataataataatattggcatcatacatactattttgtagtcttttttaaaaaaaattttatcatggaaatatctccacctgcttaaatatacttgaaaaagttgatttataataacagactcttccatgtgagtgctaaactgggactcatttatttatttatttatttgagatggagtctcactctggagtgcagtggtgcgatctcagctcactgcaacctccgtctcccgggttcaagcgattctcctgcctcagccccctgagtagctgagattacaggcgtgtgccaccacacccagctgatttttgtatttttagtagagacagggtttcaccatattggccaggctggtctcaaactcctgacctcaggtgatccacctgccttgacctcccaaagtgctggcattacagatgtgagccaccatgcctggccaggactcacttataattctttttttttggctgggggagacagtttcactctttccccccaggctggagtgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggtttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtcttattgttttacatttaatttattcaattactgattagagtgaaaattttttcctatgcttagtggccatttgtacttttttctccctcttaataccagcttatttcctttgaccagttttttactggatttagagtgggtttgggaggggaagcacttgaggaaatgtgattggcacctaaaaccagatgtggggcggagacttctaggttggctagactagaagatgacatctggccaggcatggtggctcatgcctgaaatcccagcactttgggagagcgaggtgggagggttgcttgagcccaggacttcgagcccagctgggcaacatagtgagatctgtctcttaaaaaaaaattagcctggtatggtggtgcatgcctgtcttcccagctactcaagaggctgaaagaggaggattgcttgagcctgagaggccgaggctgcagtgagctgtgatcactctactgcactctagcctcaatgacagcaagaccctgtctcaaaaaaaagattaaaaaaaaaaaggaagcctagatctgtggctgtattttgttgaaaaggacagccaattgggccaaatgatatttcctaaagagggattgccacccctgcaaattaaacgaatttttttttgttttgaaataattatagattaagaagcagttgcaaagatagtacagagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagaaatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttgcaatttgctgggaaaagaatagttatttcattttctttagtgaggtcaataagattgttactctcataatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccagtatccatgcagaaaactggatgacagccattcttattatcttaaaggaattgattgactgacttctccctaacagaagtaccccccagccatttgattgttgttttaggatctgccgctttgggtatctcttccctctgggtctgggctttagagcttagagatgtcctctcttgttaacaggacccagggcaagtctgttaatgtcttacgctcctcagctgagagtgaggggttcagacgaggtctccaagtgtcctgtgattctgtgaggtcagcagacattaagcagagttgttagacactgccgattcctcacaagcaacatggtataggcagaaaaactgaaggaatatgcccagagggagagctttggaaaagaaatgggcctcgggcagaagagtttcgtgtcaggaactcatttgaatcttgaagacagctcaggccagcaagcactgacacctcccccacacaccacgacagcttagggcaggtttctggcatttctccgggacaaccctgggactttgccctgtcccagtcctctctcatttgcacacacagaggtgtttgggctgcaatgggctcaggctcagctctggcttctgccacctgtgaggaccagggtggtgggtgtttctcagaagactgttcaagtctgtgtttaaagctgtctttctccctctcccaccaccactcactggctcagcctggcagcgcagccttatgatcgcgccccttacagcccagatcatgacttcttgggtgtcctgactggctattttatggtcagggatcctagggccctgccccatgaacctccctattcatgtgcctgtaacttcacattctcattgactctttcatttgaccttctcaataaagggactggtattattatcccaatttgggaaaataaataaacggaggcttagagagcttaagtgaccagtctaatgttacatagcgattttgcggttgagccagaattagaacccaaaattgttcaggactcttccctgccagactgcatatgcagcctcttggtcaggcttagacggggaaaatgcttcccctctcttgcaaggttgcttcccccagaggtgctataaatggctggctgggctcgttatttaagacacaaatgacctagctggggaacttgcatttggagttcttaacctagaagacgagacagtgggaaggagagaagatttgggaagacagattctgccctccagacattttcaccccaacctaccctgcttttacctccaggtgacctatggaagaaatgttgactttcaaagcggtgcttttccatccccacctgttttaaagagccagcactaagcatgtgcctgttcgttcatcttctgggaaaatgcaaccaggagactttccctgcatagtacagtgtttcctaccatgaggctaattagctttagttcagagcatctagctaactattatcgacagccctgttgctaagcctttgcttggattttccaggcatctggcccgatgagtaattttagggagcctgtgtggatgtaggttaaaaatgtctatgcatggtgagtgaggaagcctccctgcatcatggtttgatggagagtaggctctgagtatctgggaattgtgatctgacccttggacttgtcaatgttaagtcactgagagtcatggggctggttcttccatcttttaaaaatgatagatggccccagaggtcttctaggtgctcatttataagcaacaagactcaacgcatgcattgtgtgagatcttggatgctgcagggctggcaagtgttagcaaagtgcaataaagagccagacagtgaatgagtgaagattttctaaatgcctactgtgagccaaatagtgagctagatgcttttgttcattttatttcatttgattctcacatgagtcctgcaaagggggacctacttacccctcacagatgaggaggtggaggctcaggggtgtgagggatgcatccaaagtcacatagctggtgaatggcatacctggggtgtgaacccagggcagatgtctccatggccgaggctgcgcccatactctacccagtagggcacaagaggaggttgtcagggcataaactgttagctgtggagtgatgtggaagagatggctcttgatccaggccttaaaggatgactcacaccctttcaaaggttgtttctgagatgaccagggatgaggctttttgtattgtcatcttcacatacacctcgggagggtgcagatgaagaaactgaagctgagacaggattaaagcaatctccccagagtcacacaacttctggattttaccgtatctgagatgccatcgattttaagatattccattaggttatgtaccacgatgaaagaaaacatgcccaagacgaggagtctcataggagactgggccaccaagggccagcgtgtgcttattatggcatctctggggagaccatctgctgtgcagacaggggtggcagaaaatctcgcaggcctcgaccttggcattggttgccaagagggaaaaatgtctcccccaagaattggaactggaagtgggtgcttgtccagccttgtggtctgaatgcatgccgcctgtgtggtccagaacaatgtcaagctgagaatttactgtaaaatgccctcagtggggttgtcccccaacccagtggcacaaacaaacccatatccccctagaagaacttggatttagtctaggctggcagtacccgcgtggctccggctgctataagacacattctgacttcagggatgagtgtcttagaattgatgaaagacaattttaagtcttgggtctcagtaatccaagtgcagagtcctcttccctccctgctggcgcctctctgctatggttcctttggtagcttctgcatgactgctttgagactcagagcaatgtactgacagccctcgtggttgttttcacccaacattgtatgcggggcattgtgcatttacatgcctgatgtgagctgctgagctggccgaatccgtgttaccagccgctgcactaagcagaaatgtcatcttgaactgcagggtgctagcacagctctctgttcagaggccagctccctgagtgctgataacctggtctgaactttcccagaagcccagggtgctttttatggttggagcaacctattaatcctctagtccagactcagccacagccattggtccccgtgaaccaaacaggcaggaagaagcgggaggcatttgggatctgggaagtagcactgggttagcagaagctgcaggatggaatgactcctgtgcaatgactcctgtgttctgttgcttcattaccaaccacaaactcacatccatatggagaccccacctattttccaagagggcacacagatatgtctctgttttacccggaaaaacttgaaaccagaaggatagctacatagctacattgttctggaaattaactagccctcaatcattttatcggaggcatgtctcttcagtgaccacaatcctttcatttagggacttcagtttaaccacaccgcaaacagactagaaaaccaggctagccagtgggaaaacctacttgtggatggctcatttcaagattaaatttagaacttggtcagagaaggcctttggaattcaaccggaatggagctggagatggtgggaacacagtctctgttaataggaagaatcattttctttatatttgtgtagcatttacaaacatgcacccttttcacacaattattctgtttaattatttttctttctaatgtggagaggtagaaaaagttatttcatattctagacagggaaatggagacacagcaagtaagtgcctgctggggtgcccagttgggacaggatccctgtctctgagtctctcttttgtctctgtggggttggggcagtgggtgctgccgggtggattgagtccagccagagtggcctgttctagagtttactttgccttcttctcagtctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcagggtgagtagttttgttctgatgaattttttgttaaatcacgaattaagttcaaggccacaaacatttattaagcaccttgagacagaatattaagatgaatttagtggattccagggataagagggagcctgaattttttattcctggcatttaaaatactggagaaggagtcagtcgtgtccacagagagccctagcaaagtgagatcatggtatatgctatgataaggagtgtggagtaaggacccagaggagggagccactgctgtagttggggagagtgtcatggggagaggacattttgagttgggctttgaaggttaagtaggagtttgtcaagtcaaagaagggagatgagggaatttgataagagtatcatgagcatagaaaatgtacagtgtattcagggcatgtgaagcaggaaagagatggagctataagggaattaaaaggagagaatgcaattggaaagaaagtttggggccagatcttgaacatgataccagatccgcctcacagcatgcttaggggattcttacagggtttaaagttgaagtgtcttgggggaaaaattgtaaggtgtgttagtttttgtagagttaaccagttactggaccttgtggggagttttggcctggcatggtgggagctggccccacacaacacctgtccacctgtctgtaaggagagccctccatccctagatctcacaggcccatcctccctccaggagggtttctagagaggtatcctctgtggctgtggcctgagctggggggactcttgtgttttgcagctggctgagctgagaggggttcctcgtggcctgtatgacggacctgtgtgtgaagtgtctgtgacgcccaagacagtcactccagcctcctcggccaagacgtctcctgccaagcagcaggccccacctgtccggaacctgcaccagtctggattcagtttgtctggtagggttggggcttggggagggcacagttctgcagggccagctcgctggtgctggcgaggctacagttgcatttggaaaggacacagaaatagaagtgaatgatattccctttctctccaacgtgagaaatacagtggactcagatctctggagatgtattttctttttcttttttttgaggcagggtctcgctctgttacccagactggagtgcaatggcacgaccttggctcactgcaacctccacctcctggttcaagtgattctcatgtctcagcctcccaagtagctgggattacaggcatgcaccaccatacctggctaatttttgtatttttagtagagacggagtatcaccatgttggccaggctgatagaactcctgacttcaggtgatctgcccgcctcggcctcccaaagtgctgggattacaggtgtgagccaccgggcccagcctagcttggcctggagatgtattttcatagttaatgactggttgggtttcagaatcttgagatcagtttgtgtcacacaatgcccatactgtgttttacctaatatattaagaagacatttgttcaatttattaggtccatcataagaaaggacactgtggtatttcaggacttctcttctctcctacagtatattgtagtttagcttgtggagtttggagtttcaacagcctaacttcagggctcagctctggctgtgcttcagtctcctcacctgtataatggcaataatagtagttgctcccccgtgaggttgttgtgagggttaaatgggttaatatatatgtacagtgcttagaatggggccatttgagaactgttagttgtatttgcttgggtaatttgtgtgatatccccttggtgagaggaaagggttcagatttttaagtttccttgcttgaaacttctttcccatctttcatttgtcccatgactagaacattccactcttccagctccctgggccacagattcctatggcgtattaaagaaattgttaaaccagagagaattttttttcttggtggttgtatgggtttttagaaagtaacctatgtcccatatatggattaccagttttcaaaacatttaaaaataaggaactttactttgttgtaagtaaaacgtgtataatcatgtctgtgttttctgatctctcaaagctgttccaatataaggtgccatcgttcctcctacttgtgattatatgtgtaggattaggggattagaatgccagaagagggctatgtcctcagaaaagccacagccaatttgactaatcagaacaggggacaggacagagtctaagatgtagtgatattttgtatatagttttactttctccagtaatagatccaacaacctttatacagtgtctgattctttggttaccttaggctcatctcctttttaaaaagtttatttttatttttagagatataatagtatctcactgtgtcacccagtacccaggctagagtgcagtggtgcaatcacagctcactgcagcctcgacctcctgggctcaagtgatcctcccagctcagcctccccagtagctggtactacaggcttgcaccatcacgcctggctaattttttaattttttttttttgtagagataggctctcactgtgttgcccagactgttctcaaactcctggactcaagcaatcttctcacctcagcctctccaagtgctgttagtaggattccaggcatgagccaccatgcctgctctccacctcccttctgtagtctaaacttcagtgaggttttaagagaagaacaaagaatgtgaggccgggcagggtggctcacacctcttatcccagcactttgggaggcagaggtaggaggattgcttgagcccaggagtttgagaccagcgtcagcaacatagcgaaacccctctttacaaaaaatttaaaaattagctaggtatgggggcctgtggctgtggtcccagcttcttgagggggccgagtgggaggatggcttaagcccaggagattgaggctgtggtgagctatgatggtgccatagcactttggtctggaaaacagagcaagacgctgtctccaaaaaaaaagaatgcgactagcacttttcctcctgagctgtgagatttcaccttcaagcaggatcttgtgtgactgtcctggcccctcacccgctcctctcttctcctctccctccaggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggtgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcagg

SEQ ID NO: 35662 - DNA, 122175 bp, Homo sapiens
gcgcactcgggcacgcgctcggaagtcgggggtcggcgcggagtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggtaagcggtgacagccccgtcccctgctactgctcgccagcagcccagctcccggaccggctccgtcccagtggccggcctcacgggcgcagacggccgcgtgtttgctctctgttccccggcatgggccacacagaaactcctttctccaacttcttaaatagatactgcttttaacatcccgtgagggccaggatgttccgcacgagtctctctgctttcctgttctttctgacttaacgggattctggctctctgattattctgcatttcggctgttaggattgtgatttcccccttttttttctgaagcgttaatcagaaactcccatccccacttttctctttgctagcaaggtcatcacagcgcattcttggatcggaaacaagaaggtccgccttaaacactttcgcctttaaaatgtttagatgtccttccagggctgagggtgattgctctgttgagttaagggggaatttgaggggagcaaatgccttcgctgcctatattgcctatgtgtaattaaaacataaattcacttttgaagttattgttctttatagctgctcagccttaattaagaaccacaaagcgatttgactgctaatcctggtgcagaatgaacaaaaggaagtgcactcactgtaattgctgggcatagccttgtccctgggtaaaaaggctctcctttactgtcttcccttttgctttcattcaaagcaactgtagaaacacgtgtaagtgatgtttcagaaatcaggaaagggatgtgtagaaaacttcatggcagggcagtggattgaggatggacatatgtatctggaagcaccaaaaataatgttcggtctagctaaggttttcttcatcattgagatacgtaaataggcagaaagtttcattattgtgtttaacagaggaatctatgtgtgagaaacacgtttgacttaacacttcactccccattgccttggaaggcttgattattaccagtagctggtactaatgaacttccagagagaacagactgcctcaagccattcttctgtcaagggagggtaattttgtaaggctaatatcacttaggggtgttggaaaggaacatgttgtaggcaaatggttcttttgatcatgattttgctgctctccggtacactaaactttatgtaagtatcaggattccagagaaagaattggacttaacaaaaagtactttgaaaagtgggattaaattattgtgtgtggaataagtgttagaaaagcagaattatttaacatcttatttgcagttgagtcattaaacaaatgaaacattttgaaaataatttcataaaatgatactatgaggtatctgtttttcagggattgaagaagtaaagtgcactgagttcagttttttaaaggtgcctttctgaagacatagctagtgaccgaggatttcctaagatctgtgagattgctctttattttctcctgttatattttttaagttggccaaaattatttttgaaatgtgtatctaagtatttctgtttaacttttgacttgttaaagtttctgtgttcaagtttgaatactcttgaagtcttatttttttcattttcagattttaaaattttcaaagaaaaggcgttgcctgatgtctgaaatctcagatgcctgaaattcaattgacaattactgaacaacagtctcttatttacataaaggtggggttgtcaatcttggctctcagaattttctcttgtaggcactgtgtagctaaaggttatttaaggtgatttcagaggtagatagattactcagtgattactaccctgttgcaaagataatgcggtagagtaacccagtatcagttacgttagattgctcccactgggaggcagatatgttaactttgggtcatggttgattaaaaggtcaaaagagatcttagagtttacctctaacatcactttttactatgaaatgttttatgcttggacttggttttgctgaaattttcctcaacttttggtaatattcttgctaaatgaaattcataaaactatgagtttaaaacttgtaagttaaaagttaaagtattttcttacaagcattgtgattaactgtaaaaatatgtactttaaacttctagtttaaactaacttgactaggatacttgacttgttcttggatcagaaatgacatcctggaagaaatcatgcatagtggaggaggtgggaagggggaaaggtttgtgtgtagtgaggttgaggtttctctttctgtcctccccccccctttaatgacaaggttatatgtatacatgtatgtttcgatcaacaatttatgacaagtaggcaaggtgtcatgtgtcactgtgtgttttgatgtttagcatattcactccccaactccagttactccatgggctgtagctaactaattatttcccatgaattaaagtaccgtgactgttttgtgcatctattaaatctccctcccagttcaaatttcacatacccttaaacaagtgatgcatattgtgctttgctattacagagcatgtgaagctagaaatgagtagtgtgaaagaactaggtctagccaccacttttctagcctttcttttgatgttgaactttaaatacagtaaactttaaaataagcagtcaaatcatacataagaaatgtaagtagttatgtaagtgttttggcactgacttttttaaattatgaaaatgaaacatgacattgtaaattcaaacagtaagtgtaatgacaagtgagtttctttatcactagctgctaagctccatgccctagagaccacccttcacaatttcttacattaatatgaccctctagaaatttttcatgcatacacatgtgtatataaaattataggatcattttaactgatactttttgggaggctgaggcgtattttaacagatggcaaatacaaatctgattattgtgcctgtatcatcacttgctgtacaaaagccaggaaaatcagtgttgattctgaaaacagcgctctcttaagcaccatacacagtcatccagggtgcagggtgcagtgcatcctcggataaaaagagttaaagttgctatgggaaccagaattgcactttctgcttgttgtggggagaaatctccaccagccacttttctaagaagaagtcttttttgtttcaccttcaacttctggatggattattcagttgctgttaaaaagtttgggttttatgtcttataagttatagtaagtttttatcagtaccagtggggtagtagttgatactaagattgtagctaaggatttgccttttatcaaacagccccattaattaatttgataatcattgtggatggaaacttggcagacaggatcctaatcttgagaaaggtagcttttcctctttctaaaaacaattagattaaggaaaagagtgcttataaaaccaacccaatcaaagtttatgaaactcctaaaattaacactgaaaccagattagtttccaagctcctcataaactgtaggaaccaatagtgattaaatgaagcttttaaatctgcatctgcatatcttttttgtgtgtttaagttagaataattgatatataaggctattgccttttattctctttggtcctctgctgagtgtgtatgtatttaacatggaacaaatggcaatttttccccccaggaaaacctttgcaaggtgggttctgactatgtcagggaatagctcactgtggtgacttcactgtggtatttgtgcaccctgaggggacactattttagtttgtctcacaaaggcctgatttacattttgcaggtttcaacttgagaagttaaggagctcttccttaatggccagcagttgttgaacacagttttataaagttgctgttggctgctttcctgttctacagttcactgctttttctccaaattccttctccattctaagggcattcaaaaaagaatttacacattaggggagaagttggagctataaggcattcctccccccccccacctcttccatttgtcattggtcacatttgtgggaggaatcaagttttgactatttcagttctaaataattttagaaaattgggtgtgccttttgctatgcactccttcctcctgtgcatacattctcatgttattgccggatattctgcaaacattttaaaaaatactcttgaaatacataccactgtacctgatagaaagatgtagaagattgagggtcctatcttcagaagattatactttgttaggaatttacacactcataatggcattacaataataaatcaagggtgtctatataatattttacagtttataaggcctccagtttatcactgatgagatttctcacaacgcaaggaaggcaaagatgcctaaggttgtgatttgcctaaagtcatgtgggagataggtctttgactacctagttgattgcattcgttcttgcagcttgcagcttctctaacgagtctctcgaaagaaagtctactttattctaagccacttttaaaatttcatgtataccctggttcagagataccagactcctttggttttccttgttttttcttctgcatacttctttttatttatgttcctagattcctctcttttcatgctgttcacgcttcgtggatgaactcgtgtttgtctcaaggctttatttgcaatttcatttgtaaatttgtaaattctaaagttgtatttctagtcagctctttttccagatctaaaatcttgttggttatggtcaatttgggatgtccagagaccatattcaaaactaaattcactccttgttgtctcacccaactcaaagctcttttggtattccctatctcagtgaactacactgctgtctaacactgagtttctcaaccgatgttgcccacgtctctcctgaaagaaccatgcttgacaggcttcatgagtaaagactactctggtgaacagataggatccactgctgtgtggtcggtcggttctgggtagctataacttcacccgtttctttcccaccaatcgttactataatctgtccaagactctactcttaccttctatatccagacactatgtgtcttgaatgcttatctttctctccgtcctctttgtctctgccttactgtaagttccttactgtaagttcccattgcatttcacctggattgttgccacagcctccaaataaactggtgggctttctgcctccagttttgccctttatatttgggcagccatcctttggactgagtgatgattctaaaatgcaaatctgatcatacaattttgcagctaaaaattctgcagtggttcctcaaggttttatgataaagtccaaactccttggcgtggtgtacagggtacttaggatctggacctttttgttgcttcacgtgttcacagggctgttctttggtttggaacacttctcccaggtgttaggactccttccccagtttctctctctctcccctttctgccccactccctggcttggattaagtctcccactgacgccaccctgtaggtatttatcacagtccctatcacataggattatctgtttctttacttgtctgtttctacctttaaaccatgaagtttttgaaggacgagtcaggggtttagtaatcttttagttcagttaaagatgactaatattggttaattgcttgttatgtattagcaacaatgcaaattcctggatgtgtagtgattcatgggacattgccctgacctcattcttagatgaggtgtagatgcagagacccatgtctctcgatttgggggtaggcaaatgatggccttcttagccaagtccagtccagtcctgcctatttttgtatgggctgtgaactaagaatggtttgtacatttttaattggttagaaaaaatcagaagaataatattttgtgacatgtgaaaatttcatgaaattcaaattttagttacccataaagttttgttggagcacagtttagcccatgtaacaaagcattgtctgtggctgtttttgcacaataagggcagagttgagtaatagcgacagactccatatgtcccagcccacaaaggctgaagtatttactatctggctctcatagcacaggtttgttgacctctgttctagagcagtactttcatgttatatagtaagtcctaagtgagagatgcaagcacagagaggattcacttcactgactgtttgggtggaggctggaggcattctgtctccagtgacacttgtctggcatagtgttcataaaaatatatgtacagtgagtgaataaatgaatgcctgaattataaaactcccagaacattgaacattaacttaaattcttcaaagcaaaacttttgagcttgtgtttattttttatcagtgccatctctccattttataagatatatgtcactgtaatagctaatattaaatgtagtatgtggttttatttctgtaaattttttaaaaaagtactaaggtatggaactggtatggaattggaaaggcctatgactgtccttttttgggtaaaaattagactgttatgtgacttgaaggcagcctagataaatcttaggcgaaaactcatgaattctcacatgtgaatatgtatttctgaaatgttaatttgtatttttttcctttaaaaatggacataagcaaattttatttaaagtatatatattctgtagtttcagctacttgggaggctgaggcagagggatcattcgagctaagaagtttgaggctgtagtacaccataattgcgcctgttgaatacccactacaccccagcctggacgacgtagaccctatctcaaaaattaaataaataaaatgtatatattcacatgtacattgttgaaatagattcttaaagggaattattaagcagctgaggggaaaggttacaatgaaatatttgcttgttgtatatagcatccttttaagtttagtgaagtcatcatgagtagatttagaagataggcatactgtttctttaggatagtgaaaggactgtaaatgtagagtacggtatagcccagtgtattccacattaaagtggttaggccgatgagcagtaaccacatattcatctaaagttaataggcagcagcaacagttgcttcttttttttctttttttttggagacgagtttcgctcttgtcgcccaggctggagtgcagtggcacgatcttggctcactgcaacctctgcctcctgggttcaagctattcttctgcctcagcctcccgagtagctgggattacagacatgtgccaccacacccagctaattttgtatttttagtagagacagggttttaccatgttggtcaggctggttttgaactcccgacctcaggtgatctgcccgtcgtggctgcccaaagtgctgggattacaggcatgagccaccacacccggccctgcttctttacttgttcatttttcctactggactttattgacagctgtaccactgttctgtttgggttttagggaaaggtgttaaagtttagagcagagctgtttgtttatttttactgctgaaaatttctgagaaggtttttaaaaatatgggattaatgtttcttcaagttgtcagcttgaaagtgtaaaatttcaagatgattttgtgcagatcctattactttgccttggttgcttgctataagacttgtttaagatagaacttgccctgtggagaagaatagagtagaataaaataatttaaaaataagaaaaaaaaagattaaagaaaaaaaaacacatatgtaaaagggccctgctggaatttgcaagcatctcctttcttgtgatataaagttaggtgtttgctcatttgggtctaaaattgacagcttgctaatggggttaccagaaaacccatttatagaaacattcctgagattttagagtactgcaccagactagggtggcactaattaagtatgtctgcttttctatgtgtgtgctcttctaggggccagcccgaaatacgtgggcccagtcagcctggtacagctacatattcatgaaataaaataaagcagacttctctctttcttagacaatggcaccctcagatctcttgtgggagaagaatcttatggtaaggctgggaaatgaataaggggatttaccttatttcttttgaactttaggagttacatttcctcagttcccttcttttactctttgtttccatctgtgtgtggccgcttcctcttatattgagggcaacattagattcttttatttttagatttttgttattttatctttttgttttgaaagttggaggagatagtaattcaaaatcagtcttcttcacattgcttgcttttttttttatttttaaagagacaaagtctcactctgttgcctaagctggaagtgcagcggtgcagtcagagctcactgcagccttgacctcctaggctcaagtgatcctcttgccttggcctcccacagtgctgggattataggcatgagtcaccatgcctggcctcttttttttctttttttgaatttggtacgtggccttatatagagttaaggactcagtaaattttgtttcatgatgataaatcacagtactgtgtatatatgaaagtttctgctaaccagaatgattgtttgtggcagtgactatacaggtacctgtctgttttcagagacatggttaatgaccagtctcttttttttcccatcttctttagagttctgattttgtgttctattcttgagctgggtggagctcaagaataaattttacatatgtaaaatttcagagctatgcatttaatatttgtatacttcattatatgtaaattattccttgaataaaaaaatgaattaagaaactttcagccaattgtagtacactataatatagttgattttgtttgtttttcatatgatttttggcttaggagagaacacaatgtgaggcttcatcatctaaaatatatttctcttagtgtctttctcctctgtaccagaagttgctggcattaatagacattaacagatatttgttgagtgatcaaatcagtgaactggctggttttaattgagttatgagcccattttcattgaagtacctgcagagccctctcatacaatcaagcttggtagacgcctcaggcagtggagcatgggaaacctggggaagagctgtcctctgttctcacctcactttaagcaggtagtggttttggttgatgcttcatcgtttgatgtggtaaaatggtaagtctgtgggttttgctgcaggtttagagaattctttaagaatgtctttgtgtggcatatgctttggtcacaatatctggtgcttaggtaacttgctatttaatttccatggtgaaatgtaaatgttccacatatcacttaaataatgggaagaccccatcttcattcatttaaacatggtctaggtaatggctttctcttattgagccttttagaaataaaaagtctgaagtttgaatcatgtggctttcttggagaaacttttatttttttttgagacagagtctcactctgttgcccaggctagagtgcagtggcgtgatcttggctcactgcaacctccacctcccaggttcaagcgattctcctgtctcagcctcccgagtagctgggattacaggcacacacaccaccatgccctgctaggttttttgtattttttttagtagagatcgggtttcaccatgttggccaggctggtctcgaactcctgacctcaggtgatgcaccctccttggcctcccaaagtgctgggattacagtcgtgagccactgtgcctggctggagaaacttataaagctatgaaatatttccagtgatctgaaaagatctacccacttaaaatgagatgagcttattgcattttgattctaattagtggacaaaggacttatgtaaataagactgctggggagaaaatggttcactcagacattatagtatgggatgtgtgagttatgatagatgttgaagatactttttatatcctaaagatagatttattcgtaatgtatttgagatcagacaaaaacattgacctgtaggcaaaataattcagttgaaacttttttctgagatggagtctcactctgttgcccaggctggagtgcagtggcatgatctaagctcactgcaacctccgcctcccgggttcaagtgattctcctgcctcagcctcctgagtagctgggactctacaggtgcatgacaccatgcccagctaatttttgtatttttagtagagtcggggttttaccatgttgatcaggcttgtctcgaactcctgacctcgtgatctgcccgcctcggcctcccaaagtgctgggattacaggcgtgagccaccgcgcccagcccagttgaaactttttaaattgttaggagaatacctacagagcattttgaagagtagggattgaagtcagcccggaaaagcttcccggatcttgaagaaaagtaatagacatgagtgtagggtgtttccaggaaggttgagttgtttgaataaagatctaaaagtagttagataatggtgaaggtattatttgccattcatggagcaatgaggacgtgccagatggattctgaggagaacttgaaagctgggtgacaaaagaaactaaattaccttttgtcaagtgcctcctggttacctctttgaattcttcagtcttgagaactattgttagccccggggaagaataatatgactagtgacttttctgaggttgcgtaggttgaaatccagacctgctgtggtacatagattatgtttttgccactctgccattttaggtcagacctgctgtaagtgatagtgaattctagaaagacctcaaattgaggagtaaaatgagagtgctaaggaactaagcattgtttctctgatagaccactgctttaggatctctggatttcgactgcttctgttaaaagggctttacacttaagaacagaggattttttttttaattaaaaaaatatatatgttttagacagggtcttgctctgtcatccaggttggggtgcagtggcacgatcctatttcattgcagcctcaaacacctgggctcaaacaaacctcccacctcagcctcctgagtagctaggactacaggcatatgccaccatgcctagctaatttaatttttttgtagagatggggtctctctgtgttgtccagactggacccgaactcctggcctcgagcaatcctcctgccttggcctcccaaagtgctggggttacaggtgtaagccaccatgcccagctgaggattgttttcagtggaagaattttaggttttgggcatatgtactagttgtatgatatttagctgttaatgcttctagaaatttctaaggaatttattgaatttgagaatgaggtcctggattttgtcagtgtctgttgatagaaaaaatatgctctacctgtgaaaagaaaatttctacacgttctgaatttattatgccaagcggaaaagttaggccctggagactgagtcacataacatggctgtttttcttctctggtgtgtgactgttgcttagggacctttgtgttgagatgttacctgtaaccagataccctattctttattcaaacctagactaaatgcagctggaggtagagacccctgtgattgttactgctttacaatggagtgttaagcaacccccttagagtataatagtaaccaatcaaatcttgtatctctatgttagccttatgcagaaaatgttgtaatcctgttccactcccctatttttcctatataaatgattctcacctttcccaatgctggggagtgctgaccaccattcttcagtgtccatgtttcctggaaaactaccctcacactttgtgcttgaatgaattcttttttttttttttttttttaagacagcgtcttgctctatctcccaggctggagtacaatggcgcaatcttggctcactgcaacttccgcctcccggcttcaagtgattcttctgcctcagcctcccgagtagctgggattacaggcacttgccactgtgcccagctgatttttggattttttagtagagatggggtttcgccatgttagccaggctgggctcaaactcctgactaggtgagccatctgccttggcctcccaaagtgctgggattactggcgtgagccaccacgccagtctttttttttttttttttttttttgagacaagagtttcgctctgtcacccaggctggagtgcaatggcgtgatctcggcacactgctacctctgcctcctgggttcaagcgattctcctgcctcagcctcccaagtagctgcgattacaggcatgtgccaccacacccagctaatttttgtatttttagtagagatgggagttcaccatgttggccaggctccgacctcaagtgatccgcccgcctcggcttcccaaagtgctgagattacagacgtgagccactgcgcacagctgaatgaattcttttaactggatcctctgtaaaaaacacattacgcttatttgtgaagaacaaaggattgttttctttttttgttttgttttgttttgttttttagatggtgtttcactcttgtcgcccaggctggagtgcagtggcacgatcttggctcactgcaacctctacctcctgggttcaagcaattcttctgtctcagcctcctgagtagctggaattacaggcacccaccaccacgcccggctaatttttgtatttttagtagagatggggttttgccatgttggtcaggctggcctcgaactcctgacctcaggtgatccatctgccttggcctcccaaagtgctgggattacaggcgtgagccaccgcacctggccccaaaggattgttttcagtggaagacttgtaggttttgggtacttgaactagttgcatgatattcagttgttaatggttctaggaatttctaaggaatttattgaatttcaggatgaggtcctggattttgtcagtgtctgacaggaaaagtgtaccctacctcatttcctgagggatgatcagtggcttcatttatacagggaatgccaccatcttatctcctttctgccttatccatgacttctttctggttgttgagaattgctgagttagttcacttgcttactttatctgacattattaaagataaggctgcctggtctgtcttcacattctagttctttccttctctgctccaagtaaattctaacccttacatggtatgttttgttgttaaagtttgctaactgaataggtctaacccaccttttgttaattgatgaatagctagctactgtagtcccaggagctttctttgtcagtattaacattattcaggttcagaagtgatactattcactttgatgtctgtgtatgtgaatttgcaaatctgtaagtctctctttacctcttcctctctctctttctgcctccctccttttctctttagtttccccagagtgttgccgagctaaggttcaatcagaggactcttagataccttaattttttttggctttatttttgaagaaagggatcatcgttcccattaggacatgtatttacaatgtgttttcttttgcttgcccaccacactctaccactacttctagaacttaaaattctaggattgtttttttctccctcatgccctatcccctttttaaaaaaagtcaaaactcttattatagtagaacttcacaggtttgaagttggctgattaaatatactaagtattactgaatcactgccctgccttttctgctttctttacagacctgtttagtatacattgtatgtattttttttttttttttgagacagagtcttgctctgttgcccaggctggagtgcagtggtgtgatctcagctcactgcaacctccgcctcccaggttcaagcaattgtcctgccttagcctcctgagtagctgggactacacgcgtgggccaccatgcctggctaatttttgtatttttaataaagatggggttctaccatgttggccaggctggtctcgaactcctgacctcaggtgagtcacccacctaaagtcctggggttacaggcgtgagccactgctcctggcccacagatgatttttaaatgcccttgctcagtttcctttcttacagggagagtgggtggcaccctgtgctacaccggagggctgagtgttgggcttaaaatgtcctcagtgtcctcccttctctctgctgttttttgttttgttttgtttttggtcagttggtaaactataaatgcataaatgttttctcaggacttttccatcaactttcttcagagagaatgaagggataatgatttccaagaaaagagttttgcagtttttagaaagagggtagtgacagcatgatgaaatgagctgaacagctttttttgagttttcactggcagggactgggaagtgatattttcctgccctggcatcacgaatcccaattagaggcaggaatctgctgcccacatgttctcaaaatcctcgaccattttattatcaaaaactgtaaggaataaataatttgacagtgtaaaatggttagatcaagatttggagtttaatagactcttagttttctggaatgtccacagagacatccgtggactctgaaaaatatttggctaactagaataataaaatcataaaattttggagttgaaaatttaagctataaaaaaaaaagaaaaaaagttttagggataggtcctggtttaatttatttaatctcttaccaaataatttaaggtaggcgtagttgccttgggtgagcagttttacctgtagactcgtgcatctgtgctaccattcttcagtggttcccatccatcatacccctattatgatggtgctggtgacatcatctgttttgatgccactaagtttaaagaattttttctaaaaaaattctggatcatgatctgatagagctgagcatgccggaattttcattgaaattgtgttcttttggaggtgggaataaacaagggactaaggataaagattgtggtggggtcgggggagggttagaaaccaaaagagcaattgtgtacttgaattgctttggtcatgtgattgccccttcttgggtaaagggtcgtgatcagtggccttcagtgtcttggattaactttcggagcagtccatacatagttttgaatttgtggtattttagataagttcatgggatagaaagtctattggagactataaattcttagaattctacaaattatgagcatttgtgggaacatctgtaatgcagctgtaataaaatttgtttattatcaggattgctttagaggctcttgctgggttgtttattattgttttcagcatttttgccatacgccctgaaatagcatcaactcctgggtagacttcaggatcattcagttttgtaggcattctaatcaggtttgggttttaaacatatgtccactttagagcttttatgtcctggcacagacgtcaatggtgaatccagaccatttcaagatggacactgattctggaattaacatacttcccagatgtttgtagtacagatttgttttctgtgctgtctttcatgtgttctgctgtgtctgtctctatctgtgctttcctctgtttttacttttagaacccctggggaaaggtaggtatctgctttttggattgggaaatagaataggtattaaatttttggtaaaaacctttgagtgggtattgacatttctgtgagaggagaggctgctttgttccctcgagggagactgttggtgagggtggtgttggaggtgagactctgaatgtaactagattcggacttcttcacatctctagtggttttcaattatgaaatgggcaactgatgctctgagtcagcagccttttaaccatgcctgactgaagagaacttgtgtttgaaattcacagcattgcctggatccctgctgtctttttgtgcctcccgctaacacacagctgtttttgttcatacatcattttgtgttcaactgcctggttacttcctcaggtcccttttatggtgaataatggacacatgggagtttgaacacccaagtgtgtggttattcaaacaggaagtctcaaggaagcacagtaactttgtcagaggaacaaaagatgggacaggaaaggctattgatgattctaggcttcaaacatctgctgggaaatctgacaatttctgaaatacagatattccatagcttacaaacaagttggtttgtttatttggaacttgttccattttttaaaaatcagggtattaaatcttcgtaaaatagaagtggagggaaaaaaaaggatataatgtggcatcattagtgttaaaaagaggagagaggctctgcctgtggcttgactgggtttcaggagaaaggctggagcagctcatcttgactgaaggtaaccctgaggctgtaacccggggtgagcacataggtgggacttgacagaggctgctagagctgacagaattggattaaaagatgattttatgcagagcttttgatgattgagcactggaggaatatgagataaagaagaatgtaggttgcacttaaagagcatgcagtccagtgggagagtaagaatgtgtgtatcaacaaattttctctgagacaaaacatgaagtgccgtgagagaaggatagaaattccatgtgattgcaaaggagatatgactatagaagatcaaaataaatgcttcccagaatgttgatctggtgaccgtgaagattccttatgaccttgggattccttgtttatgtgataaatgacttaccagaaatagtcaaataaatcctgattttagatttaaaaatgaaaattaaatctggaagtcaaagaagggggagctctggtttcatagcaatttatattaagcaagtggggtgatgcaaatgctacagaaaagagtactgtgtcaggcttaattaatggaagtgatagtattcaaaggagtacaagttctgtgcatcttattcccctgcctttaatttcagtcatggtaaactgttcatagtaaacatgctcccaccgtgtgggtactactacatttttttcttgactctttacttttctgttttttcctttggctacttcctaatcatctttaaaactcctgacaaatttcaactcctccaagaagattttgctaatttctaattcctctgttccctccagagcacttgcctttatgtcatttgatgtttatacgtccactcacttctaaaatccagtaagcatattgcatacctaggatgtgaggggtgctatattgtattgttttctctctttcccccattagctgagttcatcaaagacaagacgaatccatagatttcttaattcattcatttacaaagatttattaagcacctgttacacaaaaggtactgcatagtaccggagacagggcagagaagacctagagcttaagttctgggtaaaaaagcatgcagtacaaaggacctgacctagggaggatttcattggcttcccctccaccaccccactgacttttatgcccctagtgtacggcataataccttttatatggtagtaggggttcaaaaaagtttgctgaatgagtgaatttctatttctttgaggctatggacacagaatgcagatgagtgcaagaaacagcaattttgtttaggttttcccatgatggaatttgccttgtagatagggtttttaaaattgatcaggcagaataggatggctagtacatggtatagtttcctcaccagcattgttagatgaagagtaagtcactgtatcaaagagccccagtataaagtaataaagtaaataaaaacccagttttaaatcattgaagtttgtttctccttcaggtggtaattctgaggtcagtggttcaggacagcagggtagttctccacgctgacattcagggactcatgagtgtttcctggaaataatctgggatcctttagggtatcattcttatgtgcctggttgaggctgggtgataggcccctgtgctttccaattgggaagatattgaggagtgtgtgcctaaatcttaacacttgaaaatcttacctccccaaagtgccataacacctgaaagtgtattatctgccaccagagagagcttagtcacttggccacctcataaacacagtagaggctggaaaatggggtctagctgggtggtcttgtgcctggccacagatctattacagtgatggatgggttggtggggagagaacagatttttggcagacagctctgccatgccaactcctgtgctgaagagtctggtttctcccaagttctggtctttctggagagtcttcagaggttcccattctgtggctggcagttgtagggagtggatatagaaaaatagggaccacgctcactgtggatcctcacaactttagcttttcagtaaaagagcctctgaagaaagggtgtgtactcattctgctcttagtgcacagccttcactccctgactttacagaattggtttattctttgaccttttccattttcacacccccagccctctcctggcactgagatcccactgtaccttcttggtgttgtgtacttacactgatgggctctatgtctatctgcctcggaggagcacatcccacatgggcattgtctgaattcacttgacgatgctgatggtgtttaccttcagctgtgacagaccaatcagagctgttttaaaatccagatgtcttttaggaatgagagttccagaagtgataaatcagtgctttttgtggcttgaacatatacagttttgttgtggaatcttcttaaatgtatatttatctttttcttcattgcgagttcattgaaggcagctgtgaatcatgttttaaccattaattaggtgtccaacttagagtggggtgcttatgatctagtagatttaggaagatgggtgtatgttacataacaccctcagcaggacccccatctccaagcaattgaatatatctgcagtaaaatgtattcgtacgaaacagactgatgaaaggctatcatagcctcacactaggtcatgtattgttgtcacacattatgaaaatctcctgctgtttagggctttttgaattgagaatcacagatgaaggattatggacttatatcacatttgattacgtaagttatatcacttttacagatagtgataaaactactgaagactatataaaaatgtgaacaataggcatctggtaaattggttatctaaataagcagataaagtttaataggaaatttcatttcattgaaagggtgaattttgacatgttctaacaatttgagtgaatggattatgaaattatggtaacaatatttagaactacagatagggcattacataaatgtttaaaagaagaaaagaaatagggttgaattctgataaaaagtgacctattagaaaagtatttctattcctctagggacatccgttcaatttttgttgttgcttcattgatttttgtaaaaaggtgttgccttttaaaaatcattttagaaaggcaatgtcatttttaatgacattactaccatgcatagttttgtgagaaacctggctatgttaaagccatttcatttgagatacattttgaattgaaagttattctgttgttcttgttttcagaagcagataattttggcgatgtctgtgtccttcttgtctgctctttatctgtttacctacctgcttatcacaactaactttctgtccagttttttttaatccttagtaaatcagtgtctaggaatctttagtcactcagttttgaggatgactgtgtaaatggttataaatgattgcttttgcctgttgtgttctgtcagcttggtttttgctttctaaaagattacagtctccttgaattgacatctttcttttttatttttttaaagtcaaactcattctctttatttgtgcagagtcctttgcccaaaatacatcatgttgtcctctgggctttactgtcctagtttcttttggaagaaaaatgccttctctataaattcttccccacatcttagaagtgtgacacagcagtgcttactgtatcactcattggtcacttgagcataccatcttctttgggaatcttttttatgtttatttattttcatatgcacccagcgtgggaaccgtgttttaaaccattaggtcagtaacttagagctgggtacttgactcgtaaaacgataggcatttaaatattctttggctcttttgatgaatcagaagattcaattctaaactgacagagaaacctaggactaaattaaaaaaatatatccaggccatggctttggaagggtgtttggaagagctgtgttcactaatcattggagaaaggccacggagctatttcctcaagatttaagacatcccccttttgtggacagtagtaatagaagacctgtctgttctgttgaactttcctttaagaactggaaaataactgaaaccaaccacaaaattgtttctttttaagaagcgttgtcttcctttccaggatccacaatgccaagttaaatacctttctttttttagggtagcagattttctcacactgagacttttaaacgtttctgttatattaattgtaaagtgtcatgaagttggtgtctcaatgcttaaaaaaaaaaaaagatccactaaagccttcttcttgtcatttgaaggttattaaaatgtaatacttcccttgtacattcttaatactgatttccagtgaacccagggattatttctcagagaggaaattctgttgtcacctaggctaataattaccaagtgctcaccagtaacaactagaatcttctcagtaggttttttttttttggctttttttgttttaaatgtatatggccagttgattagtatgaattattgttttgtacttgcaagtcaatacaaggtaaaatagataattgtttatgcagccaagtattctgttttagtgcacataaatatggagtagaaataaaagtttccatatgaagtagattagtaactctagggacatttcttccaattttcctcaccccaggtatctactaccatggattttatgttttagtcttttgcttttaaaagaaaatagttttgtaattcctaaacaatgtattgtttgtttttgagctttgtaaaaatggtattctatatgtggtaattggcaacttgccaattgaaaaaaaagttcagtatatttttgaagtgtagctgtagttcattcatttgcattcctgtctagttaagattatactacacctaagcttttgattatcctgctgatggattttttgttgttgttgttgttttacgaatagaacgcttctatgggcattctcacacatgtctcctgatgcctatgtgtgagattctctctacctgggttgctgggtcataatacatgagtttttcaatgttataaaataatgcaaattgtttcccagagtgatcgtgctagtttagatgctcaactagcagtgttaataggcctgttgatccacattgggtattgtgagaattctcaaattttgatcatttggtggtataaaattgtatcttagtggttttatttataaaggagagtatcttttcatgtgtttattggtctttcatatttcctctccgcaaaatgtctcatcatgttttctttcccttattgatttgtagaattcttcatatattctttatactaatcctttgtcagttatgtgttttccttatcttccagtgtgtccagtgtataatttgtcttttacattttttctgtgatatcttttgaacaaaatgtcttaattttaatgcgatcacatttgtgggtactttttctgttagcccttttgagtcttatgtaagaagtctttccttatattttcttttaaggatcttctgaagttttgcctttctacatttaagtttatctggagtcgattcatgtgcattgtctttatctgctaggacaatttcctttccaacttattcttctattttagaaatatcttagctatgtttaggcctgtgcttatccatgtaaaatttagaatcaggttgtcaagttcctcagtaagctgtttgcatctcgattgaagttgcattgagtttgtgtatccatttggattgaattgacatctttattattgatttttttctccatgaacatggtataatttatatcttctctgtttaactccaataatatttaatagttttctcctcatgagccttgctcttttcctgatggatttattcctagatacattttattttttattgctattataattttttctgaattacactttctaactcttttgtcactggtatataaaaataaaactttttttgtgtgtgttgaccttataaccacttgcttaattgttttattctaataatttgtctttagcttctattgggtttatatgtaggtagtcatcatctgtaataatgacagttttgtttctccttaccaagccttaactcttttacttttttctctgttgattagaacaatatacagaatacatttaaaaaaattccccttaaatattatgcctttataaagctctgctaatttgataggtgagatatgttttaaagtttatctcttttataattatgaaggccattcttaattctgttgcataatatttatttctgtaagctacctcactttttttgtaaagaggtatgatactaacagtttctttcagcttagttttcaacttcttttgctgtaaggccattttaagaaatgttttgggtacaggtttcagttaattaaaatagctctaaaatatcaaattaggtagtatacagatattattcacctttttggtaaaattagctaccaaattagttgctgttcatactgtttgatgcaataagtggtaatctggaaaatggaaacatttctattcataaaattcactggagatttgattaatacatgtatttccctaaaaaacaaagcaaactgaaccagtggtaactcaaggaagcattgatagagggacttgggttttgttttgttcttcataactaaatcactcaattacagagtgtgataaatttctcaagcttctgagatattttaggtcagtctttatatttttatatcaattctgtggatcatgcattttaagctcttttgtctctttctcttcaaaactgtctaacgccctctgaaaccttatttatcatctgagaaaggattgcatttaaaagacttggaacaaagagtgttgaatgtatgggaccttgttaaaatgttgtcttgtaaaatgtgatagatatgagtcttttaagttttggggatagatagacccatgtgtaatttgtctgtaaacactacagaagtagttctcaaatgagtgtggtactgtccccgtaggggtatttagtggacaggaggggattgtggggaattggaggggatgggagacagtcccatacaacaaagaattgcccaaatcctgcctaacttttggatttctcacgggacatttgtgctattaaaaaacctgattataaatacctgagcctagaacataactttgtctttacacataaacagtttttttcataactttattatatgtaatttcccatgaatacaaccaccatgtatataaatatttttttagcttaccgagagttagttcaccaattcggaaggccccatctctgccaacgctgcctctcatgatattcaagttgcccatacaacacatatgtaaatcagtctgcttttctagcaatcagagtgaatctgtgtaccaatttgtatattcttagcctctttttttctaaaatatcaaatgtaaataaaagtgttgatagtagctgaaattttgaaatttgctttcaaccatcttttcctaaatgtgaatagctattactgtgtctaccttgtttcttcttacggaacaatgaaatcactaagagtaagtgaacattttacaaggaaacatgctgataaagttggcagagatacgtcattgtccctcagtgtaatttgttctgacctgttatacctacttagttaaaatgtcctctttatcttaaaacatacaggtaaatctgctggtgctacgtttcccaacaatgatttttattgcagtgtccacctatagctctatcctttcatttcctgtatgccttgtacagaatgacatccaattctgtttttaaaagtataaacttgttataaataagtacaaatgtctgatagctttgttatacattctagtatagtaatccctgagctattacctattaaaaggcgtgtatttccttttaacttctgctttatgttatagttagagctacacacatgtacaccacccaccccacttgtaagttatatatgttgtagattatataatttatgagttttattttgggatggtaaaggagaagcattttaaaatatttgttatagtattggggacatgagtgtctgttgggcttgaaaatcttcactttacagcacctcatcctcacacgtgtcttttaaatagtcttctgcccctatattctctctcccttccgctctgttgtacacaggaagccaaagccctctcgaaaataccaggtatcacttcctcctattcagattcttagccaagttgttacctagtattaacattgtggtatatatattgtctcaccaactggagatatgatggcagggactacatcttgaatttcttcctgtctttattattaatatagttctttgcatctaatgtgtactccagaaatgtttgctgatatttctagtctactttcccactcttatagaagaaactaaatttggagcaaattctccaagttttcttactaaatcttcatatttgttgtatacaactgctctttaaatagttctcagcagaatcatcttaatatttttcttggtaaaatgccatctatagcatccccaggtgtagagaagacatacagaaatggaaagactttaatactggtctgattgtaattacagtattagaataagttgtggcagaagtctttttaaaaaattgtataattgtggtaaaagaaatctaattttttaagtttatctacagaggttgtgtcaataccatattcttgatttattttcttgtaactattttctccaattttgaatttaaggtttttttgttttttttttttgtttttgagacggagtttagctctgtcgcccaggctgaagtgcagtggtgtgatctcagctcactgcaacctccgcttcccgggttcaagcaattctcctgcctcagcctcccgtgtagctgggattacaggcatgtgccaccatgcccagctcatttttgtaattttagtagagacggggtttcaccatgttggccaggctggtctgaaactcctgaccccaagtgatccacctgccttggcctctgagagtgctgggatgacaggcgtgagccaccatgccaagccaaaagtgtctgttttcttatctccttaaataccatactctcccattctcaccaaactaaaacaaaaaaaaaaaatcattctggattttcttcctttgtgtcaattgtgttctttattttttaaactgggcataataggaatagtttgggcagcatcaatagtaaatcaaatctgtagtagataccatttcacatgtgtttccgtgcattatttttttcaaattcagtctccttgcataatacacttagaatcttatgtgctaaagatgtcgttcccactcaaggtagtgttatctgccagttgacctttatcaatcagatttcaaagttggtgttggttatattgtgtactctccatgtgagcttttattatgttgtttagtcatcttttgaaagatagtgttgtctctatttaaccctatctcttattagaaattacttctacattgtgactgttgtaatagttctttgatatatttacctcactttatcaatgtttctgcttgttttctcagattcttttttttttttttttttttgagacagagtctcactctcgcccaggctggaatgcagtggcgtgatctcggctcactgcaagcgccacctcccaggttcacgccattctcctgcctcagcctcccaagtagctgggactacaggcacccgctaccatgcctggctaatttttttgtatttttagtagagaaggggtttcaccacgttagccaggatggtctcgatctcctgacctcgtgatctgcccgcctcggcctcccaaagtgctgggattacaggcgtgagccaccgtgcctggcctctcagattcttaaagatagaatcactgggccaggctcggtggctcacgcctgtaatcccagcactttgggaggctgaggctggtggatcacatgaggtcaggagttcgagaccagcctgaccaacatggtgaaaccccgtctctactaaaaatacaaaattagctgagtctggtggtgcatgcctgttatctcaggtacctgggaggctgaggcaggagaatcgcttgaacctgggaggtggaggttgcaatgagccaagatcgtgctgttgcattccagcctgggcaacaggagtgaaactccatctcaaaaaaaaaaaaaaaaaaaagaattactgaattaaaagacgtggatatttttaaggcctttagatgttacagtcctaaattctgagttagcaggttatgagaatatctgttcctctgagaattacctttcctcttctcctttcaaattatttttttatctgaggtgtttacttttcaatattcaatagttaataagtcacagctgtctaggatgcaactctgattttgattgttatgatggattaaagatgaccacagatgctttgacactcctccttttgtgtgtggactgggctgtgactgctttaaccaatatgggacagtatgtgtgatgatatggcagttctaggcttagcctttgagaggatgggcagcttccacctgccttttggatcctgaactgccttctagaagttcaactatcctgagaccaccatatttgacaggacatgagcaggcatttctggtgagcattcctagctctgtccagcctttcctccatccccatcaaggcaccaggcagatgagcccacctggcagctgagtaccactgtgtgacttcagtcaataccgtgtggagtacacgaatcatccagctgaacccttcccaaattcttgactctcaaaatcatgagataaaaatggtggttgttttaagccactgagctttggagtagcttgttgtgcagcagtagataactggaacacttactgagtctctgggattattgagttggagtgcctatgctgctcttcccaaggggaatcagccttttttccttcctggaatggttgcttagaagaacctgtagacacccagaggaagttacacttttctttggctttaactagagagccatgggagaggagccagaaatatcccgaggctatgcatttctgagttctaactgaagcctggcagaaatttcaaaccaagttatcacagggatcttgtgtctgagagagcagactgtcttctggtcagtatccttgtgtgtctaatgaagggaagacaggtgcagggatccatcttcagggtgttctccaggagagccataaatgtaacagtaggaaaacaagctatgttcatattcttggtttctgcttatttctctgataaaaaatcattcctttcattggtttctgcttgttcatctgataaaaaaatcattccttttgttacctgtcaaaacatacagccccctgattgcaactcaaggtgctctgcactgcgtatccaagagtaaccatcacttctgcttcccctgttttgttgcatgtgttggctagctacctatccatttttgtgttctcatccctttttctttctgttctgtctttcacaattaccctactttccattcctcttcccatctctcccaaactctgctaattgatattctggtcatactaaaaggctaatctatctatctttcttttgttctttcttttcttttttttttgacacagtctcactctgtcgcccaggctgagtgcagtggcatgatctcggctcaatgcaacctctgcctcctgggttcaagcagttctcatgcttcagcctcccgagtagctgggattacaggcatgcgccaccacgcccagctaatttttatatttttagtagaggtggagtttcaccatgttggccaggctggtctcttaactcctgacctcaggtaatccgcctgcctcagccttccaaagtgctgggattacaggtgtgagccaccatgctcagccacttaactttctttttcttacattttcatctctttatccctcctgctcatgtcccttcctctccctcaccttaagcacagcctgcttgggtttttgggtgtgtgtcttataataatatatcacttagtaaattataagcaacttgagaataaagaaggttctattcagtcataatgcttaagagtgttcatcaaattatttgggttaaataaaaccctttatttccattttcttctcccttactgaaaaaagctacactaatgttctctaggattgatgtgcatagagaatgggaacttaaagaattattgtcttaagggtatgtgggtttccttatccaaacacaggtaaatgagggaagagatgtaaacaacgattactctgttcttcctagtgttggttggagttctctgtacttctgtttcctgtccaaggagggagagatccgtcattctgaatttatttgtttgaatttatgggacaaaaatgctataaatcaaatcccttgttagggttttccagtgcgttaaatgtaaaaacttgaaaagtttgctgaaaaacttggtttccgtgtccatatttaatagatcatattttccccagatattttcgactatagccattataagaaatatattttgtattgccacctagtcagtacatatagctgaaacaggtttatcaaagcaagtctaaccattatttcctgtatcatactctgatattttctattcacttctaattcttttttaaaaatgctcatctggatctgttttttgtgtgtgtttttttttttcatttcaaactaatgggttgtttgaaaagtattgagttacataatagttgcttgaatggtaagggtctgattctgagtctcatcagctctcctgagagaattggtgttcttagactgcattggtggctgaatctgatcagaacatttacattttgtgaagatcttgtataatccaaaacattcataatgaaagatagttttggttttttttttttgacagagtcttgctctgttgcccaggctggagtgcagtggcacgaacttggctcactgcaacctccatctcctgggctcaaacgattcttgtgcttcagcctcttgagtagctgggattacaggcgcacaccatcatgcctggctaattttttgtattttagtagagacggggttttaccatgttgcccaggctggtctcaaactcctgagctcaggcaatccacccgcctcggcctcccaaagtgctaggattacaggtgtgagccactgctcctggccaaagataggttttattattgggaaaaagtgttaagataggtgaaatctatagtctttgctcaaatgttgctttttattttctaagtgtcatcactagtgttttgcagaatgttctctcaacaagcagtactgcctattgaggtgggttgatttgttgttctgaatagttctgccacctccaatttcattttaaagtcattgattttcaggtgcatttgtaaggctagcatcattaatatcagcacttaatagctaacatttattaactactatgtgctatgcatggtgttgagtgcttttcttagattaatttaatcctcagcacaacccagtgcggatggagcactctcccagtttacggaggaggaagccgaggcatagaagccacacagctatttgtgaggattcaggctgtgcactctagggtctggttatagaggctgttctctgaatcacactgtgctctgcctcagaataaaatgccttctatacaacgtggctgtaaccttaacttctggggactggtatcacttgttactctttcctaaattttggggtcatttccagtattctaatggcaacgatactataacacagcccctaggatactgatattctgttatattgagaagaaagcaggggtaaataaggtcttttgacattttaatgaactgattgcttagggtttcaagattaacccaccccgtatattgcaaggtcgcttctcagcctgaagtttacttaggtgaaaaacaggacattttatttctttagtgtctactttatgctagacacagttcctggcttggagactacaaaactcaatgtggagcatttggctttgattaagagggaagccattgattattcatagacttctaggaccacagccaccttagagccttaggggcttttcccacttgaccccttcttctactgaagaggagcaggccaggaagccagtggttcctcatggtatcaggattccttgttcttggtgctctattgtgttgccttttcttctgccatcttattcctttgattagtgagaactttgtgcatctttttttttttttttttgagatggagtttcgctcttgttgcctaggctggagtgcagtgacgcaatctcggctcactgcaacctccacctcccgggttcaagcgattctcctgcctcagcctcccgagtagctgggattacaggtgcctgccaccgcgcctggctaattttttgtatttttagcagagacggggtttcaccatgttggccaggctggtctcgaactcctgacctcaggtgatccacctgccttggcctccggaagtgctgggattacaggtatgagccaccgcgcccggacacatcctttctttatcatttctcttcctagtgtgtgaaatgtggcgatagatgtttataaccacttactagggattgactcagctatgaacttgatacctgcttagggtgactaatttagcctcttgaagcctcagttttctcatttgtaaaaaaagttagggtaaaaatataccctattgtgtaaaaaaaaaaacctactttataggattgatgtgaggattaaatgaaataaaggcattaggccgggtgcagtggctcatgcctgtaatcccagcatcttgagaggccaaggcgggcagatcacaaggtcaagagattgagaccatcctggccaacatggtgaaaccccatctgtactaaaaatacaaaaatgagatgggcatggtgtcgtgcacctgtagttgcagctactcgggaggctgaggcaggataatcgcttgaacctgggaggcagagattgcagtgaactgagatcacaccactgcacttcagcctgggcaacagagggagactccgtctcaaaaaaaagaaaaaaaaaagaaataaaggcattaatagtgtttatgtggtgtttggtgcaaagcaagcatacaattgatgattatttttcatgagcttaataaaattgagggtgtagctggggacaccttttggaagagagagattatagagttactgttggattaaaaagtgtcttgtgtatggaataagaatcaagtggcatttttatatttttatatttcagtcctctttctttagtaaagatggagtagaactggcccagtcccctctgctgctgcccagtgctgctgaaagggcagtgtggtgcagtggttagagcatgggctgtggaggcagatggatctcaggccagccatgcttcagctgcctgctgccatgtgtcaggcctccttggatataaagttccataatttcctcaggtattaaaagtgagccatagtgtttcccttatgggattgtaaggtttaaatagaatggtgaacatagagcagccagtgcagcacccaccccatggtcgatccaccctctgcttccttttcattttctctgatacttgacgcttgccatatatgggctcctcttgctcccagtttctgtttcttccctgtatgaccttaccaaatctggtgtgtttattatccaccagtcacgtcccactgtctttcaaggcctgacctgagccatcttcatccttgaagagttcttccaccctcctccccccatccccccgttcaccaattcattgatctgtcctgaatttctccagtaatacctgtttggcacttaactagtccatgagggggcataaagggacctcgtagaccttggaagtcatttagtcgaccacgctcattatacaggtgaggaagctgaggtccagggagatagcaattgcttaagatcaggtttcccatttctagactagagctttctccaccaccctatgtaccgtttctgtttttaagcctgtaaaacaacaaacaccacaataaacaccaaaacctggaaataggagattatgtatgcagacttgtacttcatgggacagagagctgcttctgggtttgtactctgctcagaaggtgtatgctttattttactttagttggtaggtatactatatgagtaattctcttttctttaaaattgtaacacatgaattaataaacatacatttactaagcatctcctgtgtgcaaagctttgaggactgtgagcttcataaaagagtctgcgctttcagggcctacttgggctgttaaaaagctgtaaggataaggaaaatgcaatccgtattgagattcttgagctttctaaagtgttgtttccccacaagaactaaaaggaaacagattcagagaaacacagattggtgttcttaccttgttctctcctgtaccctctccaagaaaaggtatttagtagtggaaggtatattcgtttatatttcaaaggcacaatgatgtctgtttcacagctttctggatgtggtgagggactttatttggtcagccctcattccttaccactccctttgctatctttgatgggtaagcagatttcatgaggcaggccagtctctcgtttcactaggttgcctgactctctgaaaacttcctgactatcccaaaccatatagaaatttattttaaaagtttgacagctggccgggtgccgtggcttacgcctgtaatctccgcattttgggagcccgaggtgggtggattacctggggtcaggagtttgagaccaggttggccagcatggtgaaaccccgtctccactaaaaatacaaaaattagccgggcatgatggtgggcgcctgtaatcccagctactcaggaggctgaggcaggagaattgcttgagcccggggaggttacagtgagccaagatcacaccactccactccagcctgggtgacagagcaagactctgtcatacttttttttttgacagctgtcaaactgtagcctaagcctgaagggttgggaagttgaaaatatatgtcatatatatcatgctcatttaatctctattgagatgttctttttttccttcttacataaatattatgtgctctaactaaacatattatatatttttatgtgcagttcaatgcataaggaattgaatcacaattggaagtcctctttagaaggatttgctcttgtttgacagataatagcagacttcatctctttttaaaaataaaccatcagtttatgtcattgagtatatttgatccttctaaaaagaggttctctttcatatttattttttgtctatgatgtagttttctaaaagttcgtctctattggctacttcatttctgttctaaatgtagtaagttcttggaagtgtacttagaggcaatttaaggattttatcttaagcctgctgacttgtgtagttgagtggatgctagtttttggtcagttgttctatttcatacctgtaacataaggatattgagggtgactgaattttacaatgctttgcattttgtacatctttatatgtgtctgcttcttgaaatcattgctttttgtgataaagacccatctatggttatttcaatttgcttggcaggtgtatatttaagtctggttttgtttcttctagacagttatttgataatagagattcatattgttttctgtctccagcaaatactcactgaaatgaagaatgatggatttggtgatttgggagtctggtgtgtgaaaacacatcttaaaggattcaggtttaagttttttagttcttatacacggttcccatttttctgtaatgtcttcttatgtctcaatatgtaaatattttgtctttacttatactaatgtttcttgttacccaaattatctcctaagactgtttatgtagacttgaaatatttcttctgtctgtgggtgtgggtgtgagtaccttcccaaaaacatccaggaatttttgcccacctacttggtttccctggagcatgaaagaaggtgattaatggggtagaaaaaaattcacaaaaagccaccaacaaaaagctacctacatgtttacatgtattttaaaggaaaagcctgtcagctgcaatcaaagcagcaagggctcttcaaggaaggtaatatctatatgttgttctgttttataacatgtaaaattttctccccttgggaaaaaacgtctcacagaagattttcttgcaagatgactatgatatgacaggctctgtttttgttatgcataggcagttgcttctattgtgttccctgcagcctagtgcgtgtgtattttcttagactcatctggtagtgaagtggcctctagctcaggtcttcacaggcagaacatccatgctttgaggaggctgtattagcaaaataagaaacctactcagagataagggagaagcttcattgttgatgctgttattaactcaggctcagcttcctggtttgagagatgttctgaatacatattgatggatgggttattaatacattacatcatggtggaacttggcatcccagactggataagcccacttgccctgttatataccagcatttgtggtttgtattaataactctgtaatcccagctacatggaaggctgaggcaggagaattgcttgaacccaggaggtggaggttgcagtaagccaagatcatgccattctactccagtatgggcaacaggagcaaaactctggcccaataataaaaataactaacccagattgtgtgacaggagataatggaaatgatctgagtggccacctaatttcagtgaaggaactagccaaggtaagtgacttgctcagtgtaagtccacaactaatttgtggccactcaggacattgaactgggtctcggagcaaattataagataggtaaaacagaggggacacaaacgtggaatagtgagagggtgaggagagtgcagttcaggctgggatcgtgtgtggcatattcgtaggaaaccacagaatctgaagttagttaggtttggatttcatttaccacttacaaactacgtgcatcagagtaagaaatttaatttctctgactgtaggttccttgattatagagatgttgtaaagattaaatgagatgacacgttggaagtttctggcactgtgtaggggacatcacatgttccatgatggcagctgttattgttctggtacctgaagtgggaaggggagcaaggaaggaaacgtgaggattgtgatagtagggagggctctgttgattttgaaaggagagtcctttcaaagcaagcctttagaaacctcacatctgatcatgccactcactgtctgcttagaaatcacccttggcccctcatcatgtagctagacttttaagtccttgtgaatgtgcctttcccacttgctccttgcaatccatttgtgctgtatctctggcagttcctggaacatgacatgcattttcattttcatcttaagtagtatggcatgcaccaatagttccagctactcaggaggctgaggcaggaggattgcttgagcccaggagttcaaggccagcctgggctacatagcaagaccccatctcaaaaaagaaaaaaaaaaaaaaagcaattacccctttaccctgtccctctgtcctgcatttgccatcctttaagactcaattcaaactttatttctactgtgcagtctcttggaccaggctctcctcatgtcttactttctcttgcagtgactcactacgcctattgtgtttccatagtaccctgtacacaatattacagtgcttactacactgtgtcctaacgatttgtttacatgtctgactcataattatcattacattccctggggacaagagctagatcttaatcatgtttgtattcttagcactaagttgatgccagacacacagtaggcacttattagatgcttatatgaccgaatgaatgggtgaaaagcagaagtagagaagttatcttaagttgatataacagtatgagcaaaatatggatgcaaaatcagtgctattgtgatggcaagaatgagacagtttgagaaaatatcgtgttgagaagtaggtttgtgtaaaatagagataggaagatatgatcacttcatgaaaggctttgaatatgaagctgaccaattgagatgtgttaggaagggtagccattttagtttttttgtcagaagtgacatggttagatagcagagttgcaggaaaattagtataatggtagtaggttaagttattgtagcaatccagatgtgagttaatgagggataggactagggtgatgtcgatcagaaaggcaaaaggagagacactgaaaacagcaaaccacaaaaactctggcaaaccagttcacttttagatatctcacattttggtgtgccaaggttcccagcccccatactcccttcaaaaataaagtcctttccattttagtctttggttattagtgtgtgaaaactctgcctaaatcctgaactttctactctgatttgtcagaggaacagttctttcagttttaatttttgtctttagattttttggttggtgttttttttttcttcccctaggctcatctgtataggactgtgagcccagaaggaaagttgggaaataatttgtcagtattctttggcatttacaagatgttcctatagtctcattataacatggtttcctgacattttgttatggttgttgttgatagtgctttttggaaaacaacatctatatctttttttcttttttaaaaagtgcttatatcttttaagttttatgttactttgagatattactgtaagttcttttgttcatagattatgaaaaatgtcaaaaggaattctaatcagaaatcagttttgctctgtgaatttgtacattgaaatttaaatgattctagttaatacattctgtctcttattttcatttaatgttgaggtgaatacacacatgtaaggccatataagaagagaataactaatgagtgcctattctgtccagtcttgggcttcacagacatcatttatattgaatgctcataatacctgataaagtaaatattaataatctagtaaggcaattaagactttgggcaattaaattctcactgtacgtcattgggacatggcagagaaggaagcctatgtctttttctgactatagtgccagttgactctgcacgtttgcatacagcagttctcagatcttcttagtaacagaatcctttatcccatgaaatcagactcccaatatataaaacaggtaagaatagtgttcagttatatacgtttattgtatttggtacgttaaatttaaggtggaaatctatgtttcaatcttcacttggtttcatcttaaaacttatttctatatattttgtttgcaaaattaaaaaagttcaaagtttcaaagatacgaagattctaatagcttttttgctgcatcaatactattttcttgtcagaacatgataaaaattacaatgtggaactttaatagctttttaaatagtttgtcttgtagtttcagggcagcatttgattatatgggtgcagaaaacttgagaaataggaggaaattttgttttaaagttgtattaggtgaggtgcatggatcacctaaggtcaggagttcgagaccacctggccaacatggcaaaaccccttctctactaaaaatataaaaattatctgggcgtggtggggcgtgcctgtagtctcagctactcgggaggctgtggcatgaggatcacttgaacccaggaggtggagtgagccagaattgcaccactacgctccagcctgggtgacagagcgagactctgtctaaaaaaataaaaaacttttatttactggccgggtgcagtggctcacgcctgtaatcctagcactttgggaggctgaggtgggcagatcatttgaggccaggagtttgagacctgcctgggcaatatggcgaaaccccatctctactaaaaacacaaaaaaattagctgtgcttggtggtgcatgcctgtaatcccagctacttgggtggatgaggctcaagaattgtttgaacccaggaggcagagttgcagtgagtcagcatcacaccactgcactccagcctgggcagatagagcaagactcagtatcaaaaaataataataaaaaaaagtagtattactaatcatatttagtgacatccacagtagttatcagttaagtacattttgagggcaggaagggagttagtgaatgcctccacatccaatattaaattcattgtttggcagaaaaacagtttttgaatgtaccttgtaatattttaagatgttactttgaacagtcaaaaaaggctgtcagctttttactcaaagttccagaatagtcaaatttcttttgttttacatgttgagtctaaatgaacacttttctgcagtccttagtgtagtaagatgggagcttgttcagcaagataggcaagttcatgcatatgagttttatttcagagctaattgacataatttatcaaccaaagtgatttatttttaaaacacctcattagaaatactcagatctgcacattgccacaaagcaaatgaaaataagttagaagttggagttgtaatgtattgggtatacataccctggtagtgagaacttccaaggtaccttagtgaaaatgacagcctaaatggcgttgtctgttactatttggaagatgctgacatctgatgtttctaactgaccactagaacatgtgtcagcagttgcttttgtaggggccatgctattctcctgctctctcctatcattgctttaaacagtacactgtaatgtcttataaatcttccatgtattttttctgcagaaacaaaaacaaacacaggaagacagagacacatctgtctcatcaattccatttgaatcattataaagagtttagtcaaattcatacatcggatgaacttatcaaatacagagggtgcttttgcttgaaatcttccccaggtggttttgtgaggataatgctcttaattttattaattttatttttgtaataccttgctcatccatcgtaattgatacggatccctccattgcctttggataatgtttacctcgcacgtagttcattctgtgttatgataatttactttgaatgacaaattacttaaatttttattgacaggctttaagtataaaaaagacctgaaatttgaaatctgtattaggtattgtgaagcaaagtgggtaaactttattattgtagaattgactcttaaactatgaccaagtacaggcaccagccaggcagatgtgtttaggctttctctggcattggagcatggtacagggcagtaatgatgtaagtgcttctatatatatgtatatatagtcatgcattacttaacaatggagtacgttctgagaaatgctcgttaggtgattttgtcattgtgtgaatgtcatagggtgaacttagacaaacttcgatggtatgggcctactacatacctaggccatacgggatggcctattggtcctaggctataaacctgtatagcatgtgactgtattgaatactggaggccattgtaacacattggtaagtatagtaagtccttacttactggcttcaatatgcttctggtcacaaaaacataaccaaacataaacacttctaaaactaaactttgaaataagcatgagttatatgtatatttttaaaagattaataaaaacaagtaagacaatttttacccaatttttggtgaatcaatgagtaacagtggccgtagtggtgttgggttaaatcaaggaatgaagtttgtaaagcaaaaattgtaaggggcacctcctgttaccatataattaaaaaacaaaccaaaaaaccaaaacaaaataacaaatatggcaggtcaccacatacttttgtactgtatcgttcattatgatacatttatatgattactgtttattcaatgaatttgtagttgacaataatttgtattcattttctgacttattctagtttagggtcatatgtggctggagcctatcccagcagctcaggaaccaactttgctaggatgccattccactgcagggtgcactcacacacacccacgctcactcagactggaaccatctagacatgccagttaacctaaagtgcacatatttgggatgtgcacatggggaaaatgtgcaaactccacaaagacagtggccctggctgggaactgatttttttttttcttatcagcattataactgaacagtgttgaatgaaacaatgttgaacaaaatgacactacttaaggacctgctgtatttgtgtatctaaacatgccaaaagataggaaaaggtacggtaaaaatacggtactataatttataggaacaccatcttatatgtggttcgtctttgactgaaacattgttatgcagtgcatgactgtatgtatagcgagggagacagagactgtatatatatagaaagagatttaagtaattgacttatgtgattgtaggggctggcaagtccaaaatctgtggggcaggccagcaggctgcaaatttggataagaattgatgttgcaatcttgagtccaaaagctggaaactcaaccagaatttctaggttgcagtttggaagcagaattccttcttctggaacttaagtctgctattaaggcctatgacacattggatgaggcccacccatattatggatttgttttactcagagcctactgatttaaataggttaatcacatctaaaaatgctttaaaagcaatggctagactggtgtttgatcaagcagctggataccgtagcctagccaagatgacacatgagattaattgtcacgtgtatatttttgattataatttttgaaacattaatattttaaaattaagtttgattcagtgtgaatatgtctttggaagtctggagctctgagaagaatgacaagtagttgtttactttgagaggcaaatggtattgaaagagccagtgatttgcagctgggtgatttgggttcaaataaattccagctatgccatttacagtttgtgtgactttggtcaggtttcttgaacttgagtctcaatttccatgttaataaaataaggtattactttatcaagctactttaataagcgagagaatgcttgtaaaactcccactgaagtgactggcatatagtggcatttaatacatgataacgcattattgtcatagtgattatcattataagcttaggtttatattacaaagttttttatttccctttatatcttttaaactatatccttttaccaagtgtactgtactttctgtagtttgtgggaaaaattgaatcaaaatctagcattctcaactttagagttcttttttctaagaatgttgtaattgaacaactaaaagagacaattgacattatgccatcagagggttggacgaaggttaactgaggtatcctgaaaagcatctgccatgctggagaggatgtggggaaataggaatgcttttacactgttgatgggagtgtaaattagttcaaccattgtggaagacagtgtggtgattcctcaaggatctagaaccagaaataccatttgactcagcaatcccattactgggtatatacccaaaggattataaatcattctactataaagacacatgcacacatacgtttattgcagcactgttcacaatagcaaggacttggaaccaacccaaatgtccgtcagtgatagactggataaaggaaatgtggcacataaacaccatggaatactatgcagccataaaaaaggatgagttcatgtcatttgcagggacatggatgaagctggaaagcatcattctcagcaaactaacacaggaacagaaaaccaaacactgcatgttctcactcataagtgggagttgaacaatgagaacacatggacacagggaggggaacatcacatactggggcctttcagggggttgggggctagggaagggatagcattaggagaaatacctaatgtagatgacaggttgatgggttaatgggtgcagcaaaccaccatgcacatgttgtgtacctatgtaacaaacctgcacattctgcacatgtatctgagaacttaaagtataatttaaaaaaaaatgtaaagaaaagcatctgccacagagcttgggccaataagtttggtttattgtgttttagtcattggtatatagcttttctgaagttatgcattacagttaattacattctaagagtgcattataaggttaatttcttgttttgataccagggtttgttaaaaaggaacaatattttctagaaaagctttaaagtagtcatattcttacagattttaaatctaggactttgtctaactattgatgatttattgagtagctctgggatttttttcagaaattaaaaaaaatctttcatctgtacaatttttcagttttgtttagaattctttttttgtcattgcatttttaaagcactcattttaatttaataaaacgatgagtgtgtctcctaaagttgaccacacaactgcaaattgtattttttgcatttctttgttggcagtagtagtttcctattggctgttctgtacttatatatatagatatacatatatatttttgttgttgttgttgttgttgttgtttttgagagacggagtctcgctctgtcacccaggctggagtgcagtggcaggatcttggctcactgcaacctctgcctcccaggttcaagtaattctcctgcctcagcctcctgagtagctgggactacaagcgcacgccaccacatccagctatttttttttgtagttttagtagagatagggttttactgtattggccaggctggtgtcaaactcctgacctcgttatccacctgccttggcctcccaaagtactgggattacagatgtgagccaccacgcctggccacttgtcaatatatttaaaaatttttttatttttggcttgtcagtattgaccttaatatttgtagtattgggagtatcatgatagcagaaaggactttggaaaatctattattagagggcttcacatgggtgcttctgtaataaaatgaatggtgaaaagagacttaaccatttatagttgttggcttcggataaatctcccagaaaataagtggattggagtccattaacccaagcttcccaaagcataatgggagttgagcttagggcctgtttcctagtgagtgacctactgaggcttaggggctagatcaaaaggatctggtagtactgagtttcttagtaccaaattgaaaatggatttcttttttttaaaaaaggcctttgttacaatcttattgcctgagatgatgtaacatgttaatgggttatccattttgtattgtttttttttgtgtgtgtatgtgtgtgtgtaaagaatacacacaatctcaatgctgaaatgaatttgaaatgtaaactaattattttcaagtgcataggatattacagtctaaggtaagaaacagtaagctagtactcatttgttgtgctaagcaaattactaattatttaggtgagcatgaagaagaaaaccaaaccagaaaggtttagggatattaatgttcttcaaattagttaagaaagttagcagcagccactgaatgaggacctactatgtgtaagcatattttatgctcattttcctcacaagaactctatgaagtagatatcaaattattgcaggtctctaattgcatatccagcactcaaggcaagaggtgtttcacaattcatgacttttttaggtttttagaaaagtgacacatgggctgggcacggtagctcatgcctgtaatcccagcactttggaaggctgaggtgggtggatccatgaggtcaggagattgagaccatcctggctaacatggtgaaaccccattgctactaaaaacacaaaaaattagccgggcatggtggcgggcgcctgtagtcccagctacttgggaggctgaggcaggagaatcgcttgaacccaggaggcgaaggttgcagtgagccgagatcgcgccactgcactccagcctggcaacagagcgagactccatctcaaaaaaaaaagaaagaaaagtgacacaggtatatactttatatcagtggtccccaacctttttggcaccagggacttgttttgtgggagacagttttccactgttgaattctgcctggagtatatgttttaaaattcaatatgtaacttcatattacagactctctactgtacctgctatattgtgtattacaacaacatctgaactcagtgaatggttttaggttcattgtcaggactctgggtccatttatatggcatataagcattttaacttgtttcttgccatattttcaaaacagccttgtgtatgtctgggaacaataaatagggagtttcattatcactgttgtgctaatgcatgtttaaagttagacagatgagtagctgttcatcaatatatgtaaaacctagagaaatgattagctattcatcaatatatgtaaaacttaattattaaaaaaatgtaatgtcctatgtctgtgcactgggagatccaggaaaggtaaaagttaagtcattatcctcaaggagattacagtctagttggaggtgtatattatactatttattctgttgtttcagtgggatttgttgtgggagagaaaggtaagttaaacagaaagcctgaagagaggtctgggtgtccagtgtgtcagggaatgcctccttcttgtagcatccaaccagattgttttgggagttagaaatgtaatgcagtcagtcccccaacttaaagaaatacagcccagaccatctggtatgtcacagttgtgtggtaacagcagtaaggagcatcggctgagtctgaggggagagctgggtgctccttgcacctccctggccctggcaggtctctttgctgatcttgtgctgctttctgaggagcctgtttttagaatgcttctccaggtagccagcaccagtggaccatcattgaagtaggagtgggtgttgaaagagatagggagggcattccaggtagatagtgtggacaaaggcaccaagcctgaaaaaagaatggcccggttgaataattttaagtagtttgagatggcacagtgcccggcacacagtctcttcataaatgattactcaaagattgagtgagtggacagatgaatgaatgggctagattgtggcatgtgcgtggaattaggtaagagattcttagacttgatcataattgcctagtaaatcattcttccatagcccttttataaggtaaatacctagtcataaagttcaatctgtgattcactagttatatttgcaaattatttagtctctgggcctgtttcctcacctataaacaaggtagttaggcttgagaactcctctattccttccatctttagaatagctatgattttaagtaaagggacagggaccaactagtgcttctgttgggggttcagagctgaacctcttctgctgtcctggctctttaggcatctctctggcctgtcacagaggttggatgactgggatgccttgtggatgcccagatgttcctgggatacttccagttttgtgggtgatggtaatgtctgtgtgttcttcctttgtcatctgggccgtgatttgaaggatatactaccatttgtatttaatgtctagggtggtgagataagagctcctattagattttttaactagaaatggaataaatgctgtatctagttaataattaggaaaactttactcatattttttatttggggcttaaggagaaaataaactttaatttagggattttttttttcctgcttgaattcagtagggtcttcctcaaaatcttaaatgggagttctcagttccccttgtaatgtcaacctcggcaaatttcttctgttgatatggaaagaattgttggacaggtggtaagggtaactgagcagtgggtagggatgagttcaaagaagagaaatcctacagacgatggttggttggatgataaatatgaaggattgtgtgctgatgtattccctgtggtggtctgcaagagtgtgtgggagacatttgttctcatttcctgtttcatcacagcctgccacctgctgtgtcgctatacaaagtaacatcacttttaaagattgctgtttaggaaatcatgttttatatgtcaggaagctgggttttttttgtttttgtttttttttttttgagtcccattaaagactgatccaggaagcatctctctatatgaaacttggtgtgtatgtgtgtgtttgtgtgtgtgttgacaacttaggaaattggtgattgatgcagaaaggaagacaatgagtaacttgggattgtgcctgtatggatgttttgtctacacgtgggtggaggaaaatacttgatgctgtgttctgtagctattaccctgtggagtttctcacttgaaaattgaagctgtgtccagatacagctgtaattcagaataatagcaagcatagtactgtctttgtttttctgggccctgggaagacaagtctacagctctttgaggttcatgtgtgactctacattccggcctcattatttggaggtttgatatttgcatgtttgcctgcttgctaagctttgaaaccacagaaatcaatctttatggtagtttgtggtcatttgggacatctgcagagcagtgaaaaatttgagtccctgaaacacacacagctcagctgaagtaaaaggaggtgatgttctgccttcttgtttcagctgcactgctgtaaataaatatcactttcttagcctatttaatgccgtattttccccatttctgtcctttttattggtgatttcactgcctaacatgaccctcaagcatagtgctgaagtgccgtcttaagttcccaaacacaagaaggtgtgtgccttagggagaaggtgcatgtgatgggtaagctttgttcaggcaaaacacatggaaaacaaggttatattctgtccagttgacgaaaatgttgagaccagaggtttgcagatgtcaacttctgaaacaatgattctgtattctctaatgcagtgttatgttatagaaatacaagtaccatgagcagtaaaaattgtatttagagtagaagctaattggtcctagtcatggttcacatatctgggtgaacatggggaatttttatgccttgtgaaacatattttaaaagttaccttttgaaaattaaaggaactgtttgatttggagctaagaacaaataatagcacataggtagtttgactttctgaattcttttaagtctgctatttggaggcactgtttgtcataatgtgaccatagtgagcttctgagtatggatgaaatcttgttacaacacattccaaagacgatgaggcatggggacatttaattcaagtgttcgttgcagggtctgcagacagctctttgaatatcttaaactccaagggtcctgtctgacttatgtatctgtctgcttccttagaggccagcttcatagagagccctctttcctcagattttcaacattgtattccgtttgcaaagacccttctttatgggtgtggtcacttctagaacgaatgcctcaattgaagctgggaaatggtggaagagactttttccaagttgctgttactgggagctgtgagagactattgaggtgtgattaatgaatgtcttttgggtattgcaggttaaaacaggggtccccaacccctgggccacgaaccggtaccagtctgtggcctgttaggaactgggctgcacagcaggaggggagcagcaggcaagcgagcgaagctttatttgtatttatagccactccccgttgcttgccttatggcctgagctctgccttctgtcaggtcagctgcagcattagattctcataggagcatgaaccctgttgtgaaatgtgcatgtgagggatctaggttgcgtgctctttatgagaatctaatgcctgatgatctgtcactgtctcccattgcccccagatggggccgtctagttgcaggaaaacaagctcagggctcccactgattctactttatggttagttgcataattatttcattatatattacaaatgtaataataatagaaataaagtgcacaataaatgtaatgtgcttgaatcatcctgaaaccggttcctggtgccaaaaaggttggggactgctggattaaaggacagagtcagctggacatcattgtaacatcattgcttggtgttttagtagcattaagacttaagttttgctttttaaatttacttctatatgttgctggagaggatttacttctgtctctggtgatattcagctaggttttttagaatggtctgtctgtgggacaagaaaaaaatctcagctaacaaaataggtagggatttctggatgtaaacctaggagaagttaggaaccacagaagtaagccttaaatgccttttccaatctgaaagaaatagctataaaaacaaaggttttggcaggcttatggggagacagagtcagagttcagggcctttcaaagatatgtggtctgataacctcccaaacctttgagcttgttctctaaaaagcttttatcatctgtgtaaagggaaaacagaaatacaccattctgtgagtagagttggagccagctttgcatcacctaggtaacccagtgggcactcaagccttgaacttgtgttaaggtcaagccagtttggtgttactcccaggtgtctggtataagcaagtgaacattgttttggagcaagatactaggcctcaaagtactcatatatatgtgtatgtctgttttaaaatacagtgtccagcacatagtcaaagatggttaggcacattaaaaaatagggctataaatgaaagaaaacctagcaaaataatagacaagagaagcagatacccaaatttcaggtatagaaattacagctgtgtttagtatgcttaacagaaaaaaggacaagtttgaagatcaggccactggaaacaacaaaaaagtggcatagattacatagattagaaaacaaccttgtaattctggaactaaaaaaatccattgctgggtttaatttgcaggatttacacatgttgacctataatttttcttactcctttttcccttatctgatttggtatcaaagttatactagcttcataaagtgaaatggaaaatattctttatttttctgttctaaaaaaatgaaattatgcaattattcaaatggaatacatagtaacattagtcatatgtatcttttacagactgacaggttagtgccaccaagtattcacaagtttctgttcatagagtatttttatacaaaaaaacagtgaatttaatagcactttttattctcttgagttttagggacgtacaactcaggaaatgctgagtatttggaatctaagagtgacatgtgcatgtgtaaaataagtgctgttatctaaaaaatacatcataaaagtttaccgtacagtgtgtgcacccttggacatgaatagaagacaaaagcaataaagccacttagtagtggtttactaagtgttctgccactcttgacagggtcctggtctaaagctggcactgtcagcatgtgaaaggctgcagtctgtaaggacctggggaagagaagacattttctgtatgaacataattgtacagtaatattgagcctgagttgcaggttttataaaggaagaggaggctaagtacttactgaaggaagagctagaccttttctctttattctattatgggagatttttgacattttatgagttagaaaaagttatctttttcattctgatctgttagttttatacctttaatccccaatcttactgtgaattactggagtctatttttaaaatcttggaaattttttatttagtgctgcaaaaaagaaaaatgaaactttacctgaatactaggtaactgaatagacataacggaaacctcttccatttatctaccttgggtatatatattggccttcatctcatttagtttttacttcctcccaaattcagacacaacctcaatcccacttaagactaaaagaattatactgaaacaagatttgcccactgcttatatttttcttgtctaacggaaagtattttccaagatagattattaaaattatagatacatttgagcaagaatgaaaaagaaaagggttacctcagagttctgtctgatgtgggctttttttttttttttcgagacagggtgttactcctgttgcccaggctggagtgtagtagtgtgatcacagcccactgcagcctcgacctctccaggctcacatgattctcccacctcaaccccaagtagctgagactgctggtgtgcgccaccacacttggctaatttttacaaggacagggtttcgccatgttgcccaggctggtctcaaagtcctggactcaagcaatccacccatcttggcctcccaaagtgttggggatacaggaatgagccaccgcgcccagcgtatctgatgtttttaatctctttacaagcatgggttccaagtggctatcagtcctgtggtctctaaactttgattaagcatgctagtagtaaaatatttcttggcatactcctgtaatgcctgtaaattgatttatacttacaaataatacacatatatggtatagtaatatatgtattacaaggataggaaatagctcagaaggatgtggcaaaactaaatatagtgtttttaatattttctccacatctcaagggacctcttgtttactcattttggatactgatgatccagactccccactccttctctcagaaacagggaatttacactttctagagttagcccatttcaagtgttgtgttagtttgtatagtagagtgattggaatgagtagccacaagcatttgatggagcaaaactctcatattctgggagagtttttaaaacttaatttcctttcaaacagatccttgagttctgggtatttgaaatgtttggtttgtgactttcagccacctcctttgtggagaggaagaataagagctattaaaataacagtttcttaatttcttggcactctgggacatatgaaatcagtagatttgacattatgttgtctggtcaatttctctaaatgtttctgcagctgtcataagcaatggctcataaaacctcattctgtcattttgccagatcttatagcaatgggtacagagagaacttttttttctttagcaattcctttccaacagtaaacctgtaactatgcctccacagtaaagaaggatggatatgaagaatcccatcaccctttggaagtttgcgtgctttccaagctttttttgttattgttgggcacactttatattcatgctttcagcttcctttcgttttcctttatccctgagtagggaagaaggacattttgtctaattgagatttgtcatttttaattgttagcagtaaggaacaaaagagtgctgcagtgggatttttgatgaaaaatgagaaacttgagggaaagcacctcagtagttgtactttgctccttcgatgttttccatgaccgtttgttcatccttctttaccatctttgtccatcagcccaggggagcagtggaaccaagctgggtgagaaggcaggaggggctagcctccattttctcttccctagttcttccccctcacaccagcatatcctacctttgtagccctttaggaagagacagtgtacccagaccatatttcatcaaatcccccatcaagacaaagtccgtctgccacttgctttccttcttttctgccatttgttgccagtccatcatgtggatatactgtctaatgttgtaggtttgaccattggttattgaagcttggatatacatttgtgtagaaaatcactggcactcaaaacatttgtacacatgcagaagaaaaatctcttagagaccccactgtgtctccccttaccatctaataccttgtcctaaatacttaaacacagaaaaatagtgtaactttatacccaggtacttaaagaaggacctcttgattttagttgttacctagtgacttttcactgcggtctcttgaagtagccaagattgcgtttcatgagttcattttggtaactgatgtaattaagagatactttggagaacagtgtgggttgcttttgtctaatttagagaaaacagaagaaaggacctaaaaggaaaacaatctcaaacccaacttgcccctgcatttctcctttttttttgaaaagcatggatgcttggtgaaagtcttagggaagtgattcctttgaagtacctaggagaataattatatagcattttcattttacattgtgatcctgttagtcgttttggagagggaagactaatgatagcagacaatgctggctatttgcaggaatgcctttccctgtatcctcttccctgttgcttgttctcagtgctgttctgatgactagctctttttccaaacaaatttttaatttttccataggttattggggtacaggtggtgtttggttacatgaataagttctttagtggtgatttgtcagattttggtgcacgcgagcactatacaccacaccctatttgtaatcttttgtcccttgcccccctcccatccttcccatcaagtcctcaaagtctattgtatctttcttaggcttttgcatcctcatagcttagctcccacatatcagtgagaacataggatgtttggttttccattcctgagttacttcacttagaataagagtcttcagtctcattcaggtcactgcaaatgccgttaattcattcctttttatggctgaatagtatttttatggccattgtgtatatatatatatatatatacagtagcacagtttttttattcactcattgattgatggacatttgggttggttccacgattttgcgattgtgaattgtgctgttataaaactgatgactagctcttaccagttttctctctcatgtgtttggggcaataagttgtctcttaaatttattcaaccctgacattatatttttcttatcccttaaaagttgtgttttgctttttgtttgcttgtgtgtgtttgtgtgtttgcattttagtgtacttataaaagcttttggttcagaaagattactcccaacaagaattttattatatttgatattcttgactagttatgtatcctgttgttttctgcatctggagataagatgttaactggaaagatatttatcacattggaatgttagttgcttttttaaatgtgcttaaggcccaaagctcagttaataagataggatcctcatatcccaaaatcttgagccaagggagggaactaaacctttaacagatgagctggtcaggcgcggtggctcatgcctgtaatcccagcactttgggaggccgaggcggtggatcacgaggtcaggaaatcgagaccatcctggctaacacggtgaaacctcgtctctactaaaaatacaaaaaaattagccgggtgtggtggtgggcgcctgtagtcccagctactcaggaggctgaggtaggagaatggcatgaacctgggaggtggagcttgcagtgagccaagatcatgccactgcactccatcctgggtgacagagtgagactccgtctcaaaaaaaaaaaaaatagatggagtaattttaactcattcttatgttgttgtttaaaggcaacactgtgagatgaaggggatcgtgacatgtaattcatgtaagaaattgtaataatagaagctttaataacatataaagaatattgagtctgggcacggtggctcacctctgtaatcccagcaatttgggaggccgaggcaggcggatcacctgaggtcagaagttcgagaccagcctgaccaacatggagaaatcccatctctactaaaaatacaaaaaaattagctgggcgtggtggtgcatgcctgtaatccaggcaggagaatcgcttgaacccaggaggcagagtttgtggtgagccaagattgcacctttgcactccagcctgggcaacaagagcaaaactctgtcttaaaaaacaaaagaatattggaaataaggaggagtgaagagtgaaaattttaatctctgtcctgctctctgggagagagagtgctctaattttagacaactagacattatttttagacagaaccattgctacagaagggcagtttgccataatttgatagaactgttgcctaagaatgttcaactttcatttgttccaattctctgcttatcaagcaactttctgatctctaatctggttttttttttttttttttttttttttttttttttttttttgagatggagtctcactctgtcacccaggctggagtgcagtggtgtgatctcagctcactgcaacctccacttgccaggttcaagcgattctcctgcctcagcctcccaagtagctgggactgcaggcacatgccactacacccagctaatttttgtattttttggtagagacggggtttcactatgttggctaggctggtcttgatctcctgacctcaagtgatctgcctgccttggcctcccaaagtgctgggaggcaattcaccttcctcagcctcccaagtagctgggattacaggtgtgagccactgcacgtgcccagccctctaatctggtcttctttgaggacttgtcctgtgcagatatctattcccattgttttaacaaaaatagctttcattgaaattttacatatgattgtttatggtatttaaattagtttgattatcacaagtcagttccctagaacctaatcagcatttaatggactgataaaaattctgaatttgaagagcggtagatcaggtgattttacttgaaataactaacaagcattattagattacacagaattctgccaaaaagaaacataaatgtttttattactgtagtcgttttacagtgttactcatgatctcattgagtaatgataatgccatccatgacaatgtcaaaaacgtgttttttttggatgggtgtggtggctcatgcctgtaatcccagcactttgaggagccgagatgggtggatcacctgaggtcaggagttcgagactaggctggcaacatggtgaaaccccatctctactaaaaatacaaaaaattagccgggtgtggtggtgcacatgtgtaatcccagctactctggaggctgaggcaggtgaattgcttgaacctgggaagcggaggttgcagtgagccgagattatgccattgcactttagcctgggtaacacagactctgtcttaaaagaaaaaaaaattttttttgctttttaaaaattgtactagctattttttccacagtgctgtttaagttatcacagtttctaggctgtgtccttcatcattgattatctacatccagatagctgatcactgatgaaatatacatgtgcaaaacttggagatgtggacactagttttagctgcagcttctgaagtggcaggatggggtggggcagggtgaggtagtgggtataactggagtcttcagcggatcagccccacttttgtcacctccctttctctggaagctaaggattccctcagctgcagccttggggcttaggatgattgataataaccccagctccacttattggtcactgagttgagtcagacctgctggggatcagaggttttgtttcttcctgttttttttttccatactcagtagctagttaaatctcaaccattatagtttgatgccagtgttttaaatcctgtgttaaacaagaaacttacgttgttagactgtgtggtaaggttttagtttttagttagtttttttttttttcaacacagtccttggctttgctgatttggacctaacagctggccttaggacaactgtttggcagtactaatgttctcagatattttttaaatgtattttatttatttatttttttgagacggagttttgctcttgttgcccagggtggagtgcgctggcgcgatcttggctcactgcaacccccatcttctggtttcaaacggttcttctgcctcagcctcccaagtagctgggactacaggtgcctgccaccacgcccggctaatttttatattcttagtagagatgggatttcactatcttggccaggctggtcttgaacccctgaccacgtgatccgcctgcatcggcctcccaaaagtgctgggattataggcgtcagccaccgcgcccggcctgttctcaggttttaatacttttgaatgtaaactgcctttgaaagcctataacacagttcagttggcttctaaaacaagtgttttaaatgaaatttagtaatactgtttaaaaaatgaataactttatggccaggcatggtggctcacacctgtaatcccagcactttgggaggctgaggcagacggatcacttgaggtcaggaatttgagaccagcttggccaacgtggtgaaaccccatctctactgaaaatgcaaaaattagctgggcatggtggcacacacctatggtcccagctacagtgaggtgagattgtgccactacactccagcctgggcaacagagcgagactccgcctcaaaaataaataaataaataaataaataaataaataaataaataaataaataaataaatctttagagtgtttttaggttcacagaaaaattaagtcaaaagtgcagaagtcccacatatttccttcctggatcaccacacacatagcctctgcaattgtcaacatttcctatcagaatggcatagttgttataatcaataaaacattaacatgtcataatcccctaaagtctatagtttaggctctctcttggtgttgtgcattctaaggatttggacaaatgtttcatgatatgtgctgttacagtatcattcaaaatagtttcactgccctaacaatcctctgctttgtctttcatccttctctcctcccccacctccaggcaatcacagacccttttactgtctcctttcccagaatgtcatatagttggagtaatatattatgtagccttttcagattggcttctttcatctacttatatgcatttaagtttcctctgtatctttttgtagcgtgatagctcattctttttatcactggataatattccattgtatgcatgtaccacaatttatccattcaattactgaaggacatactggttgcttccaagttttgtcaattgtgaataaaatttctataaacacatctgtatacatatttttgtgtggacatacattttcaactcagttgagcaaattcaagggatggattaccatacatttatcataccattcagcaattgtatgctaagagtatgtttagaagaaactgccaaactgtcttccaaagtagctgtaccattttgcattcccacaagcaatgaatgagagtagtaatgctttcgaatactaaagagattgcaatgttaaatgtatttttgatgatttccttgtggagatatcattatggcaaaggaccatgaagcacggtaaagcaaaggaccatgaagggtcatggtaaaggaggttactggtgataggtgtgtgtgtacgcaggagttgaagggcaagggcttcccaatgttttcccatctccaaattaccacagcccacccagatactgtgtcttacattttagaatcactgctggaaatggagttatattgttaatgtgattatgcactgatgtgctttcattatattagtattggtgatgaaagtatctttgtcattttaggcatgtaactaggcctgtaaagatgtcttaattgggggtttattaggattagtgtcaaccgtatggcaaccatatcccagtgctgggagtcaaagttagaactgtgactttggacattgctctttaaggtcagggtagtgtcctgtgaggttctgccagcctcagccttgatgtggataataccatcatttgtaatgttgtgatatggtggagcaggagttctctggcctcagaaaacatagcttgtgtgaagttagtgaaatgctcatgcttctgctgtctgtgatactgaatctttcaatatttttggccttaactgtgacttgttctggtgggagaacttggaagaagtgaaaaaagatcaataactttttgaattggtgcaagacaggtaaagaagagaagtgttgggctttcttttacattattctgttaccatcaaaggtagattccctactattgccatatacaaatattctttcattccacaggattagagttgatgatggtctatctgtctttaaaggtagatctcaactttaaactttaaagttgagttttcttttgtaaagtaagagtaaaatggcaagcagatggaagcatctcaagcaaggcatccttccatctgggtgaattgtagctaatgtccagaaacagtaagaatcacaccggaacgagttgccagccagctgcccatatactacctgatgtatgctggtatgtcctgagactgaaactttggtataggtactgctcagttaaatgtaggtcattctcacacagaatcccatttgggctaccatcttgtttcttttgaatcataacatgaaatttactatataagtatgtgtaaaacattaggctatttatcatttttccttttagaagttttttaaaaaggtttttgccaacttgaaggtgtaaaaattttaatataggtgaaataatcagatgtatatttaaaatatttattcatttacatgttttaaatcacatatatacagaattgggattgttttccacattcttaacattttacgggacaattttattccagtttttttacatacatctttgatatcagtagttattgaagtcacttttaaatcatcagcataatttcccatatattatattaattttcatgaataaattgtgatacagtgcttttttaaatttgcgtaagattgctgtcactggaagtcactggaagttttatctcaagccatgcatactgatctacataacattaggatagtttttcttactggtttatatgtgggatctttacaatataactactcactctcctgcctcaaagtattctttaaaaagcatattattggctgggcgctgtggctcatgcctgtaatcccagcattatgggaggctgaggtgggcggatcacaaggtcaggagatcgagaccaagtgaaaccctgtctctagtaaaaaatacaaaaaattagctgggcgcagtggcgggccgcccgtagtcccagctactcaggaggctgaggcaggagaatggcgtgaacccgggaggcggagcttgcagtgagccaagatcgcgccgccgcactccagcctgggcgtcagagcaagactccgtctcaagaaaaaaaaaaaaaaagcatattatttacaacatcagcacttttaattttaaagccatacctactaagaatgactacataaacctgggttaatttatttttctcttaagaaaagcaaaagaaaacgaaacaaaacactttagattacatatcccaaataagtttctgaaacttgtattatctgaagtcatattaagctaatttgatttccccacagtaattggtggtctaaaatgaagtacttgggaagctctgtaagaactagaagataagacagttctcccttttctgaaaggacaacttagaggagaaattctttcattatattaggcatatattgtatttagaactagactctgtccctatctgtacatgtattcatttaaattctccgtggtttccttacgacgcatcctttttttattgtgtcattaagagagacaatgctaggcattttactcaatgtgaatattcttaaaattcatttatgaaaacgtcaggagaagccctgaaagaaaatgtagttgagggtgtatattttattggtccattgtgtcaaaaccatccattcatattttattacttattcagaggaagaaatgtaaatttggccgggcatggtggctcacgcctgtaatcccagcattttgggatcacgaggtcagaagttcgagaccagcctggccaacatggtgaaaccccatctctactaaaactacaaaaattagccgggtgtggtggtgtgtgcctgtaatcccagctactcaggaggctgaggcatgggaattgcttgaacctaggaggtgggaggctacagtgagctgagatcacgccagtgccctccagcctgggcaacagagtgagactctgtctcaaaaaaaaaaaaaaaagtttatgaaatcatccatttgggctcagtttttgctgtttgtacctttcctaaggcttagtacaccctgctctgtgttgctccttgactggtggtttcactgaattgtccccattttttgtttgttttcttgtttgttttgttttttgagtcaggatcttgctatatcacccaggctggagtgcagtagtgtgaatatgactcactgcagcctcgacctcccaggctcaagggatcctcccaccttagccacctgaggagctcggaccacaggtgcaagccaccatgcttggctaatttttgtgttttttttttctgtagagatggggttttaccattgttgcccaggcttgtcttgaacacttggggtcaggtgatctgcctgccttggcctcccaaaatgctaggattgcaggcataagccagcattcccggctgtatacttttcaaggggcggggagaatgcatttgtccttataggctccgttactgtaggcatttagtactgcttgaaaattaaattagaaagtaagtgccacttaaaaagtttataaatatgctttataaattctaaaggtgtggaaaattggtgataattggtttagcctcataccattcttttgctcttgttttctaccacttagctctttttctccttctcatataccttttatttttcacactaatattgttctttttcacttatcactggacatttaagaacttggagtgcttgatccttagcatacatttgtgtccacttaggtcttttaggggagcccttgaagggcactaagtataagcagacaataaaaacaggaatgcctatatccataaataaataaatatatgtatatacaggcctcatttatgctaaattacacaattatactatatagtagacttgaaattatatttttgtggaaagaaggaaagtaaggagacaaatctagtgaaggctgccttgacttaacagtgcagaatcactgtgcagcaatgtgcttatatggccgcgttgcgattataatcctcctacatgcataagtcaatggggtctttgctccaaacttgtggaagaatgaatgagccaagtagtggtgggagttcagtttagttccactgttttgtaaattgggctaattttcaaaggtattcagacatttaccttttcaagtgatagaagcaagagcagagaattcatcctttcttgctactaaagaatttattctaaaacattacatgtcacttgtccctcgtggctagatgtggatagagatgctggattgtttgtttggagcatgcagattgcactgtttcatcttttgtagacacagaaatcaagagttatcttttttcttccaaagatggaaacaactatttgagaaccctatcattagaaaattgtaagcctttaaaatagaaccttaccttctattattcattgcaaattattttaacacaaacttacctgcagctgggcatataggactcgactgagtacagaatattggcaaaagcattgtagagggtcagaaaattacttaagtctgaacttgattggaaatcagctgatatttcatgtctctgatgtccttcatctttgcaaaatcagttcctgtggcattttagcatttctctagaacattactatgagaaaggaaagtattgaaaagatctagtaatagagatattttcagaaatctaacagataagatggtagagtcaagctctttggagctagatgtatacattaaagttcatcttgtataaactctttattttacacttaagaaaattgaggtatggctgctccttactccctagtacaatacttctctcactgtgtatcttaattatttgtatcttatctcatctgtcatatggaattcctttagggcagggactcacccttattttatctatgtatcttcagtactcagcctattgcctggcactgagtaaatttcagggtatgtttgtaaattgaatgaatcattgactgaattaaccaaacagcaagtcagactcacctgggttcactctcgttcttctattgggttgctgcttattttacaagtcagacagttctctccctataaaaggcaacaacaaaaacatacctcaaaataaagagatagctggggatgagtccgggccctcaaaatcttacgttcttatgtgtgtatgtgtgtgacatgtgaataaaacatgcagaaaataaaggggataattccaggtactgataataccatgaaaaaagtgtcatgagcatcagacagtaattatctaaatgtcttctttttagtagaaatctaaccccacacactgggcctcagtccatctatctcacagaaaggaaatccttgctactaccatgaaagcttatcacatgctcatggctgaaggagttcttctggaaagccagagctgctaaaaggaacttaggggatctgttcctaagttcctctaagatcccaatagaggactagaggcttctttccctcttgggggatgccatgttgattaatgaaatttttgctacttagctttaggaaaaaggcatttatttattttcttttctttcctttttttttttttgagacggagttttgctcttgttgcccaggctggagtgcaatggtgcgatgtcggctcaccacaacctccacctcccaggttcaagcgattctcctgcctcagcctcccaagtagctgggattacaggcatgcctcaccatgcccagctaattttgtatttttagtagagatggggtttctctatgttggtcaggctggtctggaactcctgacctcaggtgatccgcctcccaaagtgctgggattacaggcatgagccaccacacccaaccagaaaggtctattttctttgatcttattaaaggctgccatatacaaaggttttcttttaatgttgatctgtttttaaaatatggaagaaagccttgaaaggcatcatcataagctctacgtcaatatccagaaaatatcgtcttgttttagaattctagcctgttttgtttggtagatgagtcagtctactgtaaataaatatttattgagcacttgttttgtgccaagcacagtgccctagggattgtagtgtttttcaaattgtgggtcacagctccctaatgtcataaaatcaatttagtgagctataaccggcatattcaatcaaatggaatgaaaaatagaatatcagattgcatcatggatagtattgtattattttatcaaacttgagtttcaattgtgtatgtatgtgtgcaaggttgcaatataaagtgtcttttttacttgtgtcatggttagaaaagcttgaaaagcactattatagagcatacccaaaagtatatattccttgcttttgaataagttaaactcttgttggagcaagaaacacaaaagaataaatactcaagtagtgaattacaataagtgctatgtgttcggaaaagtaagatgataatacaagttgaaagtggcatggatggatatggtggaacttgaaccaaatctggaaagatggatagggcttggaaggggtgaagactagagaatggcttaaaggtgagacgtggcatatggataatagggatggcaagactggaacagaggtttcagtttacattagagaactgtaggatatagtttggagatagaaaatgaagcacaattgtccagacttatggatgccttgtgataacatgcctgaggagtgtgtattagatcaggtaagctgcacagattcttaagctggggagtgataatgatatagggtgggtttatagaatactttccatcttcttcctaactcctctttagtcatggggagctcctaagggaatttcttctaggtaggtgttggataccaagtctctggcatcagatcaaagagagccagaaaggactttggctgttctccagaatgtaaatagaaaggtagaacaagtcccattgtgggtgcatgtgaaatactcccatggaggagaactgcagtgctgtctgtttgaaatacggcaaagaatggattgaagaacatttcttctgatatcactgtttaatgtttgctctcaatgtaaagggaaaagcagattaaagggcccatgtttttgaagtactgggaacctgactgacctacctgaaatatgctatgtaaataatttgtcatgtgatctccttaccctcaagacaccttcactgaatatgctatatacataatttataaaacagtttcaagcgtgattgcaaaaagtttctcctcattggaaagggacatttgatatttatctgccaaactctttactactttccaattaaagataaatttaaagaagtttctgaaatgataatgtgctttacggggaaggtgatttaactagaaagaagcttttaaaaaaatgactatttaatctataacactaaatacaccaataatttagatcgacttctgattgaaagttatgattctttgtcgtggcagattatcaaatgttctaaattgaggctgttctaggacatagtttttaatctaagtcatattaaataaagtttatgggggcccattgttttagactagcctcttggactaggccccagcagaccagactaaactagaatggagttgctcatgctaggtaccacataattaaactgaattctgaaacaggcctggtttgtttaagtaacaaaccagaagattcacaacaaccagtcaaaaggggcccagtttacctgggcatgataagaagtctcctctgttttaaccctaaaaggaaagtaacttttgaaacagtcaatctgctttttgttctgtttctgcttttctcagaacttttttgtctataaaaccaattcctctgctcagctcattggaacacttattctattttatagagtaagatgttgctcaattctggaatcacaaataaaagccaattaagacctttaaatttgttgtaattttatttcttaacagtcattagaaaaaaaaaagcagatgcatctaggattgcaagattatttacatgtagtccagggggattacatacattttagctattttgtagaaggtataatttaatcaggaacacaagttcaagcacagcccatgagagatgaagggatatgaagaacactaactttggtttctaaaggaaagtgtgtagagtgtacattcttactcgtctgcaaagagggtggatgaatgaaaaatgaagaagggggtgtattcgtttatacttatgaaggcatctgctcacaatcagtcacttgtagagagagtgccagctggcagggtacttgcgtgatgtaaattgtccatccgctcagaagagcagaagtacaaggaggccttgtgcaaaggactgaattcctacccagaggacaagggagggaggttcttgtagatatctaaatgagatctacttccattttccactttatttgcagttttcaacatgtcatttttcctgctgtcccagctacgattactgtttgacttgagtaatcagtttccccccttcactgcaactgctgcttattaagcctctgcctggtggggggagggtgggtataggaggggacactgctggaaaaatggtgtcactttttccaagagtgttgttttccttgtctttctgcttcactggttcatttttgtgagctgtataagagctaaaggttattattacagatttcattttttgaaatgcatcaaaatctccatcccctcccctacctgctaatctttttgcttgttaagaaagaaagtgcttctttctgtgaaatcatagataattctaggggtatcaaatgtaatggaattaaatcttataaaatttctgaatggacttccttctgcttttttttcacgatagtagagaaaaaattcaaacttccttggacaaaattttaaaacagtatgccctgcagaagaagaggttttagtagaaatctttgtttttgtattctttgatttcttagatctggattggagtgggtcaccaaactttttctgtgagaggccactaagttaatattttaggctttgctggccatgcagggtctccacaattgcccaaccctgcccttgtagccagaaaagcagcgataaacagtgtaaagcattgtttacaaaaataggtggtgggctagatttgatcttccagctgtggtttgccagtctctgtcttggattctaagctacttaaagtgtgtcctacctccctccctctgcccttcctcttcctccttcccctccctctctaattactatatgaacatctggcacttcgtacttaagccccccttttaatgtatattttttaaatacctaaaatttcttctctgaaaaataaatatttctatgctagtctgtagccaacagaatgtaacaccctccctgaaaatgccaacattacccgacacagactgggattaaacaagtctaggcttctagacaaagaagaaacagtgttttcttatctttttgagtgtactgaagcagaagttaactctttgctttcagatgtgtcccttatcatcgagaattgctggtggtcctgtatcattttattataggaaggaaggatggacaccagagagggtggggaatttggtttacagggaatcttgaccagtgcctgcctataaagggtaccactgtgaaatccccagcagtaagtaggttttctaaaaatcaagtgtgtatttctacttgcctaggttttagggccttgtgaatgcaagtcgaatgatagaggaaattggcttggaggaaaatgttggggagtttgggtttagctgggtgcagtcacccctagacttggatgtggagtgagtacccctgttgactttaacatctgtgtgtgtcttaaagaagactgctacttttctggtttattgtctatgcctacagatgacacgtggaataaattgcacattaaaatgtctgacatgaaaatcagaagagcttaagttcattccacagaagccttttgttagaatcttcaaaggatgagaaccaggatgaagaagagtttacagtagggaagtatttctcaactgtaattgtacataaaaattgcctatggtgctttaaaaaaatacagagtctggggacacatgttctcgggatctcctaagggctgtcacagaccataaagtttaagaagaaaaaaaaaaaatacagagtttgggacctcacccaaaacctaccaaaatgaaacttgtggagatgaggctcaacaatttgcattttcaaaagctctgtgggtgattctaatagccagtctgggaccttattgtgggccagattatgagaactactataacaggaagacatagacctgggctggctctaatggaaaggggccttctagagcgcctgggggttttgaactgtttgggtacagataactctttttagtctggatacttacagtgatcctgaaaatgtatattatgccttttctctttaggaaatctttgggaaggcttttttagagaacgtctttgtggatgaaaggggctctctttctccacatctcttagacccactccaatccactccaaaccaccagagaaagtcctcattgttcagtagaaatccagctgccacactggatcattcccatcagcacaacacatgatgtcttcccatcttaaaaagcaatttgttcttgaacacccctttcccccttcagctaccacctcatttctttatagaaaaattacttagtgggctgggtgcagtggttcacgcctataatcctagcaccttgggaggcccaggtgggaggattgcttgaggccaggagttcagtgttgcagtgagctatgatagtaccattgcactccatcctgggcgatttagggctctcccctgtctctaacagaaaataagaaaaattacttggaaaattgtttttattacctgtctccaatgcccccttcccttgtgcccagcattctctatggctttcattcctgtcagttctaacaaagcacttcaaggtcacacctccaggttgccaaatccagtagccaatgctcagtctttatctttcttagcatttcaggagtatatgacaaagttcagttggtcactctcttctttttaaaagaagctttttaaaatttggcttctggaattctactcttttggtattctttctacttcagtggcttttctctccagtctccttttctgggtcctccccatttcccccattgctaaaagttggtatgtcccgagacccagtctgtgtacctcttatctatctatgtccattccctagttgttttcctctaatcccatggctttgaatactaactgtatgctgacgacttccagatttctctctcttgctgcagccttttcctgaactccagacttttatatcctacctgctgaattgatattttcacttagaggtttcgtgggtatcttcaacttagtatatctgaaactgaactcccagtttcttactctccatccccccatggctgcttcatcattccagttgtataagccaaagcttgcatcccacatccagttcatcagtaaaagtggtttgttccaccctcaaaatatgtccaaaataccattatctgttagctggattgttgcaaaactcatctaactcatcttcttgtttctctgtcatcccttctgtagtctttggtcagtacagcaaccagtcatccttttgaaatgctagttagagcctgttactcctttgtataaaactctccagtgggttctcatcttattcagagtacaaaccaagtcttacagtgatctacagagccctccatgttggcattccctcctcctctcagcttctctcacctcatctcctaatacctttccaccttactcactgctgcttcagccgcactggcctcctcaccactccctggaacttgccagcatgtgcctgcctcagggtattgcacttgccattcctggaatgctcttcccattcctggaatgctcttcccccagatgttgcactgttttacttcttcaggactctgctcagatttcaccttatccatgtcatgagaccatctctgataatgctgaattaaataggctccccacaaactttctattcccacttcgtttttcaccgtcatctgacacacagaattttcatttttattttaaaatctgttccttacccaagcatgctccctacttttactgtaagttctacaaggttgagaccttgtcttattctctgctgatccccagtgcctagaacagggactgacacatagtaggttttcagtaaatgtttgttgaatgaatggaagaatttggacttgagcaattatcaaggccagtcatagctgttaaccttgacctaatgggtggctgtggtaagaaattaataagcaattgtgaaaactgagaaagccattttagtatgtaagatatcttatggtatttgtaatttgtaattatttcctcttttaaggacagatgtaaacagtacatgatcaggggaattagggaccaagtttattaggaatgaaactaaagaataaaaggcactgtagcaaaatgaaggattggaggggtttttttgtttttcgtttttgagatggagccttgctctgtcacccaagctggagtacagtaacacgatctcagctcactgcaacctctgcctcccgattcaagtgattctcctgcctcagcctcctgagaagctaggattacaggcacctgccaccacacccagctaatttttatatttttactagagacggggtttcaccatgttgatcaggctggtctccaactcccaaactaaggtgatctcccgccttggcctcccaaagtgctgggactacaggtgtgagccaccgcgcccggtggattagagtattttaaatagcacatcacagtggacttttaagttcacttagcaaatagttgttgaatagaaaaagtaaactattggtcaactttttgtgactttgtgggattattggagttgaccttagtctattactataccaccgtgactaggtattagaatcttgtttttctaattagattttctctttttaaaaaaactatttttcactcttctgttatagataaaagccaaactatagccagctttcaatagtatatgaatatcacagaacaagaaatagcttcccacacaattatggtgtctttttcatatcttaacaattacacatttctgaaatatgggcttatgtagcttatatttaattgcctttttatttctttagtgttataattaacttagttgccttctttgtgactccgttaaatctcatgtcagtcaaatccctgtagtgggatctttgttcagcagagcgagtggattttttgcctcagcttacacgagtgggggtgaatattggccttgttcctttagcccagctcaaggacttattcatgcctgtagtctaccaccatgaattaggtctggtattgagtcttggaagcatggggtttgggttaataaggcatattccccagttcttggcttaaaatttcacttgggaatcttttttggtgagtatatcaaataaaatggcaaagatgtgcagattaggatgaatttatcgtatgttttgataatggaaattgtttgtaccctctaacagtgatttgcacttatttgaaattactctccaagggtgtttgacattctagtgttcagttaagaattctctctgtatgcatataatggctgttttatgatcacattttaattcctatgataagtcaattttggccctccagtttactgaagtgtatatggcattttggggcattgcaattaggcaatgcaagcagaaagcttttattttttagaacttctgcattaggttagtgctgtgatcttatttaaccatagcaccaagtagtattttgagggtgatagggaaagagaattgtctttttggcttaaactttattttgatacttcatcgaaaaatctaatttccatagagattacggatttatcttctccaaaatcatactgtctatttcagaacttttgttttcctcttagctccatagtgataatcataccattatttttataatagcttttgatacagaattctgttagctttaaaaaattctaaaatgatatcttctattttacctacctgctttgttatatttcactgtggcaacatagaattgagactttccatattccatctctgttcatcttagttagcgtgtctttccgttattaacaatggcccaagtgtgataggaagtgcttattgcctgtactcagaaaacatgactgttgaagccctttgttcattcatttgaaagggatactttctcaaattgtaagttccattgcatttgttgtcataaatttagttaggaattactattttatacaaaactgtaaaggttatttgtctgcatttttaagttgtgctgatctaaatatactttctaagggattgtcctcttgcactgttggcatttgaccgattgacaagggggaggccatgaaaagggagtacagaaatttaggggaaaggaacaggataataagtttttaaaaacaaacaattttgaagataagttttagccaatagaaactagcccttcaacaggcaataatgaggactgagtttttcagcatctggagtgactgcactgtaccagaccatcttggtatattccttatgtgcttagttgttctgtagtgcttccgatcatctgcctgtgtctgcttgaggatcccacagtcagtattaagttggccttgggtcgtcttaatcagtgaggctctatttgtgcaatccatccgctgaggtggaacaataacagctggtttgcagctggatatgttgtcctgggaactcttgtttcagccagcagttatgctaacaaaattgaaaacattttcaaatagttgctttctgtgactactgtttgtgttaactgtttggagatcccatttagtagcctaaacacaccccatctctaattgactttgtgctacaactttattaaagttttatatgcctaaaatcaagtctggcttcaaggagagcattccttttctgacttccaaagagttaacacataagagccagtagtgaaccagtgactcctaatttgatactttagaatgaactagttttctttttctaattcaagctgtggaagggcattttgcaattttgtaaaattctatatggctattgtcattcattactaaactctaaaggaggttgtttcacaagatccttatggaatttttctgagtagcacataacagaggagcatttatgttccccagcagtcagtgcttgaatccaattctaagacaagaagagtttctcccttattcagagagatgagaaatactttaccatgtaggaggcttaagcagaattccttggcttggtcccacatgaacaaaggctggattctcattgtcgatgcggcctgttcccctcctctcattccctcaaccagcatgaactgtaggatctagagcaggaagtattggttaattttgtgtgcttcattctaaacatctgcccttgagttttttgtttatggaagggatatggcagggggaggaagaggggcagtagaacactcagaagctaaacatttttttggtggtgtgtatatccatggttagtcttcgtgtgtgtgaacatggggtgaggagtggaagatgttctggttgaatagttgctggaatacatccagaaatgcacttactgttttccttaatcatttggcttggctactttaccttaaagccatactgtctactttcacttgctcccgcagcatgttgataatctagtagtgtcatcagactggaaattagaagacctggtccagttttctattcatctacctgttaactggatcttcttactttgtcaattgtgaaatgagtaggatggacagagtagggaagtatagtgagagagaggacatggtaaccctcaggtagagctatttaacagaataaaaagctccttagtgttccagttctggttgtagttaattccagataacacacatacctcgcactttgacccctctattccattttctgtatttgccttcttatttatccagactggattccaaattccttgaagcaactttattccccttgtcttgttgtctttcttttacattggcagaggggatgctgaatgctgcagcagaaatcacacctccacagagatgtttgtacaaaggcatggcctcctgctctcctctcagccacctggtctttgcccagtaagccttcttttttctagtcagctacctttgctggactttacattggctattataaagtttctacactctgttcaaatattccccacccaacattactccctgtctttgccgccagtcttgagcaggtatccttgattttcactacacagaaaaaaagtcatcagtagaactcgaattttaacttctgccccttaaaacctacaatgtcactttgcatatgcacccagacagagagcaaagaggcaggtttccttctgtagagaaccagtctcccaacaaacatggaatcccattcttgttttccagcttctatttttcacctttccctctctgctgactcaaatacaacagcatttaatacacgttcatctctatcagaaaacaaaaaagaaaagaaaagtctttccttggccctgtaacccttccaaatatcatcttcccctccttctcctcttctttaggcagactacatggtagattaactacactcactgtgtctgcctgctgtctattctcaattcctttgtttttgttgtttttttttgaaagggagtctcgctgtgttgcctaggctggagtgcaatgtcgcgatctcggctcactgcaacctccgcctcctgagttccagcaattctcccacctcatcctcctgagtagctgggattacaggcgcgtaccaccacgcctggctaattttttgaatttttaggagagacagggtttcaccatgttggccaggctagtctcgaactcctgacctcaagtgatctgcctgcctcggcctcccaaagtactgggattacaggccttagctactgagcccggcccattctcaattccaaccactgccatcttgtccctggcactgcttttggtgcagctgtgacctctgtggcttgaagctgatggatacttcttagtcattatcttacttgactctcctagcagatttgaaccccattgattcctccctcctcaaaaccatctttccttggcttctgtggcatttttattcttttacttgccttcctccctctggctgccccctcatagcctcctctgtcatcttcctctgtgtgtgctgtgaatgtttgtgcacctcagggtggtctcagaagtcagctgtcacggaacacacttgctccatatgcttcaactgtactcaagtctccagtgtccatctgcatactagtgagtcccaagtctctgtctctaactcagacatctctcttggcccgtcaaactgctcacatccagctccctacagacatttcctcatctactgacctgcaggcatcccagaactagtgtatcggaaactgaattcatcttcccatcctgcccctgcgcctgcctccagtcctgcccacgcttctctgttctctatttcagtgagtagtactaccctccacttggttcatttgaaactagaaaactgaatgttattcttaatccttccacctcatggaatgggaaaaagcagctttgacaatgaaacagggtactaacagcgacaagttgaggagcctttcaaaagcagctccctatcgcctttgtagtacatcagttactaagttactattgaaaacggcttcctacacctcactgaggtccattcatttctctccattcctctgttcccattcttagttcaacctctgtcatctctcctggattactgccacatcttgacctccccatcttcgttcctgtcccttccaacctaatctccacactgatctttctaaaaaatcaaacctgatcatgtattttctggtttaatgccttcagtggctggccattgcctttaagctgaagttgctccttaaacatgaccgtagcctggtgtgctctgcttcttgtttgcctcatctccagccacttctgtagttctagctaccctagacaactctaattcctatggtgatcactcctctgtgttctctgggctttcatacatgccatttcatgtgcctggatgatgggtccctgtttgcttagctcattctaagcattcctcatgtcttggatttagatgccacttcctctaggaagcatttcttgaactcataaatctgggttagatgatcttctccatgctttccaaacatgatgtacttcccctgtcatggagtcatctcatgatgagttgtaaattgcagttgtctgtatgcgccgttgggttgactgcaactctgagggtggtgcacgtgactctcttgtcatggaggtgtgtgagcctccatacagactgccacagagctccctcatttccagctgtggctgtagattggcataagaaaggtagccctgcaaatgaagctcagtgccagcaaggccaggccagcacctgcaagtagactgcatcagagtttaatgctagcataattgctttctggacattttgctacttgtggctctgtgtctgtggctgcagcaagagacatatgcctggttctttcagagggtggctttgtagtacagatgttgattggaacacaggatgccttgattgattttaccttctctcctttggcccagtctgctgccgttgggttgctaaagaacaatgagatatcagaaggatagagagaaaatagagaaagaaggataatctataatctacagactagtgagcaagcctttgaacagtcgaggccacctactcatgagtaaaattacattgtttaaccattctgtaatgtcttagatagtgagtctctggaatgccacagatactgtactataacctcgccctcattcaaaggtgatgtcttgacatttttgacgcaacaaagagatacaggtaaaacttgcattcttttaacagaaagtgtgtaaactgtatttgtgtgacttgtgtctaggcaaaatgcactgcatcctagatagaatattcatgtttgtatagtatcctttagtaactgtaccaggaacagtcaggtccttttatgtgaacgtattcagaatcccagttcagggattttctttataaaccctattgtggtaatgccttatatttgtatagaattttacaattagtcaagtatgtgtagatcttagtttgaccttccaacaactcttgaagtcggtggggcagggattgtcttcatttttacaaagagaaaatggcagagcagaaatcatatggttagtaaaggagggagtcaggacctgaactcaggtctcaaaatgccccatcctgtgttctttctgttatgccacatggctttatgttgaagctaatgtgtgtgcaagtatgtttcatgtatgtgggggacagttaatccaacctcctctaagatctgggccagttgagaaatagtcggatattgctcatcctgtcagttttattatagagaacgctcagttgaagaatgtggcctggacacatagctcgcatgggctttctgctcttttcctccctgaattgacctcacccacttactcccagatccagcagcaggacagcggcaggccccaccccacacagaggcagagccccactgtgttgcactgagtgcaggagaggagagagggggactccagccggcagccagagagagacaaagcggggtccaggccacacatgaggaatcgctccttgtctctcagggactagtgggtacgaggaagtgaaagtggcagaagtctctcctcaacacttctgagagcacagaagttgctgttctgtgggttttgtaggagagggttgggatggttcttgaattaattggcttagggagaaaaaactgtaagctccttgaatacagggatctctgtgtcttcacacattctgtcccctgatgtatatagcatagagctgagcatagatttgtgcccaacaaattcttgttgaccaaactgggatcttcactataacatagaagtagcaaagtatagatattgttagagttagcaagacccaatgtgtgaatgaatggtgattttatattttacccatgtgaagacacactggctggcaaccaagccatcctgaccataagaccacactctggcttttgcagggaactgtctgccccagtgactgctgtcttttcctctctgctcagagctcatttctcatatattctcttttgaacatattgaaacaacctttttaaacctcctttctccctttgtcttttttcccccatttcattgttcatccactgaaggaattttttttcctctttcttattctactccctgctacatctctcaaacactgtcctcccttcttcaaatgtctgtatcttaacttggtagataagtagaagaatagagctgatgatattctttctgcgtcaagagtaacgttacagttaatagagaatgaggtttttttaaagtcttaaagggcctggagacccatttagaaagttagcatatatttgcttttgtatcttttaattaagcttttgctgaagtaccagcattaagaataaacgtactttttattcaactttagttttaattaatagtataagtacagtactaacatacgccgccagttttcattgcacacaacatttccacaatgcacatcacgacaggcctttatgagccaacttatggacccaactgcagtttgtcattttgggggaaaatacgtagttttctgttttagaatagcctgtcttcttggtttgatgtgtacaaggagatttatatcctttgtcaagttccaaactaagctgggaatagagggcatttgtttgcttcatacgtatgatttatgacctttgatgtgtttgtcccacaggaaaagcttttgacatcacctatgtgcgtctcaagttccacaccagccgcccggagagctttgccatttacaagcgcacacgggaagacgggccctggattccttaccagtactacagtggttcctgtgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggtaaattctcacaggttggcctgaagccagctagttctacaacatgcgaggtgtgggaagattattgtagtggggcttgtggtcccacttctgaggtacggggtcagagtagaatacttgagcaacacagacagagagcttgattctgctctctgtgtactattaataagtgaaggaaagtagttttgttcctgctgcctggttgatgtttgttcttatgcacttgcagatctattctgggatgtaaactttacacattttttaaaaagtcaaacaattttaacgttagtctctgtacctgaggtggaaacattttccttctgaccttttgaagagaacatttgacctaattacccagatttcttggatcttttcttgcctattttttgatttgacaaaataaaatgtattttttaaaattagcaaaggggaaccgttgaagcaagatatttaagaatgccatcttctttcatttttacacaagaaaattttgattagatttgtctggcacgattgctgatcattaaagaaactcctcatcacctaaaatggatgatgttagtaacaggatatggatgttagtaacaggatattaatttaggtacccatagcactgtacttaaacattgtgatagaaacctttccctgtttgagaaggatttcttttttctcctgaattctacatgcatattccttatacaccataatacggaattcttctatgttgctcatatttctgtgaacttttcatatgtcctggctatttgattatggaaaagctggtgagcctcatgctgtactcagcactttaacacagaattggagatgctgctgcatgtggctgaagtcaacaaccacatggggatagcctttgtcagttgactgaaacaagaaagtctgataatgggttttcaaatgctgtgtacattatatgaaaagctattgtgatttctaaataggaaataccccatttttctagggtttctaatttggatcttcttattctttctcaccgttattatgttcagggactctctttctaattgtatggttttggacagtgacaaaagataagaatatatttttctgtgggttcagttgccccccttccattgtatttctgtaagttgctgggaaagcatgaatgtgaaagctgttggtaaactctgaggttatggtgagcaatgagtgtgcttgccaacaccttgcaaaaaagtgtttcttgcaatggagataagttgtgttcaaaataaatggccgagagaatagctgattttgatagatgaaaaagcagggccaggcgcagtggctcatggctgtaataccagcactttgggaggcggaggcaggtggatcacttgaggtcaggcattcaaaacccacctggccaacatggtgaaaccctgtctctactaaaaatacaaaaaaaaaaaaaaagttagttaagcatggtggcaggtgcctgtaatcccagctaccctggctgggaggctgaggcgggagaatcacttgaacccgggaggtggaggttgcagtgagcaaagatcatgccactgcactccagcctgggcaacagagtgagactccatctcaaaaaaaaaaaaaaaaaaaaaagaaagaaagaaaagaaaagaaaaagcagaagaccgaatgcccagtggagaggtgacctacaaatactctttaagttgatcagctagcaaacatttgccagacttctttctttcctacagcaaattattgcattttcctgtcctgatgaggcaacaatagaaagaacagagaaagaacagtgtagtcagtagaaaatgcagtgatacaaagttgtaactgtggttttctggcacctttgctaactgtacacccagtcagcctgtcttgagccatttccccaactgtaagaattgtgatgtttgttgctctttatgccgtagaaactagtgagactatatgaggtaatgagactgtgtggtaaaaatgctatgggttatgaccttgcatttaaaaaaaaaaatgctgtgggcatctgcatagacgtggtcagtcagtttcattatgcagtaacatgagttacgtgtctctggatgtaagagctctgtctctgatacccagttgccaaggaggttgagctaatttgacttttagctgatctgacaatgagagagaactcttgcctctcttcctctcttcattgctccctaaacctccctgcagaagctgtaatctcccagatggggaaggagaccctttttggtttcaccatattataagtattactaagcatgtgttgatttatggtaataatttacatttattaaagcacttactatagcatactataatgtgacaagcactgttctaagccctttgattttctacctcagttaaccctcacagtaaccctgtaaggtagatacttttattgtctccattttacagatgaggaatcagaggcccagaaaggacataacttgccccaaatcacacagtttaagtggcagaactggaattcaaaacctgcagggtctagctccggggtctgttctttaaagatgcccattaggaaaaaaaaatggcttagctttttgagaagctcttattcaaagagagctgtgataaggtcgaagccttgtagaagatataataagcattaaacacagaaatatgtttagctatttacattacagatgactaaaagattcctactgttgtggccatgagtaggagttgttattggagttccaagtttggatatggtgaaatcgtcgtctcttttcctttctaattatacttgaaggctttgtggagattagcttttatgagctctccatgttgttctatatgccaggtatttggtgtggcttaaggcagtggttccaaatcagagctgtgcctcccagactcacctggagccttctgaaaacatagatgtctgcacctctgcacttgcttgttacgtctccaaaggtgattttgttgtgcagtccctaggaaagacttaaaatggaaatgctgtctttgagtggttatatgtaatacaccaccccaaaacctaatggttttagataactgtgatttatgatttctcatgattctgtgttagcctgggtcactcacctgacaggtcagctggggcctgggtctctgtctccctgtggtcttttatcatcaggaagcttgaccaggatttacaccacagcggaagtgatctgggagggtgagtccctgtgcacaagtacttgtcaagcctctgcttatgtcacatttgttgatgtaccctcggctgaaaccagtcacacacccaagcctagagtcagcagagaaagagactgcactggttgtgggccctagcagacatgattcactgggatcattagtatagcattctaccacacatgtaaacatctgcctaaaattagctcagtgtaagggcttagatctcataaaacctagggaaaaactctacagcccccatgcttgtcctctgccattatggtacacctaccaacttgataagttatggtttcttcaaattcattcattcacttagcaaataatagttcgcatacctactgcatgctagggaaatggcagtggacaaaatagaaatttcctgccctcgtggtacttacagtgtggtgggaaggggaaggtgtgtgtggaaaaagacaatgtaaataaaatgagagtgggaaatagggagttgggtaggggtagcaatgttagataaggtggccagggaaggcctcagagagaaggtgatattgtggggagggtcaagacaaacacagacaacatcctattggttcaagcctaagtaatgatttattagcgagtacttgagcatctccctcagatctgtcagtaggggattgggttggcagggaggaatagatgctataaaatgggcaggggtggccaggcgtggtggctcacgcctgtaatcccagcactttgggaggccgaggcgggtgtatcacgaggtcaggagatcgagaccatcctggctaacacggtgaaaccctgtctctactaaaaatacaaaaaattagctgggcgtggtggcgggcgcctgtagtcccagctactcgggaggctgaggcaggagaatggcgtgaacccaagaggtggagcttgcagtgagctgagatcacgccactgcactccagccagggcgacagaacgagactccatctcaaaaaaaaagaaaaaaaaggacaggggcaggcaatgaccagcatctctgatccaaatgtggtgccccatgagctctaagctggtatcccttactggatttggggtccagatacaggatggagggaaggggcatgtgtatcgagtccctaatttatgctgcacattatattttatttaagcctctcagcagccttgcaaagaaattagttattatccttgtttttggagactccgagtagtaaagtaacaaattaaagaagggaagagtcaagaaggagaaaaatattagaaaattaaagaagtcattgagtattataatagatttagtgctaaagagggcgtaagttaaatgataataagttagtgatttagaacattttgtcacatttatatcattttcagtccctccacttctcttttatgtttctatttttgcttcctgacaggaatgggtaactgccactgacatcagagtaactcttaatcgcctgaacacttttggagatgaagtgtttaacgatcccaaagttctcaagtcctattattatgccatctctgattttgctgtaggtggcaggtaagtaaactattaaattagtcttgaaagtgtttggagcttttgcatagaggtgaatctagcaacttgtttacaactatgttaataccgttgttagatgttttctttaccaagaataggagcggcagtccttcctgtgtgataatgcttagctgaaaagacagacagcagcctaggatattttcactgtgagatcttcttgttgttctggaaactaagcatgtaggttttccaaaaccttgtcaaatccacacatttagtgaattcttattgacaatttaagtgcaagggcactgtgaagcacttgaggaagggtaagactcaccttatcctacggagaagtcctgaccttcttggatcttacacatgaacagggtaggcaatgtatgaatatgtgaaaactgaaatacttgtaatcacctgtttttaaaaaatagataaagcagcagtagaaaagatgccacatatcaagaatgatccaaaactgccaggctagagaagcagatggcatctaagctgggtcttgaaagctttggataaggaaggagaggatgccttggttggatgcaagaggatggacatgttgtaagcagaagtttagagacgggagagtataaacccatttaactgaaggaaaatctcttaaatttgtagagttgtaaaccagaaagatagtttcgtggccagagaccttaaacagcaggtgaagaatcttggacttacctcccctgtgttagaccatgagatcccaaaagcagaaaacttatttttgtttacattgtttccggtatgggattggtgcttagtgaaagttgatgggaactgtacccaatgagaaatcaggcagaatttttggagtaggactctggtaagaaaacagtgggccaggaggattaatgtgcaaacagggtaaaaatagtatacaattgagggaatttatattcctgttatgatgctggattaggcaacaaatacatgacattaagctggtggcagcagaatggaaaggaacatatagatgcattttattgtgaaggaaatgttaccaggacttcagtcaaaggtccttttatttagtgatcaggagaatggttggtaccattaacaaaataaagaagatgagctaaactgaagagtttggttatacatatgtaaaatttcaggtcatgggggacatcaaagtttgtgcagcagtcaaggataagagcttgagagaagatgagagctggagatctaaatttgggacttgtcctgccacactatcaatgattctgaagtattttagtgtatcagtgaatggtagttgaagctatgagactgattgctgtcattaaggaagcaagtgaggggaacattacgactccatggtgtacattagtattgatgggaatttccatgagtccttaatttgttatcatacttgcatctaggggatctttcagggattcttgctccagacaacctcaggggatattagtctgactaccaaacatccatatgggggtgaggtatctaatgtgtctcaccacctttaggtcggaatactttaaaatcattatggcagataattgctgatgttcatcaacttattttgtggttttgcaatcctgagcacataaataaagcactccttgatcttcccaataaccttatgaaataggcattgtcatcatccctgttttacaggcgaggcacagaggttaagttacactggtaagtgacagggaagggtttcaaacccaggcagcctggcttcagagtccatgcttttctgaaccactatattctgctacctcttgacacacaggtttgacttcaggaattgatcctacaggtagcctcagaaattgttagggactttcttttcatacctggttaatccctacccctgttaagtaaagctaccttgtttaattttttttatccttaaaaattcagacatccattacttaatcttgctcagttccccagtttacacttttgaatggtaaaacttacttctttgtgtacatagtttttctgtgtgcatttctgggactttgcagctgttccattttttggagtatctcttctctccccagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgcgtgagtgccccatgacgtcagtctgtcagttgtcttaaggacttccaagggtggaagaaggaatgggtgactttcttttattcctccttgaaaggaaagctctgaaaggccagctttttgtgtaatttgagtagtattcaagtcagaggaaagtcatagatgagggcaattcactgtaaaggcaaactgagggttttgtgtttccttcatgaacacatgtcccagagttggagcagcatctgcaaggtttagaaatttgtttggatccaaatactgggccagtgtagtctactccggaatatggtttctctagtcgtatttgttcccctttaaaatactattatttttatcaatgctcaggcatccaaggtaattaacatgtatcaaatataatgagttctaggctaagagggccattccaagattatttcttttttcttttctttttttttttttgagactgagtctcactctgtcagctaggctggagtgagtgatctcaactcactgcaacttccacctcctgggttcaagtgattgtcttgcctcagcctcctgagtagctgggattacaggtgcatgccaccatgcccagctaacttttgtgtttttagtagagacggggtttcaccatgttggccaggctggtctcgaactcctgacctcaggtgatccacctgccttggcctcctaaagtgctgggattacaggtgggagccactgcgcctggccgcacaagattttttctcaaaactattttttctttatctcactgaagagtacaacggggagaattttcccactcccctgttggagaggtgggtagctttgggaagaagaataggtcctagtattcctagaaaaaggtaaaaatgaaaaaaaagtaaaatgaaaaaacttgaaacattgtttatcccttcataatgtcatggtttattctgaacagatagagaaagaaatctcaggagaaaggaaccttttaatcatgattttaaagcagaaatacttttcttatgtccttacaaatattgtttatcatattctgttaagaataaagagaaaaagaagatactcttaacttgcagaaattattggcagaggctgggaacggtggctaacgcctgtaatctcagcatttgggaggcctatggggttggatcacctgaggtcaggagttcgagaccagcctggccaacatggtgaaaccccgtctctactaaaaatagaaaaattagccaggtgtggtggtgcacgcctgtaatcacagctactcacttgggaagctgaggcaggagaattgcttgaacctgggaggcggaggttgcagtgagtcaagattgcgccactgcactccagcctgggcaacagagtgagactccgtctcaaaaaacaaaaacaaacaaaaaaattattggcagaaaccccgagaagggaccactatcttaactcactactgtttccactgaactgccgagaggagattttcttattcatcttttcaacaaatcctaagatttgcaagtaaaatttacagcctcctctaacatttgtaagcacttgcttgaccttctttaattccattactgaactgtaatattcagtgttggaagctctacaataaaggctggtacaagaatgaaatactcctaatatgtggcatctaaataaatggacatgtgtgcttgaaaagcattctgcttaataatgtcgtattttgagtctatccaggaagttacttaaagaaccaaacattgccaattcacctctagcaaatgaactgagtactgtagctaaaggactttgatgaggaactaagtcaatttgcttttctcgttggtcccttcagcactgtgacacttcaaagagtgacatttctggatgttgtgacaatactacattaattgtcaggatgctagggctagggaagagaactaccttctctcaaggagggagccatggcatttgctttagctgtaggttgggacagtgtggacagtggtgttattctgctttaccgtctcagaacatcagatcttcaggtgggttgggcttggtggattgagggataagctagggcgtcttgagggaagagaaatagctaatgaaggaaggaaaagggcactttaaaactaacttaacaaaactctaatttttggtggcaataactcaagtttctaaaaaagttttcagttgtaatactgtactatgaaataactgatcataagaaagagagaaaaagaacaaaaggggctgagtatggtggctcacacttgcagtcccagcacttgggaggccaaggtgggagactcatttgggaccaacctgggcaatatagtgaaaccctgtctctgcaaaaataaaaaataaaataattagcaaggcatggtggcatgtgcctgtactcccagctacgtggcaggatgaggcagaaggatcacttgagcctgggagtttgagaccagtctgagcaacagagcaagaccttgtctctgcaaaaaattttttaaaaattagctgagtatagtggcacacacctgtagtcccagctacttgggaggctaaggcaggaggaggatcacgtgagctcaggaatttgaggctgcaatgagttatggtgacaccactgcactccagagtgagaccctgtctccaaaaaacaaacaaatcaaaatgtgttcatgattttggttagaagaagtctgcattaaaaaagaaaaatatattccaaaaaagatgtattcgaatattttttttaaacaacatcctgttcgatttgaaaccaaataaaacttctttttatttactcttcaagatactgtctacattttgggaagaatcaataactcagaaaaaaatctttttattataaatatagtaaggaatttttgtgactacagatacttggtcttgaaatatggttgtgccctgcagggaatatagctacttaacagatcacccatttggagttgaggcttccctgtacatggatgtttctggaggatctagatttctttttaattctgctttcatctgtcgtggcactaattttgacccatatgtctcaagttaccccagtctagatatataaataatctggcactttggaagttagtgtcttaatgtatttgactcatctgaggcctaaaaagttaaggtaaattgaagcctgcatataaaatggcactttgtttttggagttgatactagaataaaggctaaagattcaggagaattataatttgacttgacttttacttgtatatgaacaattacctggaggcagattattttctaagtacgagaattccttgtatcttacgatggtgctgttttttagagggaggaacatttctttatcatctggctgtatataccctttattgacatcctgttgggttttgttggtggtggttttttgtttgtttgtttttgagacagagttttagctcttgtcgcccaggctggtgcccagtggcgtgatctcagctcactgcaacctccgcctctcaggctcaagcgattctcttgcctcagcctaccaagtggctgggattacaggcatctgctaccacacccggctaattttttgtatttttagtagagatggggtttcaccgtgttggccaggctggtctcaaactcatgacctcaggtgatctgcctgcctcagccttccaaagtgctgggattataggcatgagccactgcacctgaccttcttgttgttgttaatgaacagtgcatctggtaatcattcttagtctaccaccatctgtctgtctcagagatgtgggaaattatgtttggttttaagtcttaaaatgctcttcttaaaggtacccagatctgatgtaactcgtgtgttttgactgacagcctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggtaagtgacaggaagatggattgaaagacaaaatgatagttccgtggacccccggaaaggaaagctttgtttccaaggcatttggacaactaaatgtggagatgtatacattattgtaacacagaaatcagtcaagatctgtctctaccccatgcctccaccttttttaaccaagttgaactttcagatgagtttctggtgtgtaagaggggggtggtggcctgagtaatggttctgcaaataattagcagcaggatcatagagacaatttgaactttgactgtaaaaggttaactgctttgtgagttcttccttgttgatgattttgtttagtctaatctccttagagtgctgaaatattcttagcatgtttgcgtgtgtacagagatgcacagcattcttagtctagcccattcttcaagagtttaacctttatatttgtcatttaggcctatatatacttaaattctagacatgggccttaaggggctgtgatcacccacagagaagtaactgatcttgtgtgcagtgtttcattgggtacaaagtgattttcaacattgatgagtaaattcatcttagcatgtgtctagaaacttaaaatgccatgacttaaagggtcatgattttgagaaagttctgatttaaaatttggtttttattacctttgtgaccatcaggagattgcatactggttctcaggcattgcttttaattaccagttatctttctttaacacattgattttacttacgtatctggccgaatttttgtttgacaataggcattttacattttaggctctctaagcacacagtgtgatagttacggcagatgcagctgtaagccaggagtgatgggggacaaatgtgaccgttgccagcctggattccattctctcactgaagcaggatgcaggtaaaatattttcaaagccagaagaagggggcagaatctatatatagtcaacacatattaatagatcttatggcttattggcagcagggtaaacatttttcctgtaataattgtcaacaagactgaggactagctgtaatggtgagccacaaggggtttggcttgtacagagagtaagcagagttttaatgggatgactatcttaaactgaaaccaaatataaaaatgactttaggctcacacctgtaatcccaacactttgggaggccaaggtggctggatcacgaggtcaggagatcaagaccatggtgaaaccccgtctatactaaaaatacaaaaaaaattagccaggcgtggtggcgggcagcagtagtcccagctactcgggaggctgaggcaggagaatggcgtgaacctgggaggtggagcttgcagtgagccgagatcgcgccactgcactccagcgtgggtgacagagcgagactctgtctcaaaaaaaaaaaaaatgactttagggtccattttgttctatgtgtatttcttttaaaaaagtctgttggctgggcgcctgtggctcacgcctgtaatcccagcactttgggaagccgaggcaggcggatcacaaggtcaagagatcaagaccatcctggccaacattttgaaaccctgtctctactaaaaatacaaaaattagctgggtgtggtggcgtgcgcctgtagtcccagctactcaggaggctgaggcaggagaatctcttgaaccctggaggcggaggttgcagtgagctgagatggcgccactgcactccatcctgggcgacagtgtgagactctgtctcaaaaaaaaaaaaatctgttaacatgtaaaacaaagggctgacttgaagagtggaagttttctcccttctctgattgttttatccatttttcattgaataggccatgctcttgtgatccctctggcagcatagatgaatgtaatattgaaacaggaagatgtgtttgcaaagacaatgtcgaaggcttcaattgtgaaaggtagtgcattctttctctagctgcattgtgttttctgttaccatatttcaagtaaaaaaaaagtaactgattgtgtcttaatctttttcagatgcaaacctggattttttaatctggaatcatctaatcctcggggttgcacaccctgcttctgctttgggcattcttctgtctgtacaaacgctgttggctacagtgtttattctatctcctctacctttcagattggtaatttagacctcatcccccaacctgttagaactgtgagattacacttaaaatatttttaaaaataaaatcagtgactctttgagggctttttgatggttggcaacactttgtattatttagcatgcatagtttttgtagtttggccttttaatttaatgaaaatgtacttttggctttagaatttatctcaatgaatggtgattacaaatgttatataaatagtaataaagtaaaatatagtttgagtggtatagcatatattggtactgttgtaggatccatttattcaaaaaggtttattgatgcctttctgtatacaaggtgtggtcttacacatttttatgatacatagaggacctgaattcaggatgtttacagtgtaaagtgcttgtgttttccttctctacctgcagatgaggatgggtggcgtgcggaacagagagatggctctgaagcatctctcgagtggtcctctgagaggcaagatatcgccgtgatctcagacagctactttcctcggtacttcattgctcctggtaagtaaggctagaaagcagtctgacctgctgtgtgcctctgtttagtctcagtctcacattcttgcccaccattgtgtctgtattccagcaaagttcttgggcaagcaggtgttgagttatggtcagaacctctccttctcctttcgagtggacaggcgagatactcgcctctctgcagaagaccttgtgcttgagggagctggcttaagagtatctgtacccttgatcgctcagggcaattcctatccaagtgagaccactgtgaagtatgtcttcaggtaagatagccttctttgtaaagtgagacttgacgaacattgtgaaagtggtgtctttatttaagtttaactggcctctagatgtattttaaagaaaaacttctgggttattgtggtgattttgtaaaagggagccttcctttctttacctttatcttttccaattgtactaccaaaccaatagtcttattttttatttgatttgattgttagagcattgcattgttggggcataaatgaataagaaatatttccccaacatccagaattgtccttacagaggttaatgtggccctttctttctctccaggctccatgaagcaacagattacccttggaggcctgctcttaccccttttgaatttcagaagctcctaaacaacttgacctctatcaagatacgtgggacatacagtgagagaagtaagttatgatataatttaggagagttgtttaaaaagatgattggttagaaagattcatgataatgcaaaagtttctctttcctaataatataacactgagaagtgtataacaactcacattatacatgaattatatataaagacaatgcattttttaacggctttcaaggacctggaaaaaatttggtaaaattagtaaatagtattatttactaattgattactcaattgatcagtaggtcaattgaggttacattgtatataaatagattttctaaaaaacctaattataggctaggcgcagttgcttacacctgtaatcctagcactttgggaggctgaggcgagcagatcacttgaggccaggagtttgagaccagcctggccaacatggtggaaccccgtctctattaaaaatacaaaaattagccaggtggggtggcaaaagcctgtaatcccagctacttgggtggctgagggatgagattcgcttaaacccgggaggcagtggttgcagtgagctgagctcatgccactgcattccagcctgggcgacagaatgagaatctgtctcagaaaaaaaaaaaaaatctgattataattctactggctcaagttgcctcatcttcatttctttttatttactgttgtgtaattataatttataatttgagccattggttaaattattaaaagtcataaattattgaatgattttgttataatttttggtgaacaagagtttaagacttaaaaatttttttttttgagacggagtcttgctctgtcacccaggctgtggtgcaatagcatgatcttggctcactgcaacctccgcctcctggttcaagcgattctcctgctcagcctcccaagtagctgggattaccggcacgccccaccacacccagctaatttttgtatttttagtagagatggggttttaccatattggccaggctgatctcaaactcctgacctcaggtgatccccctgcctcggcctcccaaagtgctgggattacaggcatgagcccctgcacccggtcaaaattttttttcttaaaaaaaagttttaaacaaggacctttttctctagcaaggtacagctgtttggggaggtggagttagtgatgatgtggtattgggagaggcatctgcagcttagatgtgttgatttttgaaatgcctgcatgaatatccagataaaaatggcttataagtagttagaaatatgaatctggggcttaggaagagattaggactagcgatccagatttagaaggttgtcaacatatgggcaataatttttaaacttggaaatatgacagaaaatatagatggaaaagaaggatggaatcctggaaacagttaagtccatgctctaagacccaagggcaacatggcgaaaccacatctctactaaaaagtacaaaaattagcacagtatggtggtgcatgcctgtagtcccagcttctctggaggctgaggtgagaggatcacgtgcactcaggaggtcaaggctgcagtgagtggtaattgtgccactccactccagcctggacaatgagtgtgaccctgtctgaaaaaaaagtaaaataaataaataagagccaagggagaaaaagaattttaagaaagagaaacaattaacaagtttaggaagctagcatcgttgggttttggattggtgattccttaatcactgctgagtttttgtttttaagaagtgttaaaactgtccaggcgtggtaactcatgcctgtaattccagtactttgggaggctgaggcaggaggattgcttgaggctaggtgttcaagagcagcctgggcaacatagcaagattctgtctctataaatcaaaaaaattagctgggcatggtggcacacacctgtggtcctagctacctcggaggctgagggcaggaggatgcatgaacccaagaggtcaagctcgcagtgagctgtgatcatgccgttgcacaccagcctgagtttacagagtggatctatctcaaaaaaaaaaaaaaaaaaaaaaaggtggcggggtggtgttgaaactgaaagatcacagtgctttaagaagtaatttgaagttgagtaagtaaaataaagaatgttcagttaagaagtttggctataaggaaaagacatggactataatttgggagtaggaacaagattgaagaaagtatttttagaatggggagacttaaggatgtttagaattggaagcacagtaaccaataaagccatatctcatgacctaactaggcaagataaacctgtaaacatactaaaagtagtacatttagggtagtaatggaggtgtccttcagccttaggtggttaattttcaaatgaattttataaacagcaagtgctatttcataacatgaaaaatacgctttaagcataagactgcaaaacactagagtggaatggagattacagggaaatatgatgatgttactgaggcctatacctctctgataaaatgttcctgttgatgcttgtatcaggggcaccactggattggatgaaccattggtctaaggcaatataaggtttcctctgatttcttatagaaatggaaaagcattgagctttggagtaattgtatacttgtcagaagtaaccctgagtattagaactttacttgagagtttttgttttttgttttttggggggttttttggctgttttacagagggcagaaattatgtaacctgagtattacctgttgacaggtgctttcccttctgtcttacccttgaactctgtagtgcctgcttttgtagcaaaagaatgaaaacactccttaatggctgtagacataaactcttcttttccccccacactcttgttcatatctcttctcactccaaatgattgtctgatgcttttcatttttcacattggtggggactgtaaaattcagcaaatctaggggtacatgtgtgtgttttaaaaaaaattagtttgggccgggcatggtggctcaagcctgtaatcccagcactttgggaggccaaggtgggctgatcacctaaggtcaggagttcgagaccagcctggccaacatggtgaaaccctgtctcttctaaaaaaaaaaaatacaaaaattagccgggcatggtggcatgcgcctgtaatcccagctgcttgggaggctgagacaggagaattgcttgaacccaggaggcggagattgcagtgagtcgagattgcaccactgcactccagcctgggagacggagtgagactccatctcaataaataaatatatatataaacaaacaaataaattaataaataaaataaaagtttgctataccaccactccagatacttagcactcagtaccacatgattgttctaaatgctgttttctaattctcttctccagggtgtagacgtggatatctcgtttagtgtatcagagcccagttaagcaaatggctaattttctctggaatttggggtctagttactttttagtgttactgactttacacaaggtttggaaaacaagccagttcagtgattttcttttcctcactatacacaggtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgagatgatctttggcagctcttagacctaacttctctttagcaattgtgtagaaagtgctcattgtcttatatacttgtacatttgcctgttttctcacgcctgccttccaaataggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagtctgctcgcttcatctgctttcagtgttcccttctataaaaagacctaggggaaaggggcttcggagttgttttggatctttgtgtttggttcagtttcagtggttatggttttcctaataggaagctgaggctcactctccttgtttccttccatctctcttttgggtatcccctgattgtctccatctgtcaaccaagggctttcatgtcaccttgatctaccgtctcccctttaggtgatcaaatctcatcttgaggcttcaaaagcctttctatatctatgatagctaagtttgtatttccagccctggcacctctcctgagctacctacttgccatttccacttggatggtgggctagaagccttccacttgcctttccacatccctgttcacctttctgcaccctgactgagacctgcatgcactacatcaaatgtcaggctccatttgcattcagacagcagaaagcacatatgggagctcacagagaaggaggagggtgaggacagagtatttatcccatggccccttctctatggggttctctggatcgatgacctcaaatccgtcattgatgagccaaatcagctcctggtaggccttctccaaacagctctttttgcctttaggttctgctagctgccccacccaccacctgaggcccagggtatggagcctatctcaagtgctgcactcttctcgcagtttccttacactccgtgctgatttgattgtgtcagccattttctgctgtgattttgattcacatagccaaaggaactcaaatttaaacaaatccaagttaaatatttgatttcctccctttttcttcgaccctttgtttctcctccagtcttgttcatcttagtaaatatgctgccattagcctagttgctcaagctgaaaccttagggcctatacttgattcatcttcctttcaagtcctagaaacagtcagcaaatcttactgatgttatctcagatctgaccacttttcaccacttcaactatcaccaacctggttcaaacctctgttatctctcacctgggattgcctaattgttctccctgcctcacctgctcccctacaatggctccaatctcaacatgaaagccaaaatggtcctttcaaaatgtacctcagattacaccacttttaaaccctccaatagcttcttgatacactaaaaccaaatcctttactctgacctccatgcttctacatgggtttgaactgcttccatggcttatcttgtttttctgaaactttcttcccttggatattatcctggctggtctcttctctgtctttccattgctatcccaatgtctccttcttacagaggctttccctacccaccaatataaagtagccctcaccttcaccccatcatgctgctctattttgtttaaattttttatgcttatccctatctgaagtaatcttgtttatttgtatgtctgtgtattggtcttcaccaaccgctgcatacacttcatgagagcagagaccttgtccaccttgttcacatcatcctaatgacctagaacagtgctggtatatagtagatgctcagaaaatacttgttgaatgaattaataaacctcggattcccagaaatttgagtctaattcaggccctactggttacaaagatatcacgagcccaacttgaactaatcaaggtaggaaagtggaaaaggaaggatgaggagcagtgagtagtagagtggaaagagctctggattctagctctccctctctacctgtcacttctttggttgcaggcaaattacttatcctctctgttctctgagctataatatttaatacaagcagtcagcaactgatgatttctaagttctcttctaacatgccctgattctgtaccaattgatactgattaacaaggattagcacatgcctcttacattttaagagaatggttctgctcaccctgttgtgtgggaaacttacagtgtcaagagtggcacttcacctcttttaatatcatctgccaaaacaacatatatgaatgtgccatcctttgagactggagaagtttataaaccttgggcttgactcatttaccgagcacttttaatacatgatttgggttgattgtcacaacaattaaagtgaagtaggcagaccaggtgcttcctgtctagtgaggaaatagagatgtgctcaaggtcactctggtggtctggccccgtgccagggctgcagcccaggtcctctgccctccactgcaccatgtcttctctcatgtgatgattacactagattacctgtagccagtggtaatctagcaccaaaaatgtctaaggcctttctttcataacatcagattgtctcatccccaggtaagagatgtgagctctgtgatgatggctactttggagaccccctgggtagaaacggccctgtgagactttgccgcctgtgccagtgcagtgacaacatcgatcccaatgcagttggaaattgcaatcgcttgacgggagaatgcctgaagtgcatctataacactgctggcttctattgtgaccggtgcaaagacggattttttggaaatcccctggctcccaatccagcagacaaatgcaaaggtaatcagcctttgatcagattctgtcacagctaaatgcccctttattgtgagaattcttgtgtgtctcttaaaatatgtatagttgtttagtccaatagaaatacattgtgaaccgcttttgtcttttaaaattttctagtcaccacattaaaaaagtataaagaaggacagtcatggtggctgacacctgtggtcctgtaaaaagaaacaggtgaaatgaatactaatgtattttatttaatatatccaacatatgatttcaataagtaatcaataaaaattgttaatgaaatatatgttttttctcacgctaagccttcaaaatccagtgtgtatctcacgtttatagcacatctcaattcagactcaccagccacatttaaagtgctcagtagccacatgtgacagcagctaccaacctggcaacacaggtctaaagaatctctttaggttgtttatattttagtatttctctcaggtgatttgtgtcttttgccatctctgtcttcctgccttagcctgcaattgcaatctgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgagacataggtgcctttggtgaaagtaatctttgctttttctgttataaaaaatgaatttttataagtacatttaataattgactgttcagaaattactggagcgcctaatgtaggcaaggcatccttcaggggcagtgctggagaattgtaataaagctaatgaaagaaaggagtggagcacagtggccccagctgtgccagaatcacctgagcaaccttttaaaagcacaaattgccgggtcctttctgaggcacttagaatcagacccttcagggttgcagcctgggaacttctgttttcaaagctgctacttagtgtccatacagtcccaggctggagagcactggtagcagttaagttaggaaaagaggttctgaatagcactcatgaaaattacttgaaccttaggggcttaataacccttaacattccatcttagtaacccttaccattcagttttctgatacaagttacaaattacatcagtgctatactaaaaaaaaaaaaaagttgtgcttaaagtctgtttttcttgcctgagaaatgtcctgtgttcattttcaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaacgtaaggggtgttggtggcatacaactctaagcttccactaattccagttagtgtcttaaggccagaaaggactttgacagcctcagtctagccacttgactcatagtcagggctgtacctaagtcatcgtagatgctttatttgaagaatattatccatttctaaaactctgcagatcaaagccttctctggtttctttgtatgttttcttttacaacgtttctgatgcttcctttttccaatcttttattttttccaaggaagtcttcctttgattactgagctttcccactgtggttcatgaaacttctttattgattgcattcttagtgcagataatgaaatagtggaggattctgttcacaacatgtttgttgacttgctgtagttgcttcccacccttggggcccttttggtatgattacgtgtaaacatctgcttctccttggcataaacacttgcctggaattgggcctcagaacagattggcttttgctttctgaattccttcatttctcctgtggaatgtagcataagtaattgactcagttcagagaacacagtgaataaacaaactataagataatgcaaaagaagcattagcatttgggttttctagttccttagagaaatattaaacagtggagaattgaaggtagagatgaatccttgaagtgcatgaaacgagcactgatagtttcataacttctctaattgctaagtaacctgaagtgtgtcccaaaggttgcacgttttactttaaagctcattttgacttttaaaaatgtcagttttctctgctaaacagacttagccatttaagatctcataaatagtcctgtttttcaaaaaaattatgacagtatagtcagcttatagtcagcttattgttatcagtctgaattaagagatatactcttccttcttttgctaattatgtattattttctccttattctgcagcctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggtaagctgtcaatagtgcattcattcattcatccagcagacgttgagtggcaacttactgtgcactaatctctatagaaaaagtggtgaacaaggtagatgtggtccctgttcttaaagacttatgttccagttgggaggcaaataataaaaaataaataaataaacaaaacaaacactgagataagtgccaggaagaatacaaatggagaataactgggggaaactactttatgtaaggcctctctacagaattcatctaaggtgagatctgatggatacaaaggaatgagccgagtgaaaagtaatggtaggtttgttccaggcagaaggaacctggtatacagaggcctgaaagctggagagtggctggagcctgctgagtgcagagggtgtgttctgttttttaagacgggagaggttggtacggacaggttatatgggaacatgatgaccatagtaagaagtttagattttatcccaaatccaataagaatgcattgaagaaactcttaaaatctgggaaatccagattatattttaagaggagcactcttgactgatgtgtgaagaatgatggttaggaatggggcttaatgggaagcctcaattggattggataaatatgcgtgtttggggacaggataggaaaagagaagaataaggatgtgtcttgggttttttgcttaaggtagctggaggccttatttactgagatggagattcctcagagagaatagaggtaagaggtataattttggatgttaagtttgagatacctatcagagagctgagtggaggtatcacgaaggtaatctgacactcaagggagaggtcagagcttaagactcatcagcatacagtctttaaagtcaaaggaacagctctgaaggttttttttgaagctggaaaaataaactagccacgtcttctcttcagaagtagacatgcatggagtggatagaactacatattcatgcagcacaccaacatggcacatgtatacatatgtaacaaacctgcatgttgtgcacatgtatcctaaaacttaaagtataataataattaaaaaaaaaaaaaaagaactacatattcatggagtgcccatgattcctgcaggaagtgtgattgagttcttcaggaatacttgtgtgtcctacctttcccttttctttcttctttatgtttaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaaggtacgcatgattgaacagtgcatgacttctgtgagatggaccaatctttagatgtggctcctaaagcaaggttagtatagttttataaaattctttctcagtttttaaactactcatagattataaatcatttcattttttaaacactaattcaaaaagcaacctgacaaatttactgctttaagctacagtaagcatagggtgattttccaacaaataaaaaactattcgatattcaaatttcaagcattttatgaatctgttctattacaaggtgtcttaaaatattaaaatagttttaaaaatcattaaaggcatgcgtcttcataagctttttttttttttttttttttttgagccacaatcactctgttgcccaggctggagtgcagtggcgcgatcttggctcactgcaacctccacctcctgggttcaagtgattctcctgcctcagcctcccaagtacctgggactacaggcacatgcccaccatgcccggggtaatttttttgtattttgagtagagatggcggttcaccgtgttagccaggatggtctcgatctcctgacctcgtgatttgcccacctcagcctcccaaagtgctgggattacaggcttgagccactgcgcccagccaaaaaatttttacattatcaaataattgagtaaccttccaagcaggaccaccatatatagttaggcaagagtttgtagaatgtcacctctgcacatacatttggtagccaagttccaagttggttttttccaaacctgtattcatcttcattggtcttacctttgacttctcatctttttttttttttcccacattccttagaaaatttagaccccaacaccgagcatgatgctgaaatatgaattggtcaatttacttaatggtttttatatattaataaaacctcatgatacatgagagttttaataataacagacttatatttatcttttgatttgttaggacctgagtatgagatttaagttgaatgagcatattaataaagaataatttgaagaactattcaaaaacagagatcagtttgaaagaaattacactgatatgctggcacatgggggtggcaaaagagtctatttagtttaaaatacaaaatgagtttaatttgtcatacttcaacttatgttttaaacctagttttttctgggttttgaaaaatgttcggcttttagggctggcagcatttttaacaacattgtagatttatgactaaattgcatgtgctggtattaaagtcagtcattctcaccttcattaaacattccttgggtgtcttctctttgccaaccactgcataagaccagcgatatagtggtgagtaagaaagagttcgtagtcaagtggacagatggacgcacggttggaggtgtgatgagtgcacagtgaaggacctactgggtgtggtaaaggctgtccagctatggcaggggctttgtggaaacctggcagaaagttgcgatgtttagaagagtagagatacatagggcctcagatttcatgtgagatgatatgatcctcttcagataatttacagactttcttctgcaaaccattttagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtggtaagtgattgcaaacgtctgaggtggggatgggggaggcccctggggtttgtagcaagtctgttactggcagtggagtgcttcttcaactaaattgactccatgcatctttttatttgtccctaaatatggggcagaaaagccacattgctcatagttggcatgaaacagttattaaaaactggataaaaaccaagggacatctgggttatttctctagctttgttccttctatggaactaggcagtttaatcttcctttatcctttactgaaaatagaatctgcaatcaagggtgctgatattaaataaagatctctgaaaataagaagaggtattcttggggccaggcgcggtggctcacgcctgtaatcccagcactttgggaggccgaggcgggtggatcacctgaggtcgagagttcgagaccagcttgaccaacatggagaaaccccgtctctactaaaaatacaaaattagccgggtatggtggtgcatgcctgtaatcccggctacttgggaggctaaggcaggagaaccacttgaacccaggaagcagaggttgcggtgaactgaaattgtgccattgcccttctgcctgggcaacaagagtgaaactatctcaaaaaaaaaaaaaaaaaaggtagaggcattctttttgccctctaacaaaaatttagttttgactcttgctttattaaatgtaaataattcagtcctttgagaataagtgctttatttcctgtgcagtcagtcactcagccagaatctacaggggacccaaacaacatgactcttttggcagaagaggctcgaaagcttgctgaacggtaacttctagatccctgtttaatggttaagttgtggcttctgttatggggtgtgtgtgtgtgtgtgtgtgtgtgtgtgtgtattgtcttatcccataacccataaacactttctacataacccacttttgcacactttgctctcttttctaagatattatcagctgtgtatactcttttcttccttttactttgacattagaatattcactttgaatattagaatacaatggtttgaagacaaatcatatttatatttctcaaaaccataatatttttagatttttaacttatttaagactgtagtaactgaatgaaactagcagattgttgttaataaagattaggcatgggatttgtttttaactaggtaaatgatttcttgctggcatacacaattttatatgtacattactctcaaataattaaatttaaaagtagtttttctgaagaattataaacattttctcttataaatgtataccaataatttttttggaaaatattctcatctcagttttagaatgctattcataaattcagccccactgaaatgatcacaaaattccaaatgaatgacgttttctaatatttgtagaattgttgcccatgttagtatatgtacatataataaagtaggccgggagcagtggctcatgcctgtaatcccagcactttgggaggccaaggcgggtggatcacctaaggtcaggagtttgagaccagcctggccaacatggcgaaacccatctctactaaagatgcattagctgggcatggtgtgtatgcgtgtaataccagctactcaggagactgaggtaggagaattgcttgaaccgggaggcggaggttgcaataagccaagatcacgccactgcacaccagcctgggtgacagagcgagactccatttcaaataataataataataataataataataaagtaagcattacctgaattttacttatgtccctatcagatggttgtttcatggcttattttttgttttatctgtatagtcataaacaggaagctgatgacattgttcgagtggcaaagacagccaatgatacgtcaactgaggcatacaacctgcttctgaggacactggcaggagaaaatcaaacagcatttgagattgaagagcttaataggaagtgagtataatttgaaagtggtttacaccccttcaggtgttctggtaagtaacactagttcaatgaaaaattaaatgctggtgcattcagggcatacattcatgcagtaagatttcctttgttaatcatgcttttgaaatggaaaagtaagtagagaagggcatgtgaagccacagagatttggtttgattcaattactgtaactacagagaatagtaacaagatgagccatgatacttaaaattgtgcacaaataaagaagaaaaaatataatagagtaagtagaggaaacataattgaactacaaatctttaaagggtgtctgaaataagaaagtatatggtaagccatacattatagaaaattttttcttttttttgttgtttttgtgagatgaagtctcactcttgtcccccaggctaaagtgcaatggcgcgatctcggctcactgcatcctctgcctcccgggttcaagcgattctcctgcctcggcctcctgagtagctgggattacaggtgcctgccaccacacccagctaatttttgtattttcagtagagacggggtttcactatgttggccaggctggttttgaactcctgacctgaagtgatctgctcacctcagcctcccaaagtgctgggattacaggcgtgagccactgtgcccggccaagccatacattataaatagaaatgataaaagaaaatgtaaatatgcaaaatgttggtattaaaatgcaagcattttaatgtagcatttcctttgaggttttgggcgtattatcacatgatcatgttaatctggttaacattaagatgctaaaagcagctaagattgtcattaaaccacattatttgtgtcttaggtatgaacaagcgaagaacatctcacaggatctggaaaaacaagctgcccgagtacatgaggaggccaaaagggccggtgacaaagctgtggagatctatgccagcgtggctcagctgagccctttggactctgagacactggaggtatgggggcagcctgtacgcacagccccaccccgtctctcccccaagtctatgtgagagccgactgctctgcacctccctctgtcctcccactgactcgctggtaaagttgagtcttatttcacatacgctaatagaacttaccaaggtagccagatgtggtggctcatgcctgtaatgccaaccctgggaggctgaggtgggaggattccttgaggccaggagttcaagaccagcctggtcaacatagtgagaccccatctcttaaaaaaacaaaaacaaaaacttaccaaggtaaagaatcctgtgattgtaaacattaaatagcaaagactactttaatgatatgaacaatcactcctaagtctttagtgcaaatccaaattataataatacatttgaattgcttaaagcagagtacatgtagacatttactcccaggctctgtctagtagagacctagagagaaataagagagaatggtttaattaaaagactatagcaggatgttctgaggcaggtaaaatattttggaattggtaggattttatttcatatctgtactcttaatcatggattctcactccaagctctgtataaatggtattttttttgcattaagcttgaggtttactaagtttcacttcttatatctgaggtgttgacttgatttttaccataaaggtttaggtctctttagatatgtacagattgtctgattctatatatttataattagaaaataggcagaattagtctatgatgataaaaatcagaacaatggcaggcacagtgttggaaaggtagagtagagatcgggtggaaagggagaaaagggagcttcttgggtgatggaaatctgtattttgattggggtgttggttatgcagaaatgcatttgtcaaaactcatcaaactatatgtggattctgtgaacttcagtgggtgtaaagtatatctcattttttaaaaaagtccataaaatcttgatctgtgcagttcttttaaaaatatcattgagtattaggtgttacagagttcctaagcctaccttttcattagtttaaatgttttatccaaagtgtagtgatcttacttgcttttcacagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcaggttggtttgatttgcaggtcgcttcatttcttgaggcaacatttgaacagtccaaatgggtctgtgatgatgccgtactttcagagacagcagaccccagtgctgagagagcagcctaacagattttatgctggcaagtctcagggtggcacctctggagagccttgtctgtccaggagacagaagggatttgctttgagggttcatcctctcatctgccatgtgtttgcagaccgcagaccaactcctagcccgagctgatgctgccaaggccctcgctgaagaagctgcaaagaagggacgggataccttacaagaagctaatgacattctcaacaacctgaaaggtagaaaaggctgagataacaggggcaaatgcttccgccactagagtgatttttttttttaatcatgacttttaccatatttattacttcatccccaactccctactttttttatgctaaagtatttcaaagggaaatcccagagctcctgtcattttatccctgcatacttcagtatggatttttttttaaagatgttttcttattaggcaaactcacataaccaagatgcctatttagagaacttatataggtaaatggagattatctttcattttctctgccagtggcatctgattctttgttgttgtttttttttcttcaccccagatagaagagaaatgtgaccaattcactgagcaactgtgaattcttgtctgataaaacagtcataggttctataaatagagaagctttacaggatgctttacagggtactagttgaaaatatgggccaggcacggtggcctgtaatcccaacacttcgggaggaaggatcactggaggccaggagttgaacaccagttcctcactggggaatatagtgagaccccatctctataaaaaaaaattttttttttaattagccgggcatgctggcacatacctgtagtcctagctacttgagaggctgaggtgggaggatcccttgggctcaggaggtcaaggctgcactaagcagtgattgtgccactgcattccagccagggtgacagagtgaaaccttgtctctcaaaaaaaaaaaaaaaaaaagtagtagttcaaaatatggactctggtgtcagtgggccttggttcaaaaccctgcaccctgcaccacaggtcatgtaacttctttaatcctcaattttcttataaaaatgatacagcctattttatgtcaaagacacaaagctcttaactcagtacccgacacacagtaaacactaaataaattgcagcttttaataatggttgaggtagtggtaatgggatgctcagcgctctgcattttaaagcacattgttgaagtaagaattctatttccagaaacggaacatttctataacactaactgggagacctattctgtagagatgtgtaatttctaaaatttcagcccatgctctcttccattttttaccctgacttccattgttcataaaacaaaatccagttggaactccctgaaaggccccctttttacttgttgggagtttagctcaaatgtgtccttgaacttgtttcagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaaggtgtgcgtttcctcttctccaagagtccctgcccatatctttctctggtcactttccagtttctttccagaccctcagagcccttgcagatttttttcctgaacttcagtaaaattgtcttaaaccatatttgtctttttttttttcttttgactaggcatgagagtaggtatccacattgaggaggggaactcagtaaaagggtgctttactctaaaatttctactatgtctcagtgtgaggtctggcttcagaggtctatagagcccattcccacaaaaaatcagactttttctaaataaacattcttctttgacctagacaggtggtatttatttcaatactatgtagtgtgccttatcaatataactttcaagtccccctttcaagtatattgccatatgtaagccactcctaggagagacttcccatagctgccattgctaggattctttgaagtcatcttcaagaataatgttttttagtttggctttctcttatttcaaggtcaatctgtttgttttatttaaaagagagattggagcaattttagaattaggtatttaagaatcagagaaacctcttagtttccttagaacagttggcttttggattaattatattttataaaatactcatatttcaggattgtggtctttttgtacattatgatgaactgccaagaatgaaccaagctagctttgaatttaaattttacctcagcgaaagcatctaatcaatatgatgtcgtagaaagtgtatgccattaaatgtttatcatttgctgtctgtatgaccccaactaaaaatagcaataatagaacagaagtttccaggattaaagaagaggatacaaatgaaagtgctagataaaatacaaaatgttattatgtgggtagtaattttttttatgattatttataacccaaattgataatgtaagtcatgagatagtataaatcaatatattattatttctggattatatttttaagacattttataaattataaaaggagcgggagcatacttgagaaaaaggaaagcttttttaaaaaaagtacaattttcttttgtgcctagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggtaagaggttttggtatatttgctcattggcagaaagtgaacagtgtttaataataaagatcccccacttgttgagaagagtcttttttatattgacttctgtttttcatcacattgtctcgtcaagaattgggttagtagcttacatagaagacaaagaatttggatcttctgccaggtaattttgttgcacaattgtcctgtcccaaagttactcagttaaaagtaaaacattgctttacacgtttgaggttttaggacattaaaagtatgtgtttatatttttcactgggtaattcataaatgttaataaaaaaggaatgcaatgaagttaattttcttcttattcttgttctcccagcacctttagagacaaagacaagtttcttgtatataagaaatttttgaagatggcattgtctaccaccccaccaaaacatatgaaacttacatctagtttaatttttcacgttttgtgataatgtgtatgcaaggtactatttgtaacaaaattgacttgtcaatggatggcccaaggaagaactaaggtccatttttctgttctatgctatattttgctttgaaaagactttaatggagtcacagtaggaatattctttttccagttgggtgtagcaatcacggtaatgacatacacgaacttgtggttacttgctcactttcagtggcaaagaagaggccgtcgttcactgctgccagaaaacatagtccctcagtgtgggtcattttcatcttgggatggaaaaaagaagtacaaagcctgttaatctcagtaaaaactctagggaagtgataaaggaaactatctctgtgcaaccacctaattttattatgctttttacaggtaggggggtggatgttggtttggattgtcctgattttctccgttatggtgtggctcaagtaaaaattcccataaaggtgtctgggcgcagtggttcactcctgtaatcccagcactttgagaggccgaggtgggtggatcgcctgtggtcaggaattcgagaccagcctggccaacatggtgaaacgctatctctactaaaaatacaaaaattagttgggcatggtggtgggtgcctgttaccccagctacataggaggctgaggcaggagaattgcttgaacttgggaggtggaggttgtaatgagccaagatcactccaccctgggccacagaggaagactccgtctcaaaaaaacaaaaattcccataaaaaaaatagatgtttctcacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggcagggtcctttctccctccttttacactcgcagacaagcttgtggatgctcaataaggacagctgccgtttggacagagattaatcatttatttgtgaaggttttttctgccttgctttcttgttcttttttaaatcttcacattgttttgatcccaaaatgtttgtgttgtccttactcaaaactaggaaaaacaattatgtggtaagaggctcagagccacttacttaaatctcaactagatttatttgtgagaacatctgttttctgatatttagacacttcctcttccattgctgtttcctatgactcatgcacagttatttgttcaggtttcatggaatttcccaagtgtatttacctttgtttggtttttaaaatgtaaattatattgccccaataaatgagtatgtgtgtcagggggactgtggctgggtcattgcatgtggagggggagtttacagaagagaactcctagaagagctttacttaactatgaaaattttcaaagaataggacatttctaataagtccctaagagtgtcctgaaggacatgttttggttctgaaacatagtttctataatcatccttaaaaaataacttgtttctgcttaataggctttactatgaatatacctccatatattattgagttagaatgtgagaaaaggagattaatttttgaagtacaaatatagtgagttagtgagtgtaggcatcctgactgcctagtcataactttgatgaagtagaaataccaacatcctcaatatgaagatatgcagcagccccaccaaaaaaaaaaaaaaaaaaaagcaatgagaggtttcaatttcctaagttagaaaagggaagaaaatctggaaattagatttgttgggtcattgggaaaaaagatttaaagaagatgaaaacatacagtcaagactctttgcctcatttttcccttacaggcttcacaggctgctcaagaagccgagatcaatgccagaaaagccaaaaactctgttactagcctcctcagcattattaatgacctcttggagcagctgggtacgtagccatagagtcatttttgtcagtctctgaatcttttgtactgttcttaggatctgatatagtacagttgactcaaaagcagatgatataggtttacatgaatcccttttaagtcattaattaaattattaatatttccttttgctgttgcttatttttgaaagccttataaaataaatgtttgtcttgcatgacagggtctttaagagcaacttgcttctttaccatacttattatttgtcagctttacagtgtgacctgaatcatgactttaggctgtgttaatgtgacaagtacttactaggtgccttctgtggaccttgccctaagtagaacactgtggtctgaggagtttctttttatattttgaagatatattgccagctagggtagcatttatggtccagtatcattgtacaactaaacagtgatttttcttaactcatcttgctggcagtatctttaagggatttaaagtaaaggatttcaatagtagaataaaagaatagtagaatcacaggctgggtgtgatggctcacactggtaatcccagtactttaagaagccatgcaaggaggatagcttgaggccaggagtttgagaccagcctaggcaacatagcgagatctcacctcgtctcttcaaattattttaaaaattagctgggtgtggtgctacacgcctgtagtcctagctacccgggagactgaagcaggtgcatcacttgagtttgaggtgatagtgagctgttatcgtgccactgcactccaccctgggcaacagagcgaaaccctgtctcaatttaaaaaacgaaaaagaacacttaaaactggtcatgactttactgcctggaattctcttcatttgctaagtaaggacagtccgatgaggggaaagctttcatgccaaaagagagaaaaaccttgatttttcaaggaaatctatgcatacggaaaccttcttttaatccagtttgatagggtgttagggagcaggcttcattttaggacagatgcacttttgtcaccagactccattataaagtgtcaacactctagccaggactctttgtagcaaggcattatattttaatttgccagcctttaaagactggtgcattttgttttggtggggggctacaggggtattttttatcggtctcaaatgtcaagaataagttatgtgccaacagatggatataaaatgaaagtaagctagaagagaaagctttttgtggaacagccagacttttaacattagtctgacttgggttagtatctttgctttgttgcctataggctgtgcaaacttgggcaaattatttaacatctgagaatcactgatgtaaaatggtcttgtgagactttaatcaagtcaagtatgcatgaaatgctgtctattgtgtctgcttttgtttgttatggaaacatctcatttctttcaaaagaacctctttttcttgctaagcttaaagtgaagacttgctgaaattatttcagcattttactcctggccattttccataggaaggctcctaatagtgtctaactcctgaaagcagaaagtgaccttcaaaactgacccatcttccctggaatctctctaagagctgagggattagggttcttagagatttgtgtatctttgatggcactaaaatgacatagagtttacatgtatacacctggaaaaggtattaaatgttatcagatggccctcaaaggtctagaacatggtagctgtgcattgaggaaacattctgcaaaaaccattgtctcagaaagaaacatccagctctatattaattgtatgctcagacccatccctgctgggttaggtcagcatttgtacttggtttgcatattttataccattgtgtgacatcaacaatctgcaagtcacatttgccgggctgcctgtgcagaatggcagctgctgggcctagagtctagtgcaggtacttgtgaagggatcattcttactgaatatgtctgttctcttctatgtactttctgaccctccagggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaaattttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttctggcaattgttggagctggataggtaagttttataagggagtacattttgactgagcacttagggcatcaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccggggtggttaataaaatgcaacacttggcatttttatgttttaagaaaaacagtattttatttataataaaatctgaatatttgtaacccttta

SEQ ID NO: 35663 - DNA, 122175 bp, Homo sapiens; identical to SEQ ID NO: 35662

SEQ ID NO: 35664 - DNA, 12256 bp, Homo sapiens
gaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcggtgagacgcggcgccccgctcaccccgggcggacgctgcgggtcgtggacgccgggcagagggagagggaggcggcgggctggatgcggcccggcttggatgggcccgaacggaggtcgcctcttgaggccgggccggatctagggcctgaaaggccgccgcttcggcagggaggccgaggggtagcggcggcccgggtggggaggtggggtccgggtgtgcgccgcggcgctggctgcgaaggcagtggccgaggcgggctccctctgggccgtgcccggcctggctaacaaagccgccgcggcctctgttgtgtgatgtacgcgtgggggcttccggcgggcggggcggaggggctgccacccaccaccgctgcggccgccgcctccgccgctgctttcgctggagggcgggcggatgtacggggcgcctggggccccggcgcaaagcgcctcagtgactgtggtccgctcgttgcggcggccgccaccgcaggcgacagggtcagtggagaaagagccgcgggaccctacggcgccccgctgtggccgatggggtcctgggcgggaagcgggtgatctgtggctcgggcgggaggcatgggaagggtgtggattgggagacacgttaccggggaggaggctaggactgtgggatatgggcgaaggaggctgggctggctgttagttttgcaggcctgagtggtgcaaggcggccgctgttgcggtcacaggcatgacctagggtaggatggtgctgcccgtaaccaggcttgtcagaagaaggggttcaccttttgacagtgttttagaattggcatacacattttggatgcctgctgactatggtgataatctctctttgcgttctgcgatgcttagtggtcgtggaagatgtaagtgaatgtaaagaggaatgtggagaaaactgaacaattaggtttatgacgggtgatcactgtagcactacaatgtcgcttaaaagtagttcacagcactaatttgaagggtttcttgtagagagaaatgcacattttgacgtacatttgattcaagtgcaggtaattctttgtgcctgtatcgggtataattgccagctttatatcctgagagtgggtgttccatttgattcatatgtgactagactaaggtttgatgttttgctttaaaaattagtattatggcactgatattaaggctttatttctcctttcctagggtgtcttttatgaataatcaaaagcagcaaaagccaacgctatcaggccagcgttttaaaactagaaaaagaggtaaatatttacgttttaatgtctctcttcaaacctccagaacatcttgtgtatcttgccttctctgacaggtacttgcatattactaaagcctcaaaagaagataccagaaagaaacttgaatttctcgttgactgccatttcacatacacctttaatatttctactgctttactgctcaagccttaatttttagtatcaatatatctctaagccggttagtgaatcttcttttcggtgtgaaggtaaaatatttttaaaaataaaaataagggctctgttttcactagcaggcagtctcatttaagcaaacttaaatgagcaaaaatgttaatttataaaaggagaactcctaatgtagtcacccagattttgtgaagatttgtgagagaaaactcagacttcacccatggaagttaattgtggaacaggattcacattgtaatgtcttttgaaatacagacttagtagaaaaagtattagaattatattactattttttttttgcattagtgtgtacttaggtgagtattgaattctgtagcaaagtgctgtgctagtgatataaagctaaataagacgtagtctcagatatatttttactgtttttggtcaaaagcatattaaccttgttttacaggtggttttgaggaaatgaagaactaggtcagctactggttataagttgtgtttttctttttcttccttaagtagcagacattttgagatatatattgtagaattttaaaatcactaatcataggctgtctgtccccttgtagtagtggtggggagaccaaagtgtgatttgattctaatctttgcagattcatttagatttagctggtaaattttcttaaggagctggagttgtaaactagaacagtttggcagtaaaatgggaaagtgtatctcttgaatatgtgggttactgatgttaccttgatacaaataatagcaagtagctttagcattcttattattagcatcagggagagatgtaacttccccggttccagatagagatgattcgtggcctggctgttgatggttagggtactgggtagggtatacaacactccctgtctgggactgagggagtttccagacacaagactttcagtgctaaaaccaggaaagtgctgggcactcagaggtgtttgtcaccctagtactgtgtgaacagatgtcatctagcctagattgggaaagcaaaaccctattatgaagtgtgtgaaagcaactcagtaaaggtcaggtatgtgcacaaggctgtggtctgggagctttctattttattaatgtcatttggtatttacaacaactttatgggataggtactattcttatccccattttacagtaggggaattctggcatggcgagtgagactatttgcttgaattcaggtggttaaatggtggtcaggatttgaatcaggcagtttaactccagagcccatgtactgaactactacacaatatagtctcttgattacctaatttctctgactctcagttttccttctgaataatagggggaaaaatctgcctcacaaggttgttaacaggattaaagcaaatgcttaatatagtttctgtcattgggtgctcattaaatgtactttctaaagctcaccttcataaatgccaaaggattggttcaatttttttgtttgtttaatattatggacatttaaggaaaaggatcaagagctccagtgtctggacaaaacccaaaggaataaaatgtacctgttagaggatggcctaaattttggaaaagccaagaggcagtaggagggcgttcccagtagaaattggcttatggcagtaggaacacaagacactagcacatttagatcacttgtgaaattatttgaaaagttgcacaattcttgtgagtgggccatcttgtcttacacttgcagaggggaaacatgcaaaggatgtgaatttaatctaacttatttaacaattgcatcttcataaggtgatagttttgtggcattttggtaaatcttttaaaactaaatgttttgggtcccttgtccccccagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctgggtaagtgtctgtggtttgtgggcttaataatttagaaaggtataatatatggagattatggagagtctagaatatgaactatttggcaaacttgttaaaatggagtgatttttttggttttgttgtattttggttttatccaactttagccccaggtggtacactggcagatgacatgatgcgtacagatgtctgcgtgtttgcagcccaagaagatctagagaccatgcaagcatttgctcaggtaaatgaaactttacataattgttttcagttggctactatccatgtggtatatttgaggaatattctacttttaagagttgtggttagaaagttgaaggaatttgattttaaattttagggatactgttcttggtgcaacgggatgaattagaaacttaaggtgtgttaaggcgaacaaaatagggaaaaatgaaattaactcttctgttcctatttgtcctgaaattactcaatttttaagaaaaatgtcaagctggaaaagtcagtttcgtattgtgatttctctagtttatctgcatacatttatttttaaagttaaatgagttgtgagctgattagcttgttaatcaagatctcattggaaagtttcatacgtagttatgtttgtgttactgtaagcaaagaattaaagtacatctaacctggacattcttatgtgtcactaggaattcttctcaagctggtttaagcagctcataaacttacatcgagtgaaaggtttactactttgctattctagaaatatatgaagttactgaattcatttaatgttcttcataggtttttaacaagttaatcaggcgctacaaatacctggagaaaggttttgaagatgaagtaaaaaaggtatgagtaataatgtactttgtggaaaagaaaaaaatagggttagaaagaggaatgttaaatcctaattccgccacagatttggagtaattttgcttgtttgtttgggttgttttttgagacagagcctcactctgtgtcccaggctgggggtgcagtggctcagtctcagctcactgcagcctttgcctcccgggttcaagcgattctcgtgcctcagcctcccgagtagctgggattacaggcatgtgccaccatgcccagctaattttctgtttttagtagagacagggtttcaccatgttggctaggctggccttgaactcctggcctcaagtgatctgccctcggcctcccaaagtgctggggttataggtgtgagccaacacgcctggcccaatattgcatatagatgcccagaaaacttgatatgtttatcaagcaccaggcactgttctaatgatactaattcactcaatgtttataaaaaccctgtgaggcaagttttattatccacattttacatgtgaggtgcagaggttaagtaacttgcccgagatcattcagctaatgagtattgtaacttagatgtaaacttggatggttagatcccagagcccacgtattgaacaggtagccagtataacatgctttactgcttctcttattgtaatgcagttgctgttttaacccttaattgttttactttttacagctgctgctgttcttgaagggtttttcagagtcggagaggaacaagctagctatgttgactggtgttcttctggctaatggaacacttaatgcatccattcttaatagcctttataatgaaaatttggttaaagaaggtaatcagccttaaaggatggtcttcagttgactcagagtggggtggataagagcatggtttactgttcatagatgtgacttctgtgaaagtcttcgtttattaaccagccttaaatttaataagttcagtctaattcactagacatttaatgaatacctttggcatccaggtttaatggctttctttaggcatacaacagatacccagatttagacaaaatgttgttatatgtaataaaaataaaatgagaaatgctgtgggaaccccagaagagattaataccaattgggagacttggagaagatgacgtttggggaaaatgtcaagctggaagggaaaatcagttccctgtttggctccaattgtcggattattctctacagtaatttttttgaagcttttttttttttaaaaaactgcttgcagtagtgagtatttaagttaccttactgtaattctcacaacagtcttgtcaagtgtagagactgttgccctcaatttatactttggaaaacactttaagtaacttggccaagaatatacaatttgcaagtggtagactagggagattggagaagtgataaactgtggcccaggaaagttcagggttaagtttgtgaggaaagtcagtaatcccatgtgattgaactatgaagggaaggatatagggggacacagtgattgaaaccagggaaggtacttctgttaattaagctattttcttttacaggagtttcagcagcttttgctgtgaagctctttaaatcatggataaatgaaaaagatatcaatgcagtagctgcaagtcttcggaaagtcagcatggataacagactgatggttggtaactttttttcattcttcccattcttgccaaggatgtaaatgagagaaatttctcatttttaagactgtgaaaagaaagtgtttttcttaatctgatttaaagaaagtttaaccagataaattcttcttttaggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatgtaagtttttgtttaaaccgtctttttatggctaagcttctggcatagagattttcactaatttgaggaacttacttcaccaggatgagattgagttaatagtaacaggatgttatactggaactttgcctcattcttttgcatatgcttcttcagtgcctgactgaggcccagaaatacaagagactggagctcagggcacctttcagttgtaaaggtctctttttatatgtggtacacatgtggttgccagttgcatggaaaaggagttgttagtttttgttaaaggtctaaacttgatgtgtgaagtatgtacataatcaaaactgacttctgttactaaatttggattcatttgcagataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaaggtattagaactatgccttgacaaaacaaactattctgctttcacgtggtgataagtgaactgtgactatatttttctaagaggatttatcacatcctgtggttcctagggatggcccaccagtaaataaacaaatagtaacattagctattgatgataatgctctgaattgggctgtggttcacaggttaaaaacaagaatatggcctggccaggcacaatggctcacgcctgtaaacccagcactttgggaggcaagggcaggaggattgcttgagctcagtttaagacgtgcctgggcaacatagtgagacctcatctctactaaaaatcacaaaaaatagccagtcgtggtggcgcatgcctgtagtcccaactactcaggaggctgaggcagaggatctcttgagccctggagatcaagactgcagtgagcttatgatggctttgtcagacaaagcctgggtgacagggtgagatcctgcctcaaaaaaaagaacatgatgaaaaggaacttcagcttgtaattagatgtttgcttttgaagggggtattggaaaataggaatttttccccccctctaaaatactaatattgtttgacatttacttggactacttggtatagtattgtttattttacttagctacttagattttctgcttttttttttttctcttgagacagtctcactctgtcacccaggctggagtgcagtgatgtgatctcagctcactgcagcctccatctcctgggttcaagcagttctgcctcctcggcctcccaagtagtgcctggctaatttttgtatttttagtagagacgagcttttaccatattggccaggctggtctcgaactcctgacctcaagtgatccacccgcctcggcctcccaaagtgctgggattacagacgtgagccactgtgcccagcctattttttaaatttctggtaaataagttatagtttgcagtgattataaaagatgagttaagttctatattgtctgtattgtaggagttttgtaatggatggttatttgtaatgaatgactaaatcttttctctgttcctttaaaagcaatacagccctctacttgctgcctttactactcaaggtcagtctgagctgactctgttactgaagattcaggagtattgctatgacaacattcatttcatgaaagccttccagaaaatagtggtgcttttttataaaggtaatttagattttgaattttgtaaataacacttaataaaaacccttataaacacaaaattatccaaatgatgagttatctggacatcagctccctgaaatattttacttctagttatgagtcacctctgattaaattgggtgctttttagtgcactgatacttgtttaaaacatctaaaccctattcacaagttgaagtatgaaatctaaagccatcattatgcgtcctcaaacttgcctcctatactcttaaccaggtatacattcccaaagttcagctaggtgtggtggctcatacttgtgaccccaacactttgggagcctgaggctggaggatcgcttgagcccaagagttcaagaccggcctggactgcataaggagacctcatctctacaaaaaaaataaaaaattaggcagggaatggtggcgcaagcctgtagtcccagcaactcagaaggctgaggtaggaggatcacttgagcctaggaggtcaaggctgcagtgaaccatgattgtgccactgcactccagcagcctaggcaacaagtgagaccctgtttcaaaaaaaaaaaatccccaagtcccttttccagacagtctgtagtcttagctatgtagtcatagctctggagtcttcagcctgtgtgaatcctgcttctgttcatcttactcccccacccagtgttgactttccgtagtccttcaagaccagttcagagtgcttctatagcaaccccaatttcagttatattgttcccttttctcctgatcccaattttagaaacctggtctaaagtggctagtaaagacaagacctctgttgggagaaaatccattgcagttggtcataacactttgaaattctgcactaatcagaccagtcttgatcccgttgagtgtagttggtatgcgcacatgtattattatcttccatttctcatggatgtttttagcttttcagcagtttgtttgctaagcaggcatttgcacattaggtggtggttctaacgctgagtagagtatattaaaactcccttaatgcaatgagttttctttccagctgaagtcctgagcgaggagcccattttgaagtggtataaagatgcacatgttgcaaaggggaagagtgttttccttgagcaaatgaaaaagtttgtagaatggctcaaaaatgctgaagaaggtaaggattttcctttgtgtggtttgtttggtaaagctaattttaatgtggccataatatatcttcacacatgcttccttctttctgatgccattttgtacctggagtagagatttttgttataaggcaggtggcgaaagctagagtttaattattatagtatatttatggctcagccataatagtaaatgttcttcatgaaatggaaaattttgagaatatttaatgtttataaatttgtggatttcttttctttttttttttaattaaaaatatagagacagagtctcactatgttgccgatgctggtcttgaactcctgggctcaaacaaccttcctgcctcagcctcacaaagtacagggattgcagatgtgattgcacccagccaaatgttgggatttccaagtgaatgcttttgaatatctgcctcatgtaaataggttattaataaaattcgttaacagcttcaaagttacatggaggctgggtgtggtggctcacgcctgtaatcctagcactttgggaggctgaggcgatcaggtcatttgaggccaggagtatgaggccagcctggacaacatgggaaacccagtctctactaaaaataaaaaattagccagttttggtggtgggcgcctgtagttccagctacttgggaaactgaagtgggaggatcacttgaacccgggaggcagaggttgcagtgagccaagagggtgctgctgcattccggcctgtgggacagagggagactctgtcttaaagaagcttcaaagttataaatgggaacttttgccttctgatacataatgtttgactgtttttttccccttttctagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttaggctttat

SEQ ID NO: 35665 - DNA, 38720 bp, Homo sapiens; identical to SEQ ID NO: 35585

SEQ ID NO: 35666 - DNA, 84848 bp, Homo sapiens
ggggaacagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacggtgagtgagattccgcgtcccccttggacccctgggggcaccctctccccagcccccactcctgcatacggatggggaagggagacgcgggagggggtgccttttgttatcccagtccagctgacacagcagcggcccgactgggggcggggatggggtccgatttgggggatgggggccctgggcaaatgatgcttccggggccccccagcacaaacaaagaccagaggcctgggtagagagaagagggctccccatttttctgatcctggggaggagaggccttcttttcctatctctgttcggggagggcctccgcctcccctacatcctcacaaccccccaccccccatctgaattgtgaaggaatccggatttgcaatgttcggctgcaaaagggggtgggggtggggggggtggcttttgcactggcctctgtagctcgaaaggggagccaggccaggggtaccctgccgggcagagggcaggcaggcccgggaaggctgtgggtggggagagggagggccccctgcttgggcgtggaatcgaccccagagccccggctggaggcctgggtgctgaagtaggctcttccccctctcagggcctctgtcagtagcctggggtagggctgtgttggggggcagagagggggagctcgccatactatgtgactttgaattttccttcttaattcctgggagctttgagatgaaaaaacgtcagatgtcatcactggggaaggggactggagaatggcctggaatgctggggtaggagggtgggggaggctgccttcttcctgacttctggcttcatcacagtttggattggaaggagagttggaggttggatggggattatggctgtgcccccacactcctttagtaaatctgtttattccctgcacccctccaagcccaaaaccccatacacacacactttgtatattgcagagttaggcttaggctagaactgcatccttttggggaaatggggtgcctctcttccctttttttgtcagctgtttttttctcctacttgtgagtcactggttcaagtcttgcccaagctttaagcattaagctggggtcatggggttgggctgggctaggtccctgatttgagaaggggtgggatctcatcccctcctgtcatcttagccctctcatccaaagacaaaactgggctggataccatcatacaccccctcctctgtcttgccagattgggattgggaaagtttttctctgaaaccagattatctccctccctctccctaacttgcttcaattgggggaggagacttacagggtcaggaagcagctgtgtccccaaaaaacatatttagtgtccctcagttgtgccatcttggggactctctaccccccacccccaccccaccaattagctgccccggaggaggagaggggcttttcctgaatatcctccagatgccgcacagccggcttctgcctataactcctgtcattatcatgtgtttttctcttgttctcagccctgtgaggtgagaagggaaatcgaggcagggagattggggttgcagccgcttctgggaggaatagaaaaaaaatttgagagagagagagacccatcaggagccccttgaaggagggtggctagagttaggcagaagcaagagggtttctgtggagagcagggaaggtcaggaagggaccccagatagcatcactcccagggctctaaaggagttctatttgccacaccaagttagtggaagagagagactggacatgttctccttaactatctccctaccctttcttaaaatgttcacccacgccccctctgtatctccagctcagatcaaactatccaaagccccaggagaggacccctccccaaacacacaccaatatttctgccttgggagtgggaatataaataatcagctccaccccactcttgggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctatcacagccttgctgctttctctccagggcagcaatcctaggggctttcccacctcttctgctttctcttctatgcctgaaactgcctctggggtcccctgccctttggggagtaacgtcactccccactagcgacaaaattgagtgtacctgctgctggagaggttgcagaaagatggggtggagaatgggactattgagggccctgctgagattggggaacattttctagtggggagggcacccccagacaaatacagctcacagaataaggctgacttcctccctccctttttcctgaccttcctccacacacccccttgagccggcatattaccagttactagagtaggtacagtggaagtgagttatgaagctggggtgttagcttcctggatccctgagagaaagttctaaactcctttctccctgatcagactcacatcctaaacgtctccctttgcctcgttgtcttttaaagcaagaatgtgtaagaaattcattttggggttggagggatattttgatgtttagggctgcttcactagacatctttttcttctgatcttgttctctctcctctcttcattttctcaaccacccttccaccactgagcctcccaaaggatgacagcccaggtcctggccagagtcagttcctgtccagatgcccccattcttcaaaaccccttccttaccttttgggaagcccttccttactcaagtctatctctctttcctcctgctgcagtgtgagcccttgcacatcagaacccccaagcctaggtttattcccgcccagtactctcttctcagggtcctcctcactcctcagactctttacctttcaggtcctccagctctgcgtgtgggctcattgctcttggggcatctgggtgcagctgaatggtactgcaggaaggcccctgacttggtagtgctgggtatgagcgatagagaacctgcctccctcttctgtcccagatttcagcctggttagcaggatcctgcattgtttggagaaggaagcagttggctttggagtgtttccggtgcaatggcctcaggcaccaatataaaccctccctgggaaagaggtgaggggtatatgtggagagttgtccctcttgctcccctaggggagatgaaagcctctccctctcccaccaggccttagcttccctggctgaagagctccattttcctccctcctttctaccctcctgactccaggggtggtagtggtccctattctgggtctcccttgagtcaggcactgcctagggccgagactctgtctctccaagataggacagatcttgctcccaccctactctaggctcagcggggtagtcattctctgggttcatcccaggacaactgtgtcatccccttggcaatctctggactgagcccccttcctggcttttctggctgtctgtctgtctttctgtctgtctgtcattagtgtgcgctgtcttggctttttagaacctctctgtctctcaccctctcagttcatctcttactgccgaacctttgtgacattctctgccctgctttctgcgtctctgtcacttgtcttatttttctctgcctgtctccatttacccccatccaggcctcttggtatcccaaaagcttcttgggagcaagagtctctctgggctttcccactcaccccctggctccctcccctctgttttggctatttttcccccttcctggccagacccagtgtccagttcagcaccaaaagtttcctctccactttcctccgacttcctctttcttcttccccctccactaatttggggaatgggttttggagagaatgtttctggaagaaaggaacttgataccctttgtgggctaagagggagaaaggaggtatttcagaaggaaggagggaggttagacttctggcagaacttcctcctgaccaggagcctaagaactggagaaagatgtaaggagtgagtcaagaacttggagcttttactctggtgagcataagctgtgtgtgtggctggggtggggggagaaggagaggaggcttagaaatgcctggtgagtgatatggtgacctctggaggccttctgggggtctggcttttatttgtggggaaaggaaaagctggtgggggaggtcacgggtcaggctaatgtcctgctgcatcaatattgactcagaatggaagcggagacccttcccctcccctggctgtccaagccaccctgtctgtctgtctgtccaggccgcaaagcagaggcccagactcaggaatgacaaaaatgtgtctgagcctcaggaaagagccactgggcaacacccaaaatacaaaaaattcagtgaaaacctctcggtttgggtttgggaggcccttgctgccccacccccataaggtcgaaaattcagattcctgcaggctctgtccccgcgccgcccccccaccccaccccccgcaccttgagcatcctcctcccactctgttcccttagctatatcatgtggttccctttagagaacccccctctcacctagctcagaggggagcctatctctccttctgctgtgtccactcttaaaaagggccccaagagtccctgtcatgcttttgcagtccctgagtctccttgtcctttaagaagcacctctaaggtcttagctctcttccttgctctcgctccctcaagggggtatcaaaggatgggttcccctcctctggagaagactccttcagggttggacttcgctgtcaccctctctggccaggcattctcaccccacttccccacccccaaggtcccagaatgggacacagaatgacagccaagggtcaagcagggcagtggggtctgtgttgtgtctggacgcacacccaactctacacctcctgccctggctccagcttggtggccctggggaccgtggctgggctgggtgcctgggtttgggggggtggggcagggtgttggccaagttagcatggcagtcacattcatcttcaggcaaagccgagaacagacggcccctgtgtcctggtgttcttcctccaaactcgctctctctccttcctctctagatctctccttcttcttctcctgcctgtcttccccttcttctgtcccattcttgctcctctctgtctcccctatgcccttccctcctctctgaggagccctgaaggccaccccttaaaatcctctccccactgccagggccagagaacgacagcgttctccctgcaatttcccttccttgttttttgtttttgttttgttttgtttttgagacacagtctcactccatcacccagactgaaatgcaatggcgtgatctctgctcactgcgacctccgcctcctgctaatttttgtatttttagtagagacagggtttcaccatgttgcccaggctggtctcaaactcttgacctcaagtgatccgcccatctccgcctccacctcccaaagtgctggtactacagacgggagccactgcgcccatctggtttcctttctttctttcttttttttttcttttgagatggaatctcgctctgttgcccaggctggagtgcagtggcgcgatctcagttcactgcaagctccgcctcccctggttcacgccattctcctgcctcagcctcctgagtagctgggactacaggcgcctgccaccacgcccagctaatttttcatatttttagtagagacggggtttcaccgcgttagccaggatggtctcgatctcctgacatcatgatctgcctgcttcggcctcccaaagtactgggattacaggcatgagccaccatgcccggcctggtttcctttcttaacccggctgcatcccatgacctatgaggaaaccacctgctcagttaccagtcaccctgtgcctcagctcccccatgtgtgagaggggggccgcaagggcacccacctcacagggttatagtatctaagtgagttaatagtcaccgtatttccaatcagtggctggtggttagcaaggtgaaaaaggttagctcccatcggtcagggagacctccgggttctctcatgcgggccaggaggcggggaaggccttagttgcttttgaccttagggcaatgttgttctctcatctaaactgcaggccacaaaggtgggttttctgggtgctggattcagacacagaaggctctgctgaggggagtggggttggctttccctctaagcagattataagggtcctaccccgctcccaactcagctctctcccagctctgagtgaggcttcccttggctgtgtagactgtcccaaagtagtttatttgtttctttcttccctctccccctgaaggaaatcaaagacaggcctcagccttctcgctccagattcctgggcccttcaacaccagccctgacaggaagttctttcacgtatctctctgcaatccttgtgctggccaggccctcgggagatgtggccccctcccccggtgctgctgtgggataggggcctgggccctcctcttcctttcacttgtcccatcccccatcccctccctgcaagagcacatctggtttgtgaatctctctcattccagcttttggagtttgccagctgctgtttcctctgtggagttcaggccaaaaatgggggtgggggacagcgggggggactcagtgagggctaaaggagggggcaccatggctgggatgtggaatggaggggaggttaggtgaccacccggtgacctcaggccgtggctgtgcgctctgcccctgggaggagcagggcatggaccaagtcccaggtgggtggcacgggggtctgtttctgggctccaaacatctcatctgcctctgagtcccattccagcccccctcttccccctcagccggccacggctggtcaggggaagcggacggttctccggcatgctaactaggctggcgggctgtgtttcccgggaagacctcacagctggcccagtggggcaatgaactcagcattatccacctcctcaaggggcctttattccaggctcagggtgggggccaggggagggaggctgaagggggagcctggctaggccatccttgatgtgtttcctgaactcggtcattttggccaggggcctgagtgccgtctcccctgccagcggtgggggttaggagggaagacatctcagtgaggctcccatcagactccctccctcctaagagccccccccccccgccattttccttatacttctgtctctgccctgcatttgcattagttgggtacagctgtcttctcaggcgactctggctcctgcagggcagagggtcatctcaccctccttggcaccctgatgcctagtgcagtgcctggcatagagctggccttcagtgtgtgccagcagaatagaaatgtgatggcacagtctgaggaaaagccacgaaaggccaggagactgggagctcagccttgggtgggggagaaggggtgggtgactgttcctcctgtggaggatgtggtgatagaggttgggaggagtgggaattcggaggactggtgtggatttcactggttcagagcttggagtcagcttagctggttttgtcacttgccagctatttgaccctggccaagtcacctggctcaatttcttcatctgtgaaatggtggtattagttgtccctatttgtcatactgtggagggaattaaatatgatgatacatggaaaaaactgctttaccacagttcctggcacatactgagcccacaataagagttagttgtcagccgggtgcggtggctcacgcctgtaatcccagcactttgggaggctgagatggatgtatcagatgaggttgggagttcgagaccagcctgaccaacatggagaaaccccgtctctactaaaaatacaaaattagccatgcgtggtggcgcatgcctgtaatcccagctactctggaggctgaggcagaagaatcacttgaacccgggaggcaggggttgcagtgagccaagatcgtgccattgcactccagcctgggcaacaagagcaaaactctgtctcaaaaaaaaaaaaaaaacaacagagttagttgtcaccattcttaattcctccttgggggatgagggaagagaatggggtaggagtggaagaagcctgattggggtgggagggtagggccaagaggtcctgaatatagtagctaactagttggactggactgaaaccagttcctagagttcatttcagccatccccctgcctctgctccccaattctgatatcttgaaaatctttaggtgcttcttaactctaaggatgtctactgaaagtctccctgaggtctaaccaagggaggctgtgtctttagagaatggagaggacaaggcaggtggatcacctgaggtcaggagtttgagaccagcatggccaacatggtgaaaccccgtctctactaaaaatacaaaaactagctggacatggtgatgcatgtctgtagttccagccactggggaggccgaggcaggagaatcgcctgggcccaggaggtggaggttgcggtgagctgagattgtgccactgcactccagcctgggggacagagtgagaccttgtctcaaaaaaaaaaaaaatagggaatggaaatggaagcaaggctctctaccctgcccattcctgcccagccttgccctcctgtgcctctgctaataccatctccaactactactgtgtgtgccaagggcatccctccccactgctcccatctgggggcctagtgattaggggttgggaaggatggggtgatgggtcaggggaccaggagtgtcccagaaggcagggaagcagagaggttagataagaccagctcggggcctctagtagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggagaaaggtccccgcccagcttttgccctgccaagggaagtggagaacttgttggtgggaccccagagtcctgggtagctggcacagtcctggtggctccacttttagcctctcccctgcttggttaatctgggccagggtcaaagcgcccctgcattcctaggtccgtctctgttctctctcttgggctttatcctgctccagtcccatctggtgtcctgtccccacacccccacccgtaattatcaggggtaattttagggctggaaagggagccactagtgggctctgcctcacccctacactctgccctggagggtgggggccaggggtattcagcaagtatatctacggcatggtgcttcagcctggagtctcttcttgtctggtgccacctgcacccccacacttttgaccctgatgcttgggcgttagaagtaaagaaagccatgcagaagggtcagatctgcctctttttgttcattcttccttcaatttgctgtaaacctcaccttatatgcattaccactctgttcacactcataccccccggactcataacatcacacacagacccacctggcactgatgagcccacctcccacccaaaggcacaaacacattctcacagtaacacagagtcacactcaaatgtggatgcagaaacacactctatactcagagagatgtccccagacacacataccaacatagagacacacacacacaaacccagattgattcacatggaaactcactgaggccagatacaccagcatacagaaagacacacagatacactctcactacctaccgctgcatgctatacagccacaccatcagttgtgtaagcagactcccatccaggcacacatgggtcatagacactgtcactcacacaccgtgtccaggcttgggggccaatagacagtggtctctctatctcatccatcctcttgagcaacaaaggaagttgcagagatgatatgaccagttggccacaacctttttttttttctttttttgaaaggtgggatctcactatgttgccttggctgatctcaaactcctgacctcaagtgatcctcctgacacagcttcccagagttctgggactataggcgtgagccaccatgcctggccagaccacaacctttgattcttcccaaatccttctatcaggcttgttgctgtggggttggaagtctagaatagtgctgtccaatagaaatgtattgcaagccacatgtgctattttgaaattttcgagtagccacttaaaaaaggtaaaaatgaacagatgaaatgaatttgaatattttatccaatggatccaaaatattatcactttagtacagtgtattcatataaaacctttagagatcttttgcatttttctgacattaagtcatcaaaatccagtgtacattttatacttacagtttgaacttgccgcctttcaagtgcttgatagccacatgtgactgggctacgtattgggcagtgaaggtctagaagatttggcaccactcttggccctgggttctgcaacctgggagctatgggaaggagtttttctttatcattggagtttctctgccatggaccctgcttccctcagctcatcaaaacctttttttttgtttgtttgttttgagacagatctcgctctgtcgcccacgctggagtgcagtggtgcaatctcagctcactgcaacttctgcctcctgggttcaagcgattctcctgcctcagcctcccgagtagctgggactacaggtgcatgccaccatgcctggctaattttttgcatttttagtagagacggggtttcaccatgttggccaggctcatcttgaactcctgacctcaagtgatctgcccgcctcagcctcccaaagtgctaggattataggtgtgagccatcactcccggcatcatcaaaaccttttactgacctcagtcgtcatcaaaaaccaggctgtcttcagcctgtctcctgagcatagaatgttgaggcactggggtccatgggaatggggcatttggagggtggactctactgaaggcctagtttctacctccacctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggacggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagtttttcttctgtaagatgagagatcagtgttttcatacttttttaaaaatagtatgatcctttcttcaaaaggttttctgcatgaaacctgagtgtgaacacagggaggagcagaggtgctgtgactaaagcttagccatctagtttagtccacctgccgcccctacgggtgccctagaaggcatcccccaggagctgcagatctttgaggggccctaaatctgccttggtccctccctctctgacagtctagactgtctgaggtggttgataggaaagccatccaggccgaggtgggaacattaggatgacaagtcagactgcttccagcctgtggctcaggtcaccagctctacagtctttcccccaaagggccctgtgggccatggagagtccggtcacagcgtgagcatttaagagtcgtgtccggggaggcagagcctcaagcctgcgtgttagggaatagtggcttctcccttctcttttcttcggggtctgggcccggagcaagaggccagctttgagaggccatgagcgtagccctaggggaggggctgtgcttgggtgtgggggcagtgtcctgtgctgtgtgcctgagaaaacatctgtctgtgggaggagactcatctggatcctgttcactaggagcagggaggatggagcaaaggagtttgtggaagatttttctccctttctttggttgattttgcatgttttcatctgaagctcctgggacgggatgcagaatgcgggcctgggggctgacttaaatgaccacgcgcaccccttcctctcgtgtggtgtgtgttcaagcttacttccttttgagtacctttacagtctctaaaacaacagagaacttcaaaaacctcaggtctgaatttccttctctgatattacagaaatcggcctcctcattccctcaccctatatccagaaaagttactcttttctaggttttccagagcaaatgatattttccccctctgtggagaaaggctgggcaggcagcatgaatggctctcgggtggaagtggggaggagaaagaatcgctggggcctggccccccatcccaactcttcctggcaggcttagtgcctctaaacgtcttagcatcttgggcggctctctctcctaggtgggggtggagtgggaagccagggtgtgaggccgctggacaaaggggtctttgtggccaggctgcctggccccacgcaaggccattaactgggtcgctggtctgggggggcaactgctctcccacctctcccccctcctgtctcattcccttctgtctcccctgtggaagtgggtcagtggcaggagaaagattagaaaagaatccagaggggaccagttttgctcctccttcctgtcctctacctgggccttaggccttctctctgaggcctctagggctccggggatgggttagacaggtgcttccaggccagagctgggatcctgtggggacagacacgattccatgcccacttttcagccccagctgaagccaacattgtaatccccaggcagtgtagatgagaggcatatcaaagggataagactcaccatcccctcttcctgttgaccccaacaaagtgccagaacccctctccatggggacagaggtagcccagaacatccagaacagagacatgtgggttctaagccatcactggctgtgtgaccttgggcttgtcttatagcctctctgggcttcagtttcttcacttgtgaaatatggtagatgcttcctaaggcccttctgtctctgacactgcagcccttagaagtggtttctgaaggttgactgggtttaggggaaggttgtggcctgcgtggagctgccagatctggcggcctgaatatgtgtctctcctgcccccacacagagctccaaggcaactgctctcgcctgggctgccagcaccattgtgtccccacactcgatgggcccacctgctactgcaacagcagctttcagcttcaggcagatggcaagacctgcaaaggtatgtgagtgcatgtgcctgtgtgcatgtgtgtgtgccagtagccagttgaggtgggcagggaggggcagagaggggtagggggcctggctggaataagaaactagaaggaaggtgcaagagagggggtgccaccaccccagggcatgactgtgagccctaaccatttgcttccactagacttctaaaaattcaccttaaaattatagtttatatgtaaatttttctgttgtaaaaaattagagcattaacagataaaaccaaagtcccctttgacaaatccccctcaattccggtccccttcccatctccctggagttcaactctattatcagtttgctctctctctttcaggcccttttttgtgcatttgtctctgggtattcacagaaaatctaattggaagtactgctcaagagtactgcgtgctcttttttacataaacaatagtatactgtgtatattattttcaatgtttttcactcatcagtatgttccacaatttttttttctgtgttaatatgtaaagatctacatcattcttttagaaaccactatgacgtatgacttttaccacagtttacttggtcacctccctgttgatgagtgagatgttcccaatttttcactgctacaagcaatgcaaacttttctgttttaaatttgcctccctcgggtctttgtgcaaatgccaccttctcagtgaagccgtcccccgacccctctaaaactgcatccctgccatctgcattctctatccctgttctcttttcattgcactagcacctctaatgtatactttatttactttgtttcatatgttattatagtaactatatttcatttattatctgaatataagtttcatgaggacagcaatgtgggtctattttaaagttcactgatgcacccctggcacctgacccatagtagggactcaataaatcttccctgcgtggatgagtgatatgtacacgagtgtttctctagagtggattccaagactggacttgctgggtgttaaggtttgcacatttcatgctgtaatagattctgccgaactgtccttcaaggtagctgtaaggatggacatgttgatcatgtctgatgatcacccacttcgttgcccttgtcacactggaaatgaccacattcttgccctttcctcggcagattttgatgagtgctcagtgtacggcacctgcagccagctatgcaccaacacagacggctccttcatatgtggctgtgttgaaggatacctcctgcagccggataaccgctcctgcaaggccaagaacggtgggtggggttgcctctggccacagtgctaactaagccccctcaatgctgttccctggtgggtggtggcctgagaggtggtcctagagccctggctgcacggactcttctcttccccattcccagagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgtgagtcacctgctctcagcttggagggctggggagggtaggggagacagggaaggtggaccctatcttgaacagaggccgggagttacacaggatggtcctgtctggggcaggagaagcaggaggctggatacaatggtgtgtgtttgaggcaggggcagagccaccggcacgctccctcccagctctctgagcaagtgtctggatggcccctgcatttctggccaagggctgagggggcagtgaatggtcaatctccagagaccagggactgtcccttctctgagaggggagtgttgactagactgcagagggactttccggtgcagtgggagccaaggctagggaaagaaggagcggaagcctgaggtgccctgttaggctgcagctgagggtaaaggagctggggcccagctgctctgtctccatgggccatcgtttccctcggggaccattgccaatggactctctgctgccatcgggggagggcagtactgaggttatttctctgtggctttgtggcagtgaatgaggctgggagaggagcgtgagccacatgagattttagaatatcctggatgcttccattcaggcttctccctaggctacacttttgctatcctagttgtggaagaaggggtgtcacagaaaggggcacgagcatagctgggtgtagacccactgccgggaacagccctgcccatctcagaggctgttacaccagcaaccttaaaagtcaacatctggcagcatcacatttccaaagaaatgcaccacagggctgagaggaagaatctggcctgtggttgatctgaccccctaagggagattaacttgatctgtaactgtttagtaaaccagaattcccatctctgccttggtttcctaatctgcataatgggtttgagcttgtctgtctagatcagattaactggagtgaaagccagtggtaaaggacagcacactttgaagttgaggattgtgaaccttgggcctctctagaagatcttcaagtttctttatttggttcttgtgatgaaaagaaagatcccaggaggttacaagggattcattctgggagagagaaaggcccctccccgggatggtggcgagcaggggttcctctgagagccctcactctccgtggcctcagcgtaaggttcacatttctgcctttggctcctccagagcatccctgatagcgtccttgggctgctgctgtccacagctcacctgtgatcagacatgtgtcctccttggggtgctgagctgggggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttctgggtaggtggctatggggtgtcctggaggtaaccttctcaacttctactctggcctcatctccttatctgacttcctccccaggagaagctggtacccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttctgggtcatccccctccccaggagatgctgactggcctgccctggtgtgtagggtggctggtcccaggcactcacctgcacagtggctgctggcctgtaattagctccccaaggaggacgaagaagaaaggctgcagctttcccctgctttcactctgccctccagggcagccctccctgcaagccttccattctgtgctgtgactgtgacctctgttggacccctggggctgagcctcatgcagcaggggtgcacacagagggaggagtctgacaattgaggggtgttcgagccagcgaggccagcccgctggtgcaggcagaagggggagcctgccccagagaaaactctggaagcagaaatagaatagaaagaaggaaggaggccaggaaatgagcctggttcacatgtgtcctgggccatgtgagtcagacctgttgtggagtcctgagagcccccgagggcccccctgaggccctgcagtgtgtgaacattcctcttcaatgccccagggctgctgaccctcctgcctcaggcccagtgttatccccctggattgggtgggtcatctcttttcctcccacctgagattacctccccctcccctctgccgctggcccagtggtttggggaggtctatgaggctcgaattccaagaccagagaactccatggtgagagccggaagagaaggcaagacccttggccagtaccaagagcagccctggctttcactactgctttctcaaaggggctatgcattgatttgattttagatggtacctggacaagctttttttttttttttttaactgttatagttacgtttttatttgatatgcattaggaaactcctgtaactagcacatcaaatctgttacttcagcaattgtttagcatgcagcgaaataagaaaagtaagttaattgaaataactggtaataaacagtagcgcaagctgtacataagcatggtagacattttgaaagtgatacacaaaagactaaagttctgaaaattgaggcccagagggatcaacaggcctgatagtcccttagtcaggaaccaggcctgcgcactctcacccccacctctgaccagtctctcagctccagaggcctatggagcctgtaacccagctttgtccagcctcctgccaggctgcccctgggcaggcctggtggtgcagtctaccgaccccagcccagccctgcatttcctaagctgagctcctctgatctgtattcccttcaccttggaggatgccaccactgtagaaagaatgaggcagactgcaagattggggtcctgggaacatgggtgtgtatggtgaggggaggttctgaggttgtaaatagaggccttgaaggaaatcgggtttgctgaagtcactcaggagtttggactgtgtgtgaaaggatggtctgaaggggctctcagaggtctcagggttcccctccctgcaccatgctgcatggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtggctctagccaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaatacatgtgtgtcagacgcctgagacaaagacaaaaggcagcgctctccttacagtatttgcagtcaggtgaagaggccatgatcaaagaagctccagaggcctatggagcctgtaacaggaaaacttccttcttttttttttttttttttttgagatggagtctcactctgtcgcccaggctggagtgcagtgatgcaatcttggctcactgcaagctctgcctcccgggttcacgccattcttctgcctcaggctcccgagtagctaggactacaggtgcccgccaccacgcctggctaattttttgtgtttttagtagagacagagttttaccatgttagccaggatggtctcgatctcctggcctcatgatccacctgcttcagcctcccagagtgctgggattacaggcgtgagccactgagcctggccttgaaaacttccttctaatagggcaagcttccttctgggagcctgagccgagtcttgacgagtagtaggtgttagccccaaatggcccacctggagggcccacctagagtcaggaggccacagggctctggctggaggcacagagggcgacttggtggaaaaggtgggaaaggatgggttcagggaggggaggacatggtgggaaccgcagcccccatgtggggagtgtttatcatgcaccaggcctcatgctaagtgcagttagtgtaccatccagttttacaaatgaggaaacagagactcagaggcattaagtaacttgctcatagcctcagttggaaggtgacagaaccagaattcaaactcaggctgtcagtgtctagggcccagttggacccagggcagagcagaatgatatgaggagaggtggggaggttcctggaacaagggccagaatctagtgtgctccctggggatgtggatagaggtccagggacctctttggatgtgtatacactcttgggtgtgtagatgtgttgggtgacattttctcaggacataaaggcttcttccttccttccgatttccttattttagagcaggtgactagaatcctgcagctgaagctagagtctttttgggcatggggtgggtcccatgtgtttgggaaagcagccaccatgtatggaaatgcctcttgaacaatgggaatgatggagaagttgagaaaagctggagttgtagtgagtgcagatgctgagcagtgggatggggtgccaggacaccaggtctattctggggcctggaactgaaagtcctctgtgccataatgggcagctgtggtctctcgtctgactcctgcacctcttccctgcttcctagcctccctcttcatgctggaatcccctgcccctctgcccctagaccacccccaactccttccacaacacagcctccctctctcccctttggtttatttgagattctcctgtcctcaggattttcggcctttggccagagcctcttcagaaggtgcgctcaggtggttggcccttagaaggctgggcgacaaggggacggctcccctcagggttggtggagccagaatgctcaggatctctgggctgaagcccaggactccacctggaccccaattcataagacagagaggggtggcccagatactgcctatagggcagccctggaggcaaggttcctcctctccctttgagcccatctctctacactggccttggagtggtggccaagtgtatgtgtgtgtgtgtgattgtgcgtgcatttgtgtgtgcatacgtgcgtatgtgcgtgtgtgtgtggtggggcaggcagaggaatctgaactttaggagagagaaaaataatgtggtgcagggggttggataacaaaggatttttgcttgcaactaatagtctccagctgcaaaaataccaaaggggaggccaggcaggccgaggactccagttcttgccaactcctcaccggcctgctgagtggggccctgcctggcctttggggaggtggaagggagaccggccaagggtaaatatctgagagcagggatgatctctctgccttccttcccggaattgggagggaatccaggccacatcctgaggctgggggggctgattgtggagctgcacctgggatagcggcatcagatctctgcaggtttcttccttctctctcttgccaagagaagggtggatagggggagcaggggcagggtattgccagccctagggctgggcagtgactcagggaagcctcaggaagtcggagagaaggccggccgtagctgcgccagctggtgctgggaaaacagctttcactgatgaagttcatacacatgccagcagcccccagacccctgccgtgcccaccaagtaaagggcacgcagccctgtttgacttccagccaccctgctggctgccaggggatgcaggcaggtccctgctttgagacttcgatttcctttggaggcagcccagcagcattcatttgaatctgttttctctgtggttacagcgtgtggggcaaagaatttggttgccttacccctgcactaggccctcttcctacagggccttggcctcctcaagctactcttccccctctctccaatcttgtgaggatgggacagtactgggggcccagaggaaagagtggctgggcttggggatgcatgaatacttacgggggtaatacctcgtctctgtggccttgttctccaggcattgggatgggatttagcagagaggacctgaagaagaaactagtttgatgaagccctcagttggctccttcccttcctgtcctgtgactctgagtcagtgtcagggcccagccaagttccttgagagcggcgttcctgttctttttgcccccaccccaccctcacccactgttagggagcagcccctgaatccctgtggggaggagggggaattagggaggggtcaagcagaacagcaagtcattatacctgtagctgtgtgggggcagaagaatccctactgggttgagtatgggtaatggaggatgagtttcagcccaaagcaggtagcccaaagatttctttacttgttggggaaactgttggagatggagttccaggcaggggtcccagaaagtcactgccttaggagtttcccagtttgcaagaggcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgagccatgcctcagtttgccctgaggattctttcatggccctcctcctagactctctctcctccagccctatgacttattccccacctcttctgaccctccccaggacatgaggacattgagcaataaggacattgcaggaacaggggactggggctgagtagaggaagtttggcccatgtcactggtgcccaaccttttgcccccatggatcttccctttggcatctctgtagagttcatattttgaaatacttttctcccaaactgggtttattagcgtgtaccctgcttttccactttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagttaaaaaaaaaaaaaaactggactgagctagtggacctgtgctctctaccttttggtgccccaagaagatggtcccttttcaaggatgggctagaattgggaagtctgtcagtcaaccagccagccagcatttacgcaagccctcctgtatatccactctgagctaagcatgggggtgttgggtgggagggcgtccagagaaggtgggcttccaggtgtgggttctcaccagcaaagggtgggcatctctgcaagagggcctaccccaccccatggctctttcattcgtactctccagacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggtgagagtggcaggcggggttctggccctggaaggtgggaggctgaggctacagtggtaaggagggtgcccaatgtccagaccccatttaacatgcatcttcccacaggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggtaagcaaaaatcttcagaataggttagtccagccagaggagacaggagtaaagcattgagttaaaaaatggtggggccaggcacggtagcccacacctgtaatcccagcactttgggaggctgaggcaggagaagtgcttgagcctcggaggtcgagaccagcctgagcaacatagggaaaccccatctctacacaaaatttgttttaattagccaggtgtggtggtatgttcctgtagtcccaactactcaggaggctgaagcaggagggccgcttaagcccaggaggtggagactgcagtgagccgtgatcgtgccattgcacttcagcctgggtgacagagtgaggtcccgtctcaaaataaataaataaaaattaaaaactacaggatgaattggggaatgcaggtcatgaagtctggaggaagctgaggggatctccaggacagagggaggaacccctgtcatctcatgctgtccattcttgcctgcccgtctcagattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgaggtgagcagggctccatggcccctccaaagctggctttaccccatgatggctctgggaccttgggatcacagcccctctctgggccctcctgtggggaccctggcttctttcatgtcatgaccgattctcctagccagccactcgggctacctgccctggcccctcagcttcccctgccagcccccatccacccactcagcctccagatcccactctgtccctcccattccccttgccagtctggagcagtagcacctggccatgggcaaccctggaactctcttccctgactactgaagcccccactccaagagtttgaaggctgggttgttggggggcagagggtttccacccctgtggcttccaaatcctaaaatgggatagcaagcacaaagaccacagcagcagggggtgtggtcagattcaggaagccttctcaaggcctggcacaggggctctgaggggtcctaacagctcttcaccctgcccccagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagagtgagtgacagggaagggggtgtgtgcccattgggaggctgcgggagggttcctcaggtgtcccccacagcccggctgcctctgtctgacatgcagggagatgaaggaagtgtcccagagtgtacctgctagtgagggcagagatgggacttgaatccatattcgaaaaaagtgcttttctcactcacccaccggactctgcagaaaactaaactgattcattcagcaagtgtctagtgagcagtgagcactcactacatgtttggcactgttctggtcatcaggattaagcagcgaacgagatagatgttgtccctggcctcatggagcttatagtctagttggggaaacaaataaatgtaactttaggtggtaataagtggttatgaagaaaataaaacagagaatagtcaggcgtggtggcttatgcctgtaatctcagcactttgggaggccgaggcaggcagatcacttgaggtgaggcgttccacaccaggctggccaacatggtgaaaccccgtctctactgaaaatacaaaaattagctgggtgtgatggtgcgtgcctataatcccagctattggggaggctgagacaggagaatcacttgaacctgggaggtggaggttgcagtgagctgagatggcgctaccacactccagcctggatgacagagcgagacttcatctcaaaaaattaaaaataaatgaataaataaagcagagaatagagttaatgaggagagcaagggcctctctgaggatgtggtgtttgagccaagctctctgtgaaatgaagagggcaaccatgtaactccctgagggaggagcatgtccggcagaggaaatcaacagtgcaaaggccctgaggccagtgtgagtgtggcaagccagaggaacagcacgaaggccagcggggctgagtggtgtgagggcagagaaggaggcaggggttggattttattatatctgggataggaagctcatagtgacttttgagaatggaagtgacatgattggattcacatttgtataaaagtcacgctgctactgggtgggggatgggcagtagggaagtagccagaagactttcagtgtagtgggcaagaagtgatgtggtttacactaggatggcagcagaggaagtggtaaacagtgatgtgactccaacatattttgaaggtactccttttataccactgatttcatgactgatcagtgggcacttagctgaaaacctgctattcttccctcatttcctacccttggagtgcagaggtcagaccccagggtattgcggccaggacccatcgtcctgtatgttagcgtgtgcgtggtctgtccatctgacccagagcctcgcatccctaacgtctcctgacccatcacagctagggcattgcagccccttggccgcagcccctgggtggggatgatggtcatgtgtgtgtctgactgtaccctggcttgtgcctgctctagagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggtatgggctcctagggatgtggcccatggggatggaagggggctggggcccaggcatctgtttctcggtgccctctcagcaggatggtcccctgctgactggctggctgcactggttggcatggagatgaggggatagacagattgacccctgtgtgacccccttcttggctgagccaaagaggcagggttaggatgggttaggcagcatgggccgtccttgccagcccttgggaaaactcagggtctgtctgcattggcttagagccctggagctgcacacagcacacagccaggggacaactgaggtcttgaattggagacaggcctgccagatcaaaacagggcacacccacatgtatgtgcgcacacagggtctgtgcagctgaccttgcagtcgccaaaaactgcatgctaatgtgtcctgagaaaattgtgttttgtgagttgcatccaggtcttccctctgagctgcttgggcaggttcacagtgcattgtctttttaatgtctatgtgaaggattctgagctgtacgagttctgccccaaatctgcacttgggcctcaggatcaggccgcctccccatcaatctggtggatgccagttataacctttgccctgcaccccatccacactgtagttcagagaaaatcaacagtcagcaatcatatcacaagactttggggaaatcaaaagtaactcatcaggaaaagattaggggtccctataccaagggaactgctatttaaaggacacttggagtgaaggctttggctaagtgaaaaatcacttcctaatttattcattttgttagttcaggatttttaggcctaggatatgatgtcacacttgtgcccagagccacatgcccgttgtttcagctctccatgcaggcacgggccagatgccctcacacgagagcccacatcagccatgtagtttaccatctgccacgtgtggttttgagaggctagccctgatacaaatggcagcacacagggctttcccctattccttttccagcctcctgtccctacccccacccatctgtctagggccccagagggtccctgcacccctctgtagcccagactgctcaaaggtacctgagtccgggagggccagaggcaggcagctttgaacttcctttgaagctgttcatcactggtccctcttcccccaacaggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtgagtcctcccaggccttggggtgggaggagctgggagtgtgtgggcctcagataactggaggatgaaatggacagggaagcaggggaaggcaggtgaggcgggatactttagcaggaatgagagtctgcaaggggagaaggagtccctgtcttcagggaaatgggagtgattccttaaacatagaagaaatctgatcctgtcactcccagttcagggccttccaccagctccccttaccctgagaatgaggcccacgttcttgtcaggcctgcacagccccacagtgtctgcctggcccttgtctgacctcatctgcatcccgcttcccacacttgaagttctgtccccactgcctgctgtctgtttctcaaacaagcaccccggctcctcctgcctcagggcttttgctcttggagttcctcagcctggaactcccagatatttgccggactggcttcttctctacatcaagtctcactcatgccacctcctcatggtggccttctccatcactcccctgacacccccacctgcagcccggtcactctccaccccatcaccctgctttatttccctcctggcctttatcgctctccatgtaaccttgattgacctgtttcttgtgggatgggagctccgtgggagcagggaccttggctgccttggtctccactgcatccatgaatgccaaaactgtgcccaacttacaggcactcaacaaatatttgttgaatggagtgaatgaatgaaatgtgtggtccagtgatgagcaggacaggagacccctgtgaggagctctgggacagcactcatggattgggatcacaggggaggctgttgatggcgggggtgcccaggtgatgctgaccagtcgctgcccacaggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaaggtgggcaggcatgtgcctgtgtgggggaatctgtgtgtgttgctagaccatgcttgggcgtggatgaggttctgtgtgagtatgtgggtatctgtgtgtgtccaggcctgtgtgcctctatagatgtgtgcatctatttttctgtgcatctatagatgtgtacatctgtgagcttgcatgtcttatgtattgtgttgtttgtttgaggattgcctccatttgcgtctctttgtgtctattcgtgttgtctgtgaagttgactgtccatgtgccagtctctgcatacacaccatgtgcgcctcctcatgtgtgtgcatagatacacggcatgccttggtgtgtgtctgcactctctgcaagtgtgagggcctagggacggcatatctctacacttggtcatttgggttgtcatgtgcttcacgagtcatgtacgtgttctagtatataaggcccttcatgatatggcccctgaccccctctctggtctcttttctccccacttccttcatcccaacactctttgaacaagcagcactagacagcttgctcctcccagcacacgtcacagagcatctgccctctgtgccattactcatgcagttcattccacatggaatgttcaccccagctcctcttcccctggcagactgctcaggggctacctcccctaggatgtcatctccagacccctcttcacactggatcacccgtatgtgccctatctgagacagtgggaagctcaagggcagagatcgtgtcgttttcacctcttactacctactacagctcagcccctaacagatcctggtaaatgttgaagaaatgaatggatgaatactgcccgtctgctcattagtgtgtgtgtgtgcgcgcacgcatatgagtgtgtgtgtgtgtgtgtgcacgtatgtgtgcgtgtgtgtgtttggggactatgaatgaataggaatgagcccaggagaggaccatatggacaacctcaccatcagcatccttgctggatcactcgatcacccgctggcttcaggatctaccatcccactgtgtgcaaaactatcactctctggggctcccaggctaatgggggaaacaaagcaaaacccatgcccaggacatagacaaatgaatgtacaaaacagtgatctcacaggcctccctcaattttcttccaactccttagtaacatcctctccatccctagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaaggtacctccttggggctgggggcagcgtgggacctggaaggggtggtgggacttaggcattgatttgagacttccctgggagtgaaggcacttcccagggatcctaggctctgacttttgaggatcctgagaagagaactcccccaacacaatctgattctctgttccccatttcccttcctgccccatgtctgtgtctcctgttcttcaacatgatcttcttcctctccatatttcctctttctgtccccacatcttaatgtgtctcctcccctatcccttctctgacctctcctcacctcttcctccctttgcctttccccatggcccttccccacagttggcaccaacaaatgccgggtgaacaatggcggctgcagcagcctgtgcttggccacccctgggagccgccagtgcgcctgtgctgaggaccaggtgttggacgcagacggcgtcacttgcttgggtatgaggtgcctggctgggtgggagtgggaagcagaccccatcaggaggatgccgaagagtggggaggggaggatccagggtcccagtcagagattaaggaggcaatgaggggcccttagggggccaacaggaagcaagggagggggagagcaaaggctctgggggctaggagggagtttagggaagatgggaggctgggagggacttgtgaggggatggcaattaggggaaactgagtgaagaatggacagctatggatggaaggaggaaattatccttcacttcttttaaatgtatttctccattactaaagtaaaataataaatagttccaaatattggaaattactttgggaggccaaggcaggctgatcacttgaggtcaagagtttaagaccagcctggtcaacaaggcaaaaccccatctctactaaaaatacaaaaattagccaagcgtggtggcaggtgcctgtaatcctagctactcgggaggctgaggcaggagaatcacttgaagcccggaggcaaaggttgcagtgggccgaaatcatgccactgcactccagcctaggcgacagatggagactctgtctcaaaaaaaaaaaaaattaacattaaaaaatacatataatatatatgttggaaattagagaggagaaaaaagcccaaatcccaccagtgagcaccatatattgttagcattgtggtaaagtgaacaccattcttttttcctcaggggggttataattgttttttacatagctgtaatcatctgtttataaaatgtcttctgcccttttcggttcaagtgtcacagcattttctgtgttgttattgcatgattttaacaagccttgttttttattcaaaatgggttgtgttcattgtaaaacggagtaagtaaggccgggcacagtggctcacacctgtaatcccagcactttgggagcccaaggcgggtgaatcacttgaggtcaggagttcgagaccagcctggccaacatggtgaaaccccgtttctactaaaaacacaaaaattagccaggcatggtgtcacacgcctgtagtcccagctatttgggaggctgaggcaggagaatcgcttgaacctgggaagcggaggttgcagtgagccgagattgtgccactgcactccagcctggcgacagagcaagacatcatctcaaaaagcaaaacaaaacaatgaaataagtaaacagtatagaaaaacacaaaggagaaagcccaaatcatcccagattccaccacctgtagataaccactgttaccatttgggggaaccacctcccaaatgtttccctatgatttactttcacataaatggagtcgtgctgcacatactgttctgtttcctgcttttgtcacttgacagtatgtaacgagtacataagcagcatttttaatggctaaaatatatttcatttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaaccaggagtgattttggagaaagtgctggtgagccaggagctaaaaacccttacagatgacagggtgcagcctgggagccttccagaagtagaggttggtacagaagcatgatgtaaggggaagaacagtccagggaacagcagtgaggagcaaggaggacacataccagcctccaggtccatggtccatgggatacgggaggggaaatcgccacccatggggccatgggaagtttcagagattagagaggggtgggagatgagtcagaccaggcaagcgcccagctgtgaggtctggagaccgggctcacacaggagcctgcacttgtggaggttaccaaggcacagacaaaggacgtcgtgatttagctgctaatgggccaagacagatagtgatggtgaggcatacgttctggggacaggatgggtggagcctgcgcggatgtggtgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaattttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttggatggcaggcctgcagggcagctcggctctggcagtgcctatactggagcgggcaggaagctgggggcacccaacttctcgctgacccctgactcattccctccccagatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaactgccgggcgtggtggcgtgcacctctagtcccagctacttgagaggctgaggtgggaggatcacttgagcctgggaggttgaggctgcagtgagccatggtcatgccactgctctccagcctagacaacagagcgagacctgtctctaaaaataaaatgaaaggagcaaaagaatttagggcagaggggatggagccctgagcaggagtggggtctgctatccccttcccagcctgggaaactgagagggctgagcttgcaggggacagagcatagctctagactggagaggaggaacaaggcagggtagatctcctcctgggaggataccagagaccccttgagagaaagagtaaagcatccagtgagaccagagagatggttttgaattctctaagagaaatggttttggatccttggaaataagggacaccaaaggcagagaataatagggaagaagaggcagtgaagagagggtcaggacaatgagtactcacacccatccctgccccccagcccgcacctgcccccccaaccagttctcctgtgccagtggccgctgcatccccatctcctggacgtgtgatctggatgacgactgtggggaccgctctgatgagtctgcttcgtgtggtaagagggatgggcagagggagtcaggctgggcctgggggaggggcatcctgagagcatgccagttgggggtgccggagacacctgcaacccagcacttgggtggccttgagtgagttaatctcggtggcctctgtgagaggagagccccatcatcacagcattgtgtctcagcaaactcatgcaggaaaagcactcagcacaggtcctgtgtctgctgactcatggggatgagtgagtggagtttccagccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaaggcaaagggcttcagaatccagcagggcctccctccaggacactgaatccctgctgggttgcctgggagaaaacaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccctcaggctctgggcttcaggctcagaagcccacctggcagatagccatggaccaggtgatgtcagccttgagccaccagggctagtatgtgtgtaaatgtgcgggcaggtgactgccgtgtgtggtgtctcagggctctgttctgtctgtgttgtgttgtgacgtgctgccccagtggttcctgtcccagctgatgtgtgagcggatgtgttgggtcagtgccacgttgcccctcactttttctgtgtctcgcatgccaatggttgccccggcggtttctgtgtttcagagaaggattgtggggacggctctgacgaacagacctgtcctgagcctgccggtcagtgcatagaagcacatgcaccatcacccagagctcagctggccccagccccctgcaggttctccaggcccctactccagagctgctaggatatgaagaaaaagcaacagagaggagggagagcagaaaacagagggagaaagcaaatagtggtcaggaaagaagcagagacggcagagggagcctctgaggaaaggagatgacagagaggtggtgacaaaaagcccaagatgcaaggggaggagagagttagagaagcaaatccagttggaaaagaggcaggaacataacccaaaccccagtctccaccacatgtcccataaatacagagggtcaagtcaagcagcccccacccaatgctgagaaagcaggagcttccttcagccagcctcagcgagcttggtccagaagtggcccccactcttgccagccacaggcagggcccctgtaagccaggcacccagagcatggtattcagcagtgccagcctcagggcaggcctgtaaagcttgtctcaagccggccacgcctgcaccccacctacctctctccctccaaaactagagaaacccctgcctttcccccaaaagcaagcagacccctgttcccacacctgccagaaaggggaaatgaaatgtttaatgttccctgcacccagcctttctgagcttcagtgaggggccctccaggagccttctcctcctcctcatcctgaccacgtgggccatggtgcatgctgcagtctatgcagtttctgtgtcttttctgtttgttattttcccagtgggggggttagggtgggctgagggtgggttctgggcagggggcccaagctgggatcacagagaaggctgctccaccaactcccgctttgcctctccccttcttcccccaccgccagacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgtggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggcctgtgtttggtaaatagtagcttgagaaaaggatgctgcaggcagggatgaatgagcctgaagagacagaggagagagggcctggctccacaaggctcccagtgccctggcctctggggcccagcctcgggggcggtggggacctagttttctggagggatgggccctctcaaggaatgctggcttcctagctctggaagatgtgcagatttttatgtgaaaactaccaaatttttaacactacagtattagtttctctcgtctcacagttctggaggctggaagtcccagacccaactgttggcagggtgggttccttctgaggccgtgtgggagattctgtcccaggcctctccccagcctccgcggtttgctggcaatctttgcagctccttggcttgtcgaagcttgacccgatctctgccttcatcttcacacggtgtcctccctgtgggcatgtctgtcaccagatccccatttcccctttctgtgaggacacctgtcatattggattaggatacacccttatgacctcatcttaagttgaccatctgcaaagacactatttccaaataaagtcatattcacaggtattatgggataggactaatatctttttagggaacacaattcaagccataccaactggcagttgattttagaagttttaaaaggctgggtgcaggccaggcatggtggctcatgcctataatcccagcactctgggagggtgaagtgggaggatcacttgaggccaggggttcaagaccaacctggttaacatagggagaacccatcttgaaaaaagaaaagaaaaaaaaaaaaggctgggtgtgttgactcacacctgtaatcctatcactttgggaggcaaggcaggaggatcacttgtttccaggagtttaagaccagcctgggcaacatagtgagacccctttctctacaaaaaataaacaaaattagctgggcatggaggcacatgcctgtagtcccagctactcagaaggctgaggtgagaggttgagcccaggaggttgaggctgcagtgagctgtgagctcgccactgcactccagcctgggtgacagaataagaccttgtctcaaaagaaaaaaaaagtttaaaaaaaactacagaccaaactcttcctgcaggcctcatctgacccatggaccactagattacagcctctgccttatagagttagggcacattcccaccctagtaggagaagactggacagcgttgagtgcccaccttgagccctgccctgagagggaggacagagaaggccacaggaagcttgggaaatagtaattgcgtctccagggctatctctgtgaaggggagggtgaggggcacaggtgatatcccttagggttctgagaaggggcctctggaggctgtgtggtgtggtgagaagagctccctgccgctcccagataagctgggcaaatttggacaagttgcttcccctgagcctgggcatcctcctttatgaaatgagctgaggtatgtgaggcctggcgtggaggagcagggtgtcactattggtagcagttgttaactatggtatgagctggatggtctgggaccattcaggaggagttgtgtttagactgcaggtaaatggacaggagggagggtcttccagtggggatggcatggtccggagaatgctgtcgtcaagacttagagggtgaaactgagcacttccgtagggtgacagtggggccaggtggagccgttcagaccgagggaaaggctcgtgcagggacagtggggaatgaggctgtcctcaaagggggcagatgatgacagcaggtgtaaatcgtgagaggcttgatttgggaggcactgggaacctttgaaggatttccaagccggaaggtgctgtgatgtaggaggtgatttcggaacacagccctagaggaagattagattgagaagaggttcaggggccccaagaaaggaaaatcagttcagagactgctgctgaaagtcccggcatgagatgagagcatcagctgggtccagggtagggaagggggaggagcggggtgtctgtggcagcatgagtgtatgagtgtggggctccaccaggcagtgctcctgctcctctcctggcctcctgagtcagatctcaggacagcagccagagtgatcctgacaacataagtcagatcatgccctggccctgccctccagcctgtactggctccctgcacccttggaacaaatgccaagcccctctgcacggcctgcagggcccccacccctacccctctgacctgcattcctgccctcccctccccctgcactctactccagctgtggcgttttcttttttctttttttttttttttgagatggagtctccctctgtcgctcaggctggagtacagtggcgtgatctcggctcactgcaagctctgcctcccgggcagctgtggcgttttcttttctttcttttttttttgagatggagtctctctgtcgcccaggctggagtgcagtggcgcaatctcagctcactgcaagctccgcctcccagttcacgccattctcctgcctcagcctcccaagtagctgggactacaggtgcctgccaccacgcctggctaattttttgtatttttagtagagacagggtttcaccatgttagccaggatggtctcgatctcccgacctcgtgatccgcccgccttggcatcccaaagtgctgggattacaggcgtgagccaccgcgcctggcctgtgtgctgttttctgaagtgctggcgtagtcctatctcggagatgagactttgcagcggctgttccccttgcctggagtgtgcctccagggatcctctgggctcactcgctcttcatgcaggcctctgctcagattccttctgcccagaggtcttccctgaccatcttacctgacagatcacccccatccctctcagcttctacccagctttatctccatagctttatcaatacctgaaattacagtctagatttatgggttatgtcttgtctctcttccccattagaacctaagctccatgagggtagggactttgtctggttcagtgctggccccaggacagcgcctggcacacaggaggcactcagtaaacatttgtggcatgaatgaatgaaatagaggctaaggaggtgggcatttgggctcaggccttagcaaattgcttctccagctgagatctccggtgtcaatggggggattagatgaggtgattgtggggcccttggaggtgtgatgcctcctgactctactactgagttggtgcttccaaggagtgtcagcaaagcttggcagactctccaggcctgcctctgctcatatccccaggctgggcttaccggggtggcagggcacagggatgaggagggctgacctgggcaacccctccctcctgaggccctccactgtccctctgcagccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcggtgaggcctggtcccaggagaagggtagggagggtggctgggtaggagtctgggccaaggacagtctttgggggacctgagtctaggagagagcagctctggcagccgggcaggcgagcagcacccagagtggtcaccagcagcctgtgtggacctggcgctccccatggcgctgtgctgagtgagccacgccattagagcagtttatccacaaggcatccctgggggccaggtgctctgttttctccgtttgacagatgggagcactgaggcatggaggggttccatagtggtcccccagacttgggccaaggtagtacagctcctaaactgctgtggagactcagaccccttgcccacatgcataccacagagagatgcggagtgctcttgtggagacaaaggcaccagggttgactgctgatggtcagggcaggcttcctggaggatgtggggattgcatggggttcccaaggacaggcagtacttgcagagtgagtgagaaggcatgggggcaggcgcggtggctcacacctgtcattccagcactttgggaggctgaggcgggcagatcacttgagctcaggaatttgagatcagcctggccaacatggtgaaaccctgtctctgctaaaaatacaaaaattagccggacatgtctgcagtcccagctacttgggaggcagaggcaggagactcgcttgaacctgggaggcggaggttgcagtgagccaacatcctgccactgcactccagcctgggcgacagagcaagaccccatcccaaacaaacaaacaggcaaggggaggagggtgcccattcaagaccaaaagagatgaggttgggggagtccaggagtcagggaggaccatgtggtgtgacttggggatgaggagcagagcagccttatctggtcctcttagccaggcagagcccccagttccttggaagggaggagtggaagataaggccacagggactggctgggagaactgccgacaggctatcagtcaggctggcagtttccagggtgtgccagaggaccaagggtggtataggccctgctgcaccccaccccaaacccctccaaatcaggagagatcagcacaaggggactggacctaaggacctcccagggtccctcccagggaggcaaaaagctggggcccccgccctgggcccaagaaggcaggaacatatcgagaccagacagagatattgaggggtgctccctgtgggaaggggaggtatggtgccagctggtgggtgcaagggtcccaactctggtcctgagggagcccaggaagtcctgggctgaagctcagcctgaagctcagcaggaatggagacgaatggggccgtgggcagggcacaaggacttggtccaggctgcccaggacttggggcccagcagggccgtggtcttgcctcctctcagcttctgaccctgggtctgttccatgcctgcccctcccctagaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctgggtgagacaacagtgaggtgtggtggggcaggccgaggcaggcctctgagctgcagtgggttgggcttggtggccaggtgccaaaggctgagttttccaccctagcccccagtgcccggaccagcagagacctgcctgcgccaggacgggtggcacacaggcagctagccccttgctgaccccatcacatccctcccatcccagaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggaggtgaccaccgattgctgccaggcaggatgcacacaggcggagcgctcaggcgctaggggccacaggtcccatccaagtggccccaaagcagaggcttggctcccccatcccccacacttctgttcattgggttagattttgctgtgggtctccatgcctgacgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctgctttctgtcccaggcagcgtggtgcaccccagacttccttcagtcacacacaatagtgagtgcccactgtacacactgggcagtgggcatgcagcagtgatcaaaacaggctgttttcagttgtgtggtcaaggaaggtcccctgagaaggtgacatctgagcaaaggcttctaagaggcacattttactagagaagtttgtattgtttgtaataatacaaacttgaatttgaaaccattacaaatgtccatcaacgaggggggaggctaagtaaactgtgatgatatccacactgtgcaacagtctctaaaacaatgaggcacacacataatgtattagcatggaaaaatctttatggcagtcacttgagctcaagcagttgaggctgccgtgagccatgatcatgccactgcatccagccttggtgacagaagaccctgtctcaaaaaaaaaaaaaaagttggggagacaataggagtcctactcttgaatatgggcacatcagaaactttggcagaagtgccagggttgagggtgggtcatcgagggctcccaggatttcacacattcatgcacagctccccaggagacgctaacctttcactgccctctcttctccagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggtgaggaccttgcccagccttctcctggccccatggcccccctgaagtcccattcagcctggccagggacaccttactcctcagtgccatctgcctcctcccaccctctacctacgatcccaccacagtcgctccctgagggccctgactttagccctcctgacccctccccactccccaggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagcaccctctgtgccctgagaaggcccaagtctgtggcaccaggacggggtggggaggaacctgtggtgatgagggtgatgagaaggaccaagggatctagaactaggaacggtggcaaaggactgggcacaggaggaggaggacggaggggcgtggggaggccagggccgaggggagggggcaggtagaggaggcggaagcagggccatcagctgtggttattcacactgtaccatcctctccactcacctgtcctctccactctgttccctctgctggggctgtgtctgcccagagggaggggaaacttctttctaattggtctgcccagggagggtgcctttttcttttctttttttttttttttttttgagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctggagggaaggccgcaggccccaggatcccggttgtcagctaaggcagagtcccagtcgggagggtcccgataggagaggctccagagacagccactgtgagaaggggctgcaggtctgccaggggggctgcacccagcggggtatgtccacggagccaagggccagtagcaaacagacggatccagaagaaggcagggcctgaaaccggattggtgggaagcacagaggcagggactgccttcagtgaccagcccatgccccacagagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcaggttcttcctggccctggatgcccaccagtggacatgggcacctccacccgccccttgctcccaaccctggtctacttggtccgagtggtccttctcccagtcctgttccccctcagtgctccagcctggtttcctgatcccttttctccagaaggcacactggctcccctcctgacccactgccctgcagacacccaacaactgactccctacttgtgcccccagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggtcagtctagggcccagggccggggagcatggggtgtggggctgggaagaagaggaccctgacctttccctcttggcaccctccccccaggaagctctactggaccgatggtgacaacatcagcatggccaacatggatggcagcaatcgcaccctgctcttcagtggccagaagggccccgtgggtacgagcttccctgcccacccccacagcccctccctaattccttgaccagcaggtgcttgcagggtccttcagttgcccctcagcctccccagagccctagcttagtgcctgttctcaccatctgctcccttccctggatccccagccctgggccagactccccggcagtgactcccccttttccaggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggtgagggctgctgggcgaagcagagatgacgcagagcaggccaggccagacctactgggagacaggggctggcttggggcagtctctcaccatgtggggcgggcctgatgacttagggccaatgggcccttcaggagagctgggtgtggggccttcccaagggtctcatcccctcctgctgccccaggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctgggtaggtgcgaggccgggcggccgctgggggctcaggggcaacaggggagccgtccagagctgcaggctgcagggccatggggcaagggagtaagtgggttaggctgtacccaccacccaaaggggctccttgtttccttaccacaaaggcgccttgtaggctcccagcagccctgttcacaaggccaggggcccaggaggacagaaaacctgagagctgggtagggtggtgacccccattaggtccagggtagtcagtgaccatcctgtttctgagcagcccaagcctgaccctgaggtcccaaggagggccacctaaccctttccctctgcctcccacctgcccccagaccataagggcaccaacccctgcagtgtcaacaacggtgactgctcccagctctgcctgcccacgtcagagacgacccgctcctgcatgtgcacagccggctatagcctccggagtggccagcaggcctgcgagggtcagtgcctggctttcctcccagccttgtcccagctccccaaccctgacccctcctaccctacagccccaccttcctcttcttaccttggggacaagactacattcgtcgtgtaggggacactggactatgaagtggctatgactctccagtgcctccagtaggattttggaaaaatagatgtcagcaggcagatcggggcagctgcatggaagaggcatgctctgagctgggttttctaggacaagtaggatttggatgcattgttcaaaggagagggaactatacacaaggcaaggtgtgtgcaggagccccagccaagagtggtgggcaaagtgtggggaagtcctggagataaggctgtgagctaggcggggctcctgtgttctgagccaggagtgcctggaaagtgatgtttggggaagatcaacctggccgcaatggtggtggggaagaaacagaggcggttaaaccagttaggaggccattaggagtaatcagagtgtgagatgatgggcctgggctgggctcagtaagggttgaagaaaagaaatgaaacccagacgcatttcacaagaacctgctaactgatttatgagcttgctgggggacagcatttcccaaaagtgcattcctaggagcctccctctttgatgtgggtagattttaccaaaagaaactctgagttgaacaaagtttaaaagtgttttgtgctgcagaacttctcagagccttgaatatgtttatgtgtgccaagaatttttcaagcgtttggggttttccaaaactcacttgaccattcatttttttttcactgagtctgagcaaccagggaccatgtggggattcactttgggatgtgctgtatcaaagggataaaggcaagggaggattctgaggtgcatgggtagtggtgcctcaagacatgggaaaactgggccaggcgcagtggctcaagcctgtaatcccagcactttgggaggctgaggccggccgatcacttgaggtcagaagtttgagactagcttggccaacatggcaaaactccgtctctactaaaaccacaaaaattagctgggcgtggtggtgggcacctgtaatcccagctactcagaagacctaggcaggagaatcacttgaaccgggaaggttcaagggttgcagtgggccaatattgtgccactgaactccagcctgggcgacagatcaggactccatctcaattaaaaaaaaaaaaaaaaaagagccaggtgcgtggctcatgcctgtgatcccagcactttgggaggctaaagagggcggattaccttgaggccggggttcaagaccagcctgaccaacacggagaaaccctgtctctactaaaaatacaaaattagccgggcatggtggtgcatgcctgtaatcccagctactcggaaggctgaggcaggagaatcacttgaacctgggacgcggaggttgtggtgagccgagatcgcgtcattgtactgcagcctggggaacaagagtgaaattccgtctcaaaaaaaacaaacaaagaaaaacaaaagaaaagaaaagaaaaagaaatgggataactgggaatgagactggcttcggagtgaccttagggggttgagtttttgatgttggagagagggtgtggcatagaccagacagagggaggacaaagaggaaactaggatcaggctgagcaccaaactggaagtctagattttggagtcacctagtcctgattgtctggtctgaactcccagactttccctaaggaacttgcaggggtgcagggttgggttgtgctgggtggaggccggcagagcacagggtgagaaatccgagtctctgctgccctctcatggtggctaggggtcctgcaggtggttccccagagctaccagccaggtgcgcttcctcccggcccatgctctggcctcaggctagggtgtgtgtgctgggtggaggatagggatgatggtggggggggatgatatcaaaggagaagcagagaacagttggagggtgacaggaaccaagtttaagggagtgttggcgatacccatgccttaagtttccttgtctttcaggcgtaggttcctttctcctgtactctgtgcatgagggaatcaggggaattcccctggatcccaatgacaagtcagatgccctggtcccagtgtccgggacctcgctggctgtcggcatcgacttccacgctggtgagccatttggtggcagagggagttgggcgtggcgtaggagctttaggggtggtgtggtgtgccctgagggtccagtgagaggctgcctgaattggcctgaggtggggcacttgctacagctgccaccctgactccacctccccttcaagcacctggcccctccggcactctctcacctctgtcttgagccttgtgagattttgacccctcaccttacccctgccttattgggcatccccatgtcacctcctccacctccagaaaatgacaccatctactgggtggacatgggcctgagcacgatcagccgggccaagcgggaccagacgtggcgtgaagacgtggtgaccaatggcattggccgtgtggagggcattgcagtggactggatcgcaggtgagcagtgggcaggtttgtggggcttggggtgtggcagaggactgggggacgaagtgagaggaggagttggcgggagcaggaagaggagctgtaggggtgcctgggagcttggagacaccaggtccacctgtcctcacctaacctccctgagccccaccaactccctccttaggcaacatctactggacagaccagggctttgatgtcatcgaggtcgcccggctcaatggctccttccgctacgtggtgatctcccagggtctagacaagccccgggccatcaccgtccacccggagaaagggtgaggagctggaaagactggccttgtcattctgcccatggcccatgctgatgaggccctgtctcctccagggtctgaggactgacccccacttccacccccaccctacaggtacttgttctggactgagtggggtcagtatccgcgtattgagcggtctcggctagatggcacggagcgtgtggtgctggtcaacgtcagcatcagctggcccaacggcatctcagtggactaccaggttcgcacgccaacttggccttggatccgatggtagacccctgacccaggctcctgttccctgtgatgagcccattctgggaggacttggagcccaggggaagtcacagggtctcccagcccagccctccacccagagtaggactcctgctaccacagagatgatgggcaggggtcgctcagaagtggggagtgggggagtggagagatgcctggaggtcaccttatcagcagggcagtgggcaggagtgtatgcaggaggcaggagtgagttaggggaggctgaactgagggcctcactctggcccaggcactccctgctgccccagacatggggctggcagcgagctcagccctggaggtgaggtgggtgcctctggcctgtaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggtgagggcttctgtcctggcctcctcagctgatctcttccttccctcctgcctccactgatgccctgcttgtgccctgtccttccctcaggactcatgccaacggctctatcaagcgcgggagcaaagacaatgccacagactccgtgcccctgcgaaccggcatcggcgtccagcttaaagacatcaaagtcttcaaccgggaccggcagaaaggtgaggctggggctctgggctggggtggagaggtgagggggactctggcctgggagagtgctccccagggaacccagtgtgagagggctgggagacaagttagacccatggggcaacttccgatggcccgagagacccagggatggggaggaaaggctgaggtgctctgggacagatcttggcattggactctgggccctggagggtcattcaagctgggaataccgaggcagagggcagagctttcgccaaagcctggatgacaaaggcaccagtgagcctttcccaaggcaggccctgccctctgtaccctcccctcccccaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaagtgagcccagaccctaagtcttcccaggaagtgggacatggggcggggagcagcacagactcttagaccccagccaggcactctaccctaggtctgaatcccagcagctacaactcagctgaatccaactgcacccccgcagttacatgactcctgatttggagtcagcgtcagcccccgacttcctcccgccactggtcctagttctgccttcagagctgcacagaacaagcgagaggtctctgtggagcccaacgctcacaaacccaggctgcagacatggggctgagctccagtcacttgggctttcaataacttgggtcagtttcctgctcttgccaagcctgagccttctcatctgcgtggatgagtgtctcatctgagacaggattcctcgagctgctgcgcaggaaggcttagctcagtgatgctggggacggagtgtgtgctctggaaagagcagttacagtgtcagggctgtcatcacaggacagcctttcagctctttgaaaactgcatcctgctacattttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacatagtccagcctgcatgtctgtctaaaaatgtagcatccgaagctaaactcggtactccatgctcgtagcttgatcaggagagactggcacatcaatccccagacccctggaagggatgtcccctcacctccggctgtctgcagaccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacagcccaagcaggatttgatttacagaaatctacattgcactcagctcagcagaactgcagctccaggaaagtgcaaacacaccagaaagcccgattgccctcagtgggagagggttgagaggtgaccacaggtcatttgagtgaggacagcagaggttgggggcactgagtcagaccctggtgcccccgagccctctctgctgcacctcttgcactcccataccccacacttcgccttccagccaggagagcacctgccccaggctgtcccccacggctcctgtgcaggctgccctctgggccctcctgacaaatcgctgctcctgtctcttcacagacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaagtgagctgctgcctggggatgggggtagcagggagaggtgggactcggggtggcagaaactccccaggcagatccaagcgggggtgcaggagaggcaggccctcacttgagctccacccttccctgctgtgtgatctggggagaggtgcaaaagcttcctaagcttcaggttcctcttctgtgatacaagctggctaagattccagctgcctgcaccaaagggagcatcaggactgtgggggacgctctgcctttgtgattgattcattcatcagagcaccatgttggaggcacagggtagggcctctagctctgggatccaaagcttcaggcaaagaatgtttgtcgaacccttcgtacagaagcctaaggctgggcctaccaagccacctagctgggttgagaagtcatacttgtgggaagtaatggtaactggcacagggctgtatacgggtgaccacaggtgtcatgaaggcagtagattggcccagagcctggaactggaaaagacaaggaaggccagctcggacaggggaagtgctttgagcaaaagcctgaagaaaggcaaattcaaggcagggaggacagagggggacctctgcatgccatagagcataggcaggcctgagcccagccaggaagtgaggtcagggtgcggaggagttaggagcacaagccaggacaggtggcagaaagcacccgggggtgggtgctccccctggagggttcacccgcagtcagcctgctctgttctcccgcaggggcagccctcatcccggctgtttgggcctctagtgagccaccccctcgccttagggatccaggcccacatgttagcaacatttttttcccaattcagcagtgcttggaatgtttttcaaaagctttactaggaaactagtaaacacaacccaaagcagctgtatagatacgtgagtgtcccgaacccagattccccccaccagtcccccaatgtcagtcacctccaacctggctcaaggaccctctgtttcctcctgcctctgtcatctggcacatctgcagctgatgatgaaggtccagtccccccttccatgaccctcggctgcctcacctgtctggggatggcctcagagcctgtccctcatgagtctggagcttccctggagggtccagcaaggctgcctggccctcgtcccagaggacgtgaccccctggctgcccaccaagctcctttcttatgaggccaggggattccatcacgcattcagcgagtggcttttgagggcaaagaaggtgcagaggacccagtggggagcgcgaggggcgtcatgaagagcttcgtggctgtgtgctgaggactggccccacctggaagtcagggaacgtgtccttgaagaggcggcatgttagccagcgtctgaggatggcaggagtggctgggtgggagcatggtcccagtgcccaggagaaagagctgagctggcaggaggggccctccccctggccacaaggagcaggcactttcggggaatcagaaggagccagtgtggaccccagtggagagggcaggggcaagtggagactccaacaacccagcctcctcctgagccctccccgcgtcagcactggagcactgatggccctgtagagctcacagtaggatagttagaaggtccgccatgttcctggacactgagcacctaccccaggaaagcctctctctccctcctgccccattcctgggaagcaggttcacccagaccacagttgtgtcacatggaggagtttgttgacgccaggaggaaaaccacttctcactgcaggtgtgagtagtttcacctgaggtgtaggagttcctggtggggactgacaggccaagtccaatcctgacaagccaggaagatgactggccactgccccaggatacccattttcccttatggaggctagaaggacacgccgcctccctcccaacttacatcccgattccagagccaccgcaaacccctgctctcctccaggatgaggcccttaagatcagagcttctcacgagctcgccgaggctcagggcagccagtgtctccagaggggcagagcagcaccattttcctacgtgagcccagcagaaggcgggatagttcaatggtgctggagacgctgggggtgggcaagaagggtgtgacctggagaggtctgaggagacaagttcacaggccagaggacagatctgtggccagaatggtgaggggcagaggtaggaggaggccagaggcactggggtgggggcgggggcaggtcctgttagggaactggagaacggagctggcttttgtgtggcttggtggtctcagactccactgtgcctaaggatcgcctaggagcaagagaatgtggagtcccctgccccgccctgggcctagctgagtgacaagctctgggaccgaggacccagggctcaccatccaatgccggtggtccaaggaccactctgtcacacccagggtagtgcatgaccagccctgaggccttccacagcccccctccagcctcagcaccaccccacaaggagcacggcataattgggggctggctgttcccattgcctcctttactgagaggaaaccagggctcagaggggcgacaggctcattcaaagttggagccgttacgaggcagaacggtggctccaaccccaaacatgcaaaggcctcaaagtacggagaaggggactcttgagagctgcttgaggataggacccacataccccaggacctgggacacatgccacactcagctccacaagggcttcctgaatgatctggaagacagccagcctccctgcacagaagagagcagttaagaataaactcctgggaaatactcacatagtgtgtgccatctgtccttaagatggagattaacttcttccactctcacatcctgcgaggcaggtggtgctaccatccccacctcatagaggaggaaactgaggcacagggcagttgagtaagttgcctaagggcacctagctggtgggtggtggagccagggctggaaccccagggcctgtctcacttggctgcaccggctctcttctcagcaagtagacggtcactgcccagatactgcaatgtgaatatctcacacttggccctcatcccctcacactcagccacctcgtgtgtgaactgtctgtgcaatagtggggcccttcctgggcattggggcactgctggcctctatggctctggggtggctttgccctggcaggcttccaggttccaggtgcctacgcgtcctggcctgtgccctctgttgtggattctcaggctttgcctcctgatctctggaccctcttcccccagcctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgagtctgcggggtgggtgagctggcgggcggctgaggggaggccagggccagggtcagccgtcaaccaagaccgtccaggcacagacatggtgggaacagctgggaggaggtgagtgcctccaggccccagcctcggtcaaccccaccctgtccagcttgctcctcatcagctagacgagggagatagcaggatgcctctgcgggccctcattctgtagctgtcagaggccaggccaggctgtggtccggtggagactgggcaagaggcctgagcgatgctgtgacggtgatggtgctgtctccacaggtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgagtggggctgccgccagctgcctcaccctcctgcctgtcgtgcatggacatacaaacacacaccccacacacacatcgcacataccacacgcaccctacacataccacacacacacatcccacacatactacactacacacaccacaccacatacacacaccacacccctcccacacactcaacacatacacaccacaccatacacaccccccacacaccacatacacatacacccccaacacatacacacacatacacaccccacatacacacaccacacatatcacatgcacaccccacatataccacaccacacacataccacacacacaccacacaccacatacacaccacacataccacacacaccccacacataccacatacacacaccaccacacacactacacataccacacacacaccacatacacacaccacatacacacaccacacatgacacatacacaccacacataggacacacatacacatgccacacacctaccacccacaacacacatcacacacacaccacacagcacacacacacaccacacaccacacgtaccacaaacatgccacacacacacacacacatctcacagacatactataaacaccccacaccccacacaccacaccccacacacacttgcctggtcctgctctccctgggcctccattacacagacacacacagctgtacacacctttggaaccgcaaaacccccagtgctcctgtaccccttcccaccaaggcatctacgcacacagatggactctgcacacgcctggcatctcctccacgttgcacacacacattcatgtcacacccgcccctcagggctcatccatgccctcggtgcccctaccctcaccctggtcactctcctcacttggagccacacagacagccgagagcctgggtgcacgtgccctcagtgggcacgagtacatgccccagcgccccccaccacagacctgcagctttcccaggtgtctcccatgcgccctggggctcactactgcacccgtgatctcagggccctcagactcgaatctctcagaaacactcctcaaagcccacggtgccctgcctaaaagcacacacatcctcaacggcacacctgccgaaaaccccatgcacctggccctcccacagcagccatccccatgccctccccactggctgcaagccgctgtgcctgccgtgactgagcagaggcttgggagctccatgaagtcagtgaatgggtgggtgcactctgggtgcatgcacagcagagaacactctccagccctgcgcccaccctgtccctgctcaggtgaactctctccatgccgaatcaacaacggtggctgccaggacctgtgtctgctcactcaccagggccatgtcaactgctcatgccgagggggccgaatcctccaggatgacctcacctgccgaggtgagagaggcgggggggaggggctggcggggaacccaagcacacaccagggatggtgaccatctcccctacatgctccagcccagccccccaaagccttttgccaagaagacgctgatgatgacctcagctccccgggggaggaggcgtgggcactggggcccacagcgctggctcagaaagctccctccacctccctccccagcggtgaattcctcttgccgagcacaagatgagtttgagtgtgccaatggcgagtgcatcaacttcagcctgacctgcgacggcgtcccccactgcaaggacaagtccgatgagaagccatcctactgcagtaaggagccccctgcagcccctgcctcttccaggcccagagcccaggtcctcctcccccaggcccctgcaggatggagcaggatcaggacccagcttcctgaccatgagttttgggagctcatgaagggcagaaccactgttagcctggactgggcctttgggtttgggggtggccagctggacacgtgcatgacgtctcagggaggcagccctttccctgtgcctgtggctgacacgcagcctactcctccatttgcagactcccgccgctgcaagaagactttccggcagtgcagcaatgggcgctgtgtgtccaacatgctgtggtgcaacggggccgacgactgtggggatggctctgacgagatcccttgcaacagtgagtgaggcgcactggcataacccatctgtacctcagttcctgccccacccctccctggccaagctttgtccctgggccccgtggtgtctggttcaaggcactctgtgacaggccagggcaggtgctgtgggccaggagctctgtcctgcgtccttctggcccccacagagaaaactctggcctgacgatacggggcgggcactgttctagagacagcctgtggtgtgggcgagttccgctgccgggacgggacctgcatcgggaactccagccgctgcaaccagtttgtggattgtgaggacgcctcagatgagatgaactgcagtgagtgacgccctttgctggcacctcctgggctcctccccatcgctcactgcatctcccgccttcaggccctcctgcacctgcccacattcctctctgccttccctcatccccgctgacagcctccatctccctgaggccctgtccccatcccgctcctgctcctgggctctcgtggggttccgagagggggcagtgagcagatggtgcagacagtgccccaccagaagggcaccgttcaacttttggaaacacatgaaggctccatagggctggcagctgccccagtcgggggtgatccagggggaaccaggtatcaccctcacccctgcccccaccaggtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgggcgggggcaggtgtgtggtgggtggtggcctgcggtgagcagggccctcacacctgcctcgccccccaggtgtgaaacgccccagatgccctctgaattacttcgcctgccctagtgggcgctgcatccccatgagctggacgtgtgacaaagaggatgactgtgaacatggcgaggacgagacccactgcagtgagtgaccactgcacccactcagtgctccaagagcctgctgggccccacttcttagtcccccccagcaaatgcccccttggaaaagggcatccagagccttcaaccccctgccccacaccccaactcttgaggtcagactcagagactctgcctctagctgctgctgagcccccccacagaggggtgctgtgggcatctctcctgtccttcccatggcatcagcctccccaggtgggtgacccccacccttccccatctaactgtggcttctgactgccccagacaagttctgctcagaggcccagtttgagtgccagaaccatcgctgcatctccaagcagtggctgtgtgacggcagcgatgactgtggggatggctcagacgaggctgctcactgtggtaaggaagctgggattgggccgggggaggtgccccagggagggacagaccccacccaactccaccccacacacagacacccctgcagacgacggcgaaccatcacctccactgctagacctgatctacccgctcctaagtctctcagtggccctctctccccctacagaaggcaagacgtgcggcccctcctccttctcctgccctggcacccacgtgtgcgtccccgagcgctggctctgtgacggtgacaaagactgtgctgatggtgcagacgagagcatcgcagctggttgctgtgagtggcggggccacgtggagcgggtggacagcaaatggccacagtctcactttgcagatggggaagccggggtgcaggagaggaaatgcctcagcggggtccactgggggcggagccatagctgtagcccaggtgtccagactcctcatccagtgccctgcccactctaccaggagaaccacaggaggttagagtgagggacggtcggccgctggccaggcagggctgaagggctgtgtccacctctgtccacagtgtacaacagcacttgtgacgaccgtgagttcatgtgccagaaccgccagtgcatccccaagcacttcgtgtgtgaccacgaccgtgactgtgcagatggctctgatgagtcccccgagtgtggtgagccttcggcggtggtgggaggaggccctgccctctgccgggccagggcatcagcctcacaggtccattcctcccccagagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaaggtgggccccagacctggctcccctctgccccctccccagactgcctgagaccccgctgacctgccgcctccgcccctccgcagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaaggtatgcccagccctggggaggagcttccacaccccagacgtgccaggaacgcctttctccactgccttattcattcattcatcccctagacagtggggatacagcagtgaatgagacagaaatctgcttggttggggtctgcctctatctggcaggtagagagccagcagatttgctgacagatgagatatgcagtgtgagaggaagagaggagtgaggcatcaagtaggcaagagatacacaggtctggagttcaaggagaggcccaggctggagagggaagtctgggagttatcaccatagagatgctatttgaatctgtgagcctggatatgattcccaagggagcagtgtaggtggagaagagaggagtccaaagtctgagccccgagctgagcaacagccaggagcagggaagtgaggggaccagcagaagagcctgagaaggagcagctgctgaggcaggagaacagccacgagaagaaagcatttccatggggagggcacacgcagctctgtcaaatgacactcgggggcacacagaaggaggcctgcactgtgggccagctgggtgggctcagtacccatatgctgctgcccctagtgaggccgggtagagggaattggagtctctgagccaggtctccagggtgggaggcccagaccctgccacatgcccagcccaaggctccctgtgcctgcagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactggtgagatgcgcgcttggagggcatgaggtgacccaggctgtgtgggactgcccgggtggcagagctccagacaggcaggagaccagggccgctagaatgtgccaggagctgaggcaagatcctctgtctgcagacgaggaaccgtttctgatcttcgccaaccggtactacctgcgcaagctcaacctggacgggtccaactacacgttacttaagcaggtaccaaacccaggccctcctccccgctgcccatctcccagacccagcacagcctcccttgcaagtctccccgcttaggtccaaccatccctcccccagatgcaaatgtggcccctgttgccacaaccgacttctgctgtccttcactccccaaatccagggcctgaacaacgccgttgccttggattttgactaccgagagcagatgatctactggacagatgtgaccacccagggcagcatgatccgaaggatgcaccttaacgggagcaatgtgcaggtgaggcgggcggccctcggcgaccaacactggcccgcctcagatgactgttttcagatcgtctctccttcccgccccaccaacccaaattgcttccttctcactccactagtcactatatgactgcttgttctagctgctcactctcctctgggcccagacagcaaggactgggagattcctcttgcccttcccctcgctgccagcctcatgtctccttaatcatcaggaagttccctgtgaggtctggccaagcactgtgaggcttggggcgtggtcccattcacctagagccccctctcctagagcctctgctgacacctacacagtgtcaggcccaggactgggcattttacttccatggttctcccaccagagctgtcagagggagctctaccccattttacacgaggggaggctgagcctcacagaggcttgcaggtcctcccccaggtcacccagagctctccctcccctgccccttcctgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtatgtggctgaggagggttgggggagcccctgaaagcagcatccaagcccagcctccctgcaggccactggtgcgatgggttacgggatctcccagggctcactgcctacccatcgccaggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttggtcagtgtgccagtgaggctgtccaggcacagcagactcagtggggatggaggtctgaagcgacaggggatcaagttttgggggcaagagtggacataaaaagcggaggatatggcctgaggacaccactcactggggtgtggggttcagagcaccccgggggcttccccagcctggccaccacccagctcccttgggaaggaagaggagaggcccttcccttgtatacacagttctggaggactggccccaaggagggtgggggtgggaggcctgcgattgagaactgcagtgctccccacttcccgaggggagccatacactggcagggcaggaacttgccatgaggcagtctaggtttgaactccagctctgacacttgttagctgtgagaccatggggggtctgtaccatgaaccatctgtaactggggctgacacccacctctcagggtggtggtagggcttgaggaggtggagtgggccggcaccctgtccgagctccggctgactggcactgtgcctgccccttggccctgcagtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgt

SEQ ID NO: 35667 - DNA, 10036 bp, Homo sapiens
gacatcaccggccagccgggtggagtgagcggcgctgggctcgggctccggctccgcgggcggaagaggcggcggcggcggcagaagcggcggcggcggcggcgggagccgaggaggaggttccggacgctgcttaggaaccggggactcaggagtgcccgcgccctgagcgctcagctccagaggcggtgagaggggcggagaggagacatgtcgcggggaaggggcagatttcggggtctaggcttggaggggcaacgatctgggacaccgggggccagacggggagtgtggggaccccggacgagtccactttgtgtcaggcctcacggggtccgtccctcggtcggtgcgtcccgagcgccgagcgtgtgctggaggcggcgtggctccggccagcccgttccacgctgaacggcagtttgggagtcggaccggggcctgtggattaggatgcagcctgcttcccgcccagccggctcggccaggccagcgcccgcccctccctccccgctcaggcttcggactcgcctccgctggcggtctcccggcccagccctgtctcggttccgcgggcggctggtaccatgtgccctcacccccagctcactgcacctggggaagaggtgggcttggcggaaagcttgtccagagggaaggaggagctgggggtgtagagaagtgatgtatatctaacgtaaaaacccttattaatttcatataatccgtgtcaaaactgacagggaaacacgcacacctataaggcacgccagcacacacagtgacacacacccatgtgacttatacacatagtctagcacactccaaatcacaaacgtccctggactacgcatccggccgcccaccacacccccactctgtggggtggggcatcccatgaggagtcttctgaactgcgggctccaagtcatcagtccgacaggacagctgagtggacagaaagggccactgtccccaaatccatcctgattttctggcagcttttcccagccccatggtttcagattgttcctctttaaaactgtggggaaagatgggagaaaatcttggtctcattcctctaacacaaggagacaggattttgcggactaatgagggtaggggcttctggtggcttctcttcctgggtccagttagggcttagcgtgctgggagtggctagtttctgggtaagagtggccaagggatggaggaggagggggtggaagaaacggagaggaaaaagaatgggtatgagtcagccaagaatggaacccaagtcagagagagaatgagaggaatgtgtgtgagaagcagacagacatctccagagaggtctagagatagtcagggaaccagggagagggaggaagtgagagaaagagatggtcagagaagtgcaaacagtgtttgagagtgcactaaacaaattagggaggatgaaggttgggggagaccactgggagttagggaaagtggtacgtgtgtctgggccccaggctgtcagagcgattagctttaattgctcttccctttgtggttaaatactccattggggaaattgccagtgatgccctaggctgcaggcttccctggttgcctacttcctcaattccgtgcccatcatgtgtggatgtattatcatgcatgaagagggtcacagaatcacagagcgcctcactctctcacacagatcctcacgcacaatgtcatgatggatatcttcaccagctggtaggcagccaaccactgaatctccaagccactccgaccaaacttactctgtcttttgtagcagggatgctcaccccttcctaattgcagctccgaatattcagatggggacagtgaagcacagatctcaggagtcctaagtattcatggctaccactaagttggataggtgagtaggaaatgctagaaggggtgaaagcctatagaaaggaggaaaagagagactgaaagatgaagtagaaaggaaatgcatgacaaagagtgagagagatggagagagacagaaatagaagcagggagtgccacaccagaagagtggaaacagagatgggctggggagagtcctaggccccattcccctcctcgccatcagccggccctcctctgctctgcctgatccagtgccagctatctcctgatgccccatcttgggtctggctctttctagaccaagggctgaaggctaatccttgtccccatgcccaaaggtaatccattttgcttcttggactgaagtgaacattttagggcccagatgtcctgcctctcgtcacttccaggctgaccctggagcctcagaaccctcaatttccttgttacaggagtaaagacaaccccctcctcccccacaaagctggataaaaagcttaaagaagaaattaattgagaatgatattaaaggaaataaactacaggactgcttgaatttggggcccagttataatttaaaataggaaagctggacccctactctctcccttccaacccctctgcctctccgtgattacttccaacttcaggcagaagactgacagacttgagtgcctgggagtcccctcctgcccaatacagggacctctaggtccttgcagctgtctgggatggcccctcccctcaggcttaggcagctgcaacagatgtggaagagggacgggcagcaactcttaatcttcaggcttccttctcgaatttacagaggatttggaaccaaacgttagaagggataatctaccacgacttaatgtcaaaatgcacagaaattcttttggtgctgccacctcctccacaggtggttatcccaattgccaggcttctcaaagcactcccagggcctggctcttcttaccccagtgcccatggagctcccacctgtcccaccctaaaaggtcagtatataatggtccttacctcctgcccctcttccccagcatcctcagttggtttgacctttgtcagggctgtgcctggggccagcttggaaggagagggaggcaggaaggaaggaaggtgtgaggaagcggtgagcctagcacagaaagctgggagggaagaggactgacttcctggcagccggggctccggttcctgattcctgccctggtatcctgtcccaagaatggcctccgcccagactgcctggtgatccctgagcagctctctgcactgctccagaaatcaggaggatttttcagagcccagagagcagatttctccacgagccctaaggaaatctgaatctctggtgaggaaagtgacatggaggatgaaggaaacaagctctgccaagccccaccatggccaggccagaccagcccaggtacaactgttgatcagtgagaattgagagcagttcccctaaacaacactccctttgcttcttctgccatactaaggcctaggcaaatggatctctccaagaagggaggcaactgggctgcctttccttgtaccgtcagggggccttattcctatcctttctgtcccttcttactcaccattccctacactcctcccatctagtggtgtcatcctaacgactgggggtggggggcacccagaactgaggttgctatagtaacagatgagatgaggctacagccttctatagttgtggactgtatgctctcctccccctcgccccccatgcctcatttgcagccttagtctctttctgtctcccaactccagctctctttctccattctgtaggctcccctcacccctctggatgtgagcctgtggttatatgccttcttacacatgctcttggctggtttagacacatacaaacacacacatgacagatactcacagccagtgcacccacagccatatatccagtgctggcacatacacctccattaccagaacatccaaacacacccacagatacccagccactgcctcctccagagctgtgcccacaacccggggattagcatccataagatccgagcacacacacatttctcctctgccactttaacattcctacccccatctctcttaggggcctccttgtatctttcactctcttagaaagctcctacccactgcccccaagtctttgtgggtgagtgtgttacacacattaatctcttcccgcctacctcctctgtagatctgttttagattcaaagccctaaatctgaactcctcccgacacacacacacacacacacacacagacacacacacagatgcactctttcctcccgcaggatctgtaatatttacaaactctccttccatatgaaagcagggaagtataacccccaatcctgcccccttttccagctgagggcttggccccagagtttcctccactggggcagggtcttcttgtctcctgctgcgctttcccttccagttgtactcatgcccccctactcattcttatctccatctctagtcccctccccatcatccccctcacccgtacccccctccttctgtccttggattatcagtgaagtgaggggggttgggctccagagcttgctgctgtgacctagatttcaaggcagagacagttcctggtgctgacagtcagagagcattgttcctggcccggcctggcagggccactgctgggcccttctgtctggttgcacctgggtgtgcaactgagcatgcctatgactgcctgtttcttgcgggggtcatggtagccctcctgtctggctcattgtctgcctgtgtcatggtgcctgccaccaagggaggcttgtttattctggtccaggtagggggctgggaatggggacttctgggtctgtatctcttattttgtgaccaccatgccaatctcagttcccctgcagtagagcaagaaggaaaatgtgaatgtgtcaaccaagcccctttgatctgccacattcccagcctaatgctggggtgatttgcaggcagcctccgtcagggacaaggtcatcttgctgcttgcccaccccttggtctagtcgcatacagagtgtttatgatacaatttactttttaaaacatgctttacttttctgactaaaaggaaatagatactcattgtggaaataagttccatttttgagcttaccactagtgtcacattttatcaaatccagaaagtccattcaaacatctgaccttctttcttctgtcttagccacagttcctatcttagtggaaggaaggccttgaatgttctctacttctcacctaaggatcatgaaagagggatagggtgaaagcctaggtgagatctggccttgctgatctcatcagaccatgctgaaggtagtgccagtaggatgttgatacgatacgagaagggggggcagtccccttttgccattctcccaaagccgcatctaaagtcccctccccccaccacccagccagcctgggaactgggcagggggccagagccagttgcttggtattcttgggcacgggggctgcaggcacagcacaaagggtaggagagagagctgagtgggggcctggtaaccatcaaaggagaaaatgggctccacaaaggtgggggtggtccattgcttcccccacctcgaaccctaatgactgaatacaaggctagcatggtggggccaaggaaccatcagaccaagcaactaggcatctatccaaaatgagtcattagtggggtggtggggagttgaagtgagggacccctttgcctttgaggcagaatggggaagctagaacacatgagttcctaccagaccctccagctctttctcagcttctcactgccacagcaagcctcgccctggttgttttggagttttttttccctgacatggggaggggttggaagtgggtggggcgattctgaggggggacttggagagagcgggtgagaaagtcgggagcaggttgctatggtaaccgcctcctcagtcaggggaactgttgccagggttactgttagagggggaaaacagaagaaaaagatggtggggggaaggaggtatgacttgtcactctaggctccagcctggctcctagcttcccgtctaccctgactgcctcccctaggtcttccttttctccctccagccctagccacctccagcctccatgttccaggcacatgcctggtagggcagagtggggagtaggagggtagtgccagtgagtaaaccagactccataccttaagctcaactcctatccctttgtcgcctcccaaccccagtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaaggtgggggaggggagcacaggggtcctgtcatcagtcattcaggctcagttcattcagcaaatagagatgagctcaaagcttttacatccacaatgtgtacccctctatagcaaggcagaagagaggtgctctaagagtatgggggccttagacatttttcactgtgcccctcatcggtaaaaaatgttattcagatactcctgtgctattatcacatatacaacagaacataaaaacaatctaaaaatagtaaaattttaagtggcaaaaattgggaagaattctagacaataaaaatggaagaatacctgaatgaggggagaactcgaagtgtaatctaactggtaaatagtaatactaatctttgttaagcattttttaaaaactggtaaaatttaaaactacaagttctatcattttcttatccactttgagagactactgcttggggagtgggatctatggattagagtaatccctcacagctggaggctttagggaagaattggtgtttaagatggccctgaaaggtgagtgggatttctaaggcaagatccaaaggagggcatgccaggcagaggaacactgtcacagagtatctagtgtgtttggaaatgcaatcagtcctgcttggcttgactaggatgtagggtgtttagaaatggctgggaaggtaaggtaagactgtgttgtagagagcctgggtattggataggtgaggtgagtgaactcagggcccttcagatatactattctgactgctgtgtggctggcagggagaacgtataaaggaggacgtgttacagttagactgtatggcaacagtcagaggggaggagccagggaagaaggtctaagggcatctataatctcctggaattggccaagccatggacatcgtccttctggtggtgtccataccttctctcatttagaataacctttctcaccaggcccagaatctctcctgggttgcctagagattccaccctgctggtcctacatgtgctgtcagcaaattctgatacttacttggatggaaagtggaaaaggatgggggtgggggtggggtatctggaagtcaagttgatttttcttttgtcccctccccacaacatatgggagctagtatctaagctaaacccctcattctaaccacaatctagaaacttcactgaccaactatctgcccttcctgcgaacagtcctctgtattgttgtttgggtaccttagctttcttctcctggattagtagcccctcttcctccagtgttgtaccctcccataaccaatgtcagcaactcagctttggttccaggtcactagtctggtggagtaggggaagctgacctctacagcctagctctgaccctatctcctgccttcctccagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaaggtaagcggccactcctttaactagctgcacctctgcctcgtcccgttgactatccttggagtacttgagttttgggagagtggaggcagatgcccaatgggcctgcctggcatctcccacactgctgtccctggacacatacctttttgcccccagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgc

SEQ ID NO: 35668 - DNA, 7946 bp, Homo sapiens
gtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgaggtgagggactccccggccgcggaggaagggagggagcgagggcgggagccggggcgggctgcgggccccgggccccgggcacgtgtgcggcgcgcctcgccggcctgcggagacacgtggtcgccgagcgggccacgaccttgaggcgccgcttcctcccggcccggggttctcccgcggctggataagggtgatccgggcgcctcgttctgcccccgtcttcacagctcggggctggaggggcctaggggagacccacccggagaccctgcggccccgcgccggcctctttcccaacccttcggcggccgcgcgctggccggggagccgttggggaggccctggcggccgcgcagcaggtgcaggggcgcagagcccgggctcgccttggtacagacgagcgggccccggccttggcgccttcagtttccttccagtttttattttcgctgtgtctacagagcagatgacaccaatttggaaacccgcgagagtgggtagagctaagatagtcttgctgtagtagctgtgatattagatgctcggccatgacttagaggtgtttatttaaggactgtgaatgactcggtgatttcggaaaagcttggcttagatgaacggacatacacaggggagacagccctaaggtttgcagaaaaggctgattgtgctgtttgcgaagtcgaaataattggtgaaagtgtagaaggcagaacctctcaggaatgtctggggaggacaaagaatgtgttggctgactttgtttaaacataaaattgggcagactttaattgatttgtgaaatttttttcaaagtttgtttgaattagcccctatctcttctaacattatcctcttgtgctaattgattgaccattttaaataacttagctgttacagaaagaccgaaaggtgttcttcagtaaaatatattcaagtaagttacttaagtaacgccttaaaagatacagaaaagcaaaaaagtattggcgtattaaaaagaaatcaaaactttccaagtttaggcctgaacattgccttaaaaatatttaataaggcctcaaatgacccagtccgagactgcatgagcctatttattattaaattgtaaatattcttcatataaacaaaaatatataaccatgtctgtaacaaaaatggttttgctagcgttgttactctcttcccttctccgaggggtgatttaggcaacttcggaggttgacaatgccaagcagtcacaatagatagagctttaaagcaaattctatgcatgggtttggatttatgacaggcccgtcaccctgggcctgtcatagtaccccatgccagagcaaactgtgtccccgaaccattgcctggcctctgtgcccgtaggctgctggcactgaagtgggttgcacagtggaaaagaagaaagctctacctggcagaaatttttaaaggttaaaataaataattttaagaaagctggttcacaaggtgccacatttgatgaaagcaaaatacagtggcttttattgttactagagtgatgttcttgcttgtttttcttttttggtgaagttagccccaaattattctcatagctaagcaaatacgagagtgactgtaaggacagttggcattcccggaattgctaaacttggtaggcaacgctggtttaagaatactgagttctagccgggcgtggtggctcacgcctgtaatcccaacactttgggaggctgaggcaggcggatcacctgaggtcgggagttggagaccagcctgactaacatggagaaacgccatctccactaaaaatataaaattagccaggccccgggtgtggtggcacatgccggtaatcccagctactcgggagactgaggcaggagaatcgcttgaacccaggaggcggaggttgaggtgagccgagatcatgccattgcactccagcctgggcaacaagagtaaaactctgtctcaaaaaaaaaaaaaaaaaatactgaattctgatcaggtaacagcaactgtaatacaatgtgataagttgacttgaagattacagtttttaagaagtatatacccagctaatacatgaaaattaactcgtaaaatctcaaatgctccagacatttccatgatgcctgttggtcagtaaaaatcattctaagacttagtggaagtaggaaatgtttgtatggctgtgtataaaggctataatgtaatcccagcactttggaagaccgaggcgggtggatcacctggggtcaggagtttgagacccacctggacaacgtggtgaaatcctgtctctactaaaaacacaaaaattagccgggcatggtggcaggcgcctgtaatcccagctgctggggaggctgaggcaggagaatcgcttgaacccgggaggcagaggttgcagtgagccaagattgcaccgctgcactccagcctgggtgacagcgtgagactctgtctcaaaaaaaataaaaaagtctataatgctattttaagtttctaaggaactgaaactgctctgaaataaatcagaccattataagacttttttccatatcagtgagctaagtgcagataagcttctgaaacttgcatgctagatttttttggtacaaatatttgaaatgcttagtgtgctgccttggaaaaacctggtattttttgttgtgtccttatactgccaaggtttatggaatcatgtaccttatgcctagtaataattaggatgaccaggccagtgagtggttcatatccggggcatgattagctctgcgtgtgctcagccagtgccccatcttcaactcgatgtgttcctaaggtagacagcaaattccctattttatttctcagattgtcactgctgttccaagggcacacgcagagggatttggaattcctggagagttgcctttgtgagaagctggaaatatttctttcaattccatctcttagttttccatgtaagtattcagtttacatttatgttgcaggttaatcttaagaattgtattgctaaggcttctaagtgaatttctccactctatttgcattttgttgcatttcagaggaacatcaagaaatcatgaacaactttggtaatgaagagtttgactgccacttcctcgatgaaggttttactgccaaggacattctggaccagaaaattaatgaagtttcttcttctgtaagtatatgaggcccatgctggcagtgcagctgagagtgccaggcaagtggaaaactttggcaaggtctaaggaagagcaatgaggcttacatgtcttgttatggaatgtagaaattaattcactggtggtaaattaatagtgataatggtgatactcatatcagtggctagactcaaaagagcaggattcattgtgactgatgggaatgaaggtcgctggctattggtgtggtgtgtggtgaggctgctagtgagtcacctgtgaccactcttgtttcaggatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaaggtaagcgatagcagcaggcctcaaaagcgttgtataaaatgggcctggtattccccacgaggcagatacaagttgtgttttttgggcaataaatgctcactaaaggcaaatggggcgggggggtacatgacaacttcccatgcttttctgtttattccacgtgttaagccacatatggatagcatgacaccactcttctttttcagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagtgagttattcccccatctgagggcaagatcgggagcataagatatgtggattcttatcaaacaaacttaaatttctgattattatatttctatactttagtagaaagtagttgaaacccccattgagtcatgaagcctgggactcaaactacagaatatatcagcgacagtatttagaacaggattgtttttattttaattgtggctataagtgaacatctatcatgagacatttgctgcactttccttgcttgtaggttggttttgcggattgccactgatgattccaaagcagtctgtcgtctcagtgtgaaattcggtgccacgctcagaaccagcaggctccttttggaacgggcgaaagagctaaatatcgatgttgttggtgtcaggtgagattttggtgggatagctagaggtcaagacattgaacagtttgagttttacaggctttctcctagtgtttgctattattttaagaaatactaagacacagtgtctcgtctctttattttaccccagcttccatgtaggaagcggctgtaccgatcctgagaccttcgtgcaggcaatctctgatgcccgctgtgtttttgacatgggggtgagtatacgtgaccctgttagggaagggcgggacacaactgacaataactagtcttaattctagagttaactttttatggcagttggttctgtattacatgggtttcagcctatctgctgcatacatttttgttattagctgtggatctggctgacttattttcttgattctaggctgaggttggtttcagcatgtatctgcttgatattggcggtggctttcctggatctgaggatgtgaaacttaaatttgaagaggtaatttagaacaaaactgtaatactcagtagccgttctaataaattcctttttggaatatttcaaaatttaagtgtcttaactaataccacaatgggctgaagtgtcttggtgtgatattttgagtgatttctttgtgctgtctgacattacacttgataccatttggttttctaaagtgtgaatcagctttcccagaagtcttggataattggttacattggaaatcatggctcacacctgtaatccagcacttggggaggccaaggtggtaggatcacttgagcccaggagtttgagaccagcctgggcaacacagtgagaccccatctctacaaaaaaaattttaaaattagcctggtgtggtggcgggcacctgtaatcccagctacttggaaggctgaggtgggaggatcacttgagcccaggaggttgaggctgcagtgagccatgatcatgccactgcactcagcctgggctacagagtgagaccctgtctcaaaaaaaaaaaagaaaaagcatgttgctgtgggcttcctagagaatatgctgactgtagcacatcatcaccccaaatgtgctttgctagacctatgcttcctctccttaaaatacttgaaatgtttagtcacttaggaagttaagccattatattggtgcttgaatttataaaatatatccacatggtttgttaaaatcatgacgtaggcagaataggatttttatcctgttggcatgtatttgttaaaatgttttgacatcttgatgccttcctaggtagtagttagttgcgtactgttctttgataaaaatcatacccataacatcctaaaggagatagggtgcctggaggggaatgaaaacgagccacctgggatatgtagcctggttttcagggagatgttgatgtttttttgcttttgttactttaatgataaacctgtctgttgatgcctggtctcatgatgtcatgtcacaaggccctgtgatgttactcccccatgtgaatttcccacaatgaaggctgctctttcttttctgtttcactctcttagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatggtatgtataaaggacgaatcacttcatgtataactgaaagctgatgcaaaaagtcattaagattgttgatctgcctttctagacgaagatgagtcgagtgagcagacctttatgtattatgtgaatgatggcgtctatggatcatttaattgcatactctatgaccacgcacatgtaaagccccttctgcaaaaggtaatttctgagcatactgtataaaacaattaagaggactggtcacaacacgtgtaattaagtagtacttcctctctccgtctctttatatagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggtaagtaagccatgcatgttgatggtgctgccaagaataggcaccttcttggatgtgtgcttcttgtctagacgaataagaaattgtcttgcctaagattaaatatatatggatatttttcctaagaaaagttttagaaaagactgatgagtgtatttctatgtaattggaatatatttaagttcatgccatgtgtcttgtggtttccttattaccaaaacggtgactgaagaaacgcttgctttagaaatacattgaattggccaggtgtgctggctcacacctgaaatcacaacacattgggaggccaaggcagaaggatcacttgagcccaggagttcgagcctgggcaacatagtgagaccctgtctctacaaaaaattaaaaaattagttggccatggtagtgggcgcctgtagtcccagctgcttggctaaggtgagaggtttgcttgagcctgggaggttgaggctgcggtgagctatgatagcaccattgtattccagcctgagtaacagagaaagaccctgtctcagaaaaaaaaaaaatacattgaattgtttcctgatgggaagtaaatactctcatgcccagttaggagtgagtcagggtttttaatatgccactttttctttctcaggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggc

SEQ ID NO: 35669 - DNA, 113970 bp, Homo sapiens
ggagctgtagctaccgccgtccgcgcctccaaggtttcacggcttcctcagcagagactcgggctcgtccgccatgtccgccgcagacgaggttgacgggctgggcgtggcccggccgcactatggctgtgagtgcggggctccgcggcgcgggggcttcgggctgggctaattgcagacgaggcgcgattttcctgggggctcggccgggcgggtggggcagggcggctgccggcagctcggacccggaagagccgtcccggtggggcggcgggcggcgggcggggaggcccctggttcgcgccccctcggggtccgaggcggcggagaggacccccgaggcctcccgccttagctggggccgcggtagggggagccccacccagcgcctctcgccgcccaggctcggccgagattggggaagacggcctagagtgaggtggcaggatgaccgcgcagggcgtgtcccggggattgggggtctgggtacgcgggctctgcccgtttcgtggaaaggcgctgccctagtgttgcctgcggggtagacccaagggatagaccagggtccagacctgtccggtcccaggctagctacgaggtgccgtcctgggcaagtcacttcagttttctcgggcttagttccctcctcaagatttcaaaagtaaaatagtaataaagaaaaaaaaaagaagcagaaaatcctctgacttcctcattttctgttgtcggccctggacgtcattgaactgcaggcaggattggctaaaggaggaccctttgggattttgaggttttcggttttattttatattgtgggaataatgttcttttttaaaggatcaacatttcacgcatcaacagttatacgtgaggtattgtgccacgtttgtgaaattaaagatgagtaagatcaggccctgtctccaaagagcgttttaatcagagagtcaggtgtgcaagctaatgattataaggtgcaataatgataaaagatgctgaacttactagccatacagagtaatgtaggtaaggagaaggggcctggggaagacagtatgagcacgggaggtgacttttttttttttttttttggagacagggggtcttgctctggtcgcccagcctggagttcagtggtgcaatctcagctcactgcaaactccacctcccaggttcaagcgattctcctgcagtctcccgagtacaggcgtcggccaccacactggctaatttttgtatttttagtagagacagggtttcactgtgttggtcaggctggtctcaaactcctgatctcaaatgatccccacgcctcgacctcccaaagtgtgagccactgcacctggcctgaaggtgacatttgaacagagccttgaagaatgctgtgtagaaagtttgacaggtggccaggcatagtgactcctgcgtgtaatcccagcactttgggagtccgaggtgagaggatagtttgaggccttgagtttgagaccagcctgggcagcacagtgagactccatctcttaaaaaaaaaaaaaaaaattagccaggcgtggtggcccatgcctgtggtcccagctgcttggggctgaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttgggaactgagtgatgtagactgcacagtggtgggaggaagggaagaggagagtttccaaaaatagttgggaccagactgggaaaggccttgaatgccttcccaaggagttaggaatttattccacacctggtgcccatgaaggaagcagattgcttcaaggttaagctcaggctttggagacagactctccaggtttggattcaggccctgtcacttatttgccatggggctgagttcacccagcctcagtttcttcgtctgtaaaataggagtgataatcacaggattgttgtggggtttcaatgagagaatgcgtgtaaaatgcttcgtacaattactgccacttatgtctcaataactgctggctttggtcattaataaaagagggaaacaatattatcagatctgtatttagaaggagttctggcagatagggacagatttgtgccaaaatctcaagacagtatttttcaagattacactgaaacttagtacatatttatattatcatacatttttaaaaaggtcaagatgattatagttgaaaccacatagttctttttttaagaaagtcattgtagtacacctggctggctacacactcattagttatcctgactttctaggtgagtggcaggaaattgattctgtggcaatcttttatcactcaggaaggctacagatcctggtgtttacattctttcttttatgttgtagctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaagaaaagatttatttgagtatgttatagatgtaactgggaagctggtggttgagggaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaacaagtgtgtgtgtatgtgtgtattttaattctgaaaatcttaaaatgctacaagaaagtccagagaacagtacaacaaacatcattgtattccagaactaacaaatgttaacatttgagatatttccctttcctctaaaaacaaaacaaaacaaaaccaacatcgctacatttaaagtcttttttgtgcccctctggtcccattcttccttctcctggggcaaacactaacctgtattttgcatgccctcttgtgtctaggcttcttttctgagcttaaaacttccaggaaactggagcttgggtttcagtgatgacttaagtgaggaggataacacttgtctttctaaataatagaagatgacatagcaaggcatgctatatcactagaaaagggggcattttctcatatgaagtttataagaaaacaaaaactgtaagatctctgccatttaaattgtggatttcaaggtttggaaggtcaaagaatttggaagctgcagctgttctgagagaccatcttgtgctctgtggagctttggtgattccactgaggtgacctgggggtgagagggaagagcttcaacacaccttccttcccccatccaaagtagctctgcttttgttttactgttgaatttcttgaataaaattcacttgttacagagggtgttttggctaacacctcccctcccccaaacactaccaataactagttcaactgctaatctagttcaaccatctcatttaatgaagaaactgaagcctgagttttttggtctacttgtagttttcttgattgaagaatgtttctatctttttttttttttttttgtacagtctcgctctgttgcccaggctggagggcagtggcgcaatcttggctcattgcaacctccacctcccgggttcaagcgattctcctgcctcagcctcctgagtagctggaattacaggcatccgccactacgcctggctaatttttgtatctttagtagagactgggtttcaccataatggccaggctggtctcaaactcctgacctcaggtgatccgcccgtctcagcctcccaaagtgctggaattacaaacgtgagctgctgtgcctggcctcatcatttttttaactatggttgttaaccaggtgtgtgcattagaatcacctggggaacttaaaaaaaaaaaaaaatacacctatctgggccctaccatagagattgtggttcagtaggtcggggtgggagatccagacacatagtagtcccttggtatctgtgggggtttggttccaggacacctgcagatatcagaatccacagttgctcaacttccttatataaaatggcatagtatttgcatataaccttagcacattgcataatatatacttgaaaacatctctagattacttatcatacctctagattactctagatatatctctagattacttatcatacctgatccaatgtaaatgctacataaatagttgttacactgtattgttttatttatatctttctttatttttttctgactgtttttgatccatagtttgttgaatccatggatgcagaacccatggataaggagggccgactgtattttaaatgtctctagtgattccgatgctccttccttggcccccactcctccccctgttgagaaacaagatttaaaactctgccttatgctgggatatcatgacctcagtagaatgttacacttcatcctatttcttcatcaggttctgcattagccaggcattttattttcagctactctagagcgtctttttttctgtcaggtgtttttttccagtataggaaagtagcccatttcctttaaagaccacccagcaggcatgatcccctgaggtgtttttttgttgagtgcttttgcatacttaaggagtaactgacctggcccggtggctcacgcctgtaatcccagcactttggaaagctgaggtgggcggatcacctggcggtcgggagttcgagaccagcctgaccaacatggagaaacccccgtctctactaaaaatacaaaattagtcgggcgtggtggcgggtgcctgtaatcccagctactcgggaggctgaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctattttatggaggcaatcataaaactgggtgtggtgatttttgttgttgtttaaggctttgattttaaaaaatcaaggttggaagcacctatttagattgtaaactagagaggacaaaggaaagaagcctgggaatgttatggtgagaaaagaggactagaatccctgtcagccacctatgtggctgctgccacccctaaaaagtgttgtgagtgcaccaaggacaaatggcatgctcttcgttattagtgagctattaacctcttccagttctttctcctaccttggtgaaccggcctgtatcttgtgtgttccgagggcccctctttcccctctagcgctagacccagtttgcctttttggtttggttccatcctgtttcctccataacctccacccctcccaagttggaggagccccaatatctgggatttacagtaactctaaggccaggaataaagatcatagagattggagggagaaaagcttcccctcttcagttctatttataatacctctacttctactaaaagctccaccttttagtacagtggccccattgtgtatcctagggcactccattttctcctctgcctgtaacagagctctttcttgggaaaagagaggagtgtgtagagagtgaatatgactgtgtagaggcagtgagtataagtaagagagtataagtgtagagagacgaaagttttctgtggctgtgggtttgtgtttccctgaaaggttaactgggaaaatttaggggtaattcctataaatgagcactgggagtggttgagaaatagaaaatgtagagatttctgcttttcttcattgtttggagagcagcttcaatattgaaattaagccgctgttctaatgagatatcacctaacgattcaaggctttttgctaagggctgcacaatagatcaaggatacatcttaaattattatttatgcttaaattgaagcttatttttatccttttgcctgttcttattgagttttacatttgtttaggctaaggagcggggttttttttgtttttttgtttttttttgaaacggagtctcgctctgtcgcccgggccagagtgcaatgacgctatctcggctcactgcaagctccgcctcccaggttaacgccattctcctggctcagcctcccgagtagctgggactacaggcgcccaccaccacgcctggctaattttttgtatttttagtagagacggggtttcaccgtgttagccaggatagtcttgatctcctgacctcgtgatccgcccgccttggcctcccacagtgctgggattacaggcgtgagccactgcgcccggccggctaaagagcagttgtataggagcaatgaataccgtttcactcagttgaaggaggtaacatttaaatatgtgaggtatgttcagtgcttaggtcttggacaggaggaagtaacagatcagaataaggttcaggtgaaaagaaccaagaagagaacgtgtcaggcaggacagaacagggaattctgcaagtgagaagaaagtacgattagtactggaaatggaagaaaattcagctaggttaaaggtcacaggaagaaagttaattccagcattctctgagtttcagacaattcctggtgtgcgctttcaagtctgtcatgggccacctttctgctgctgagtgcccgtaccctagctcaaggaatagggcacacccctcttgtagaagggaaggtaggaacgctggctggttggagactgtcagcaactccacggtgataagtcgagcttagcactaagtagaagtatgtcactttctgtaatttagaggaattgaaaaggtatcttggaaagaaattagttcttgggaacaaagtcttttttgtgcatatgtctttactgttggcatagagcattttctgggatgggctcttcagatctcctctccctgtaagtgatttcagaattccatgaatgttgggatatgtccaggctggcaccctgggatcatgaaaatagaagttaagacatttaagaagcaagaaaacaaaatgggtaggtgaggtgactaggaagaatatcatgcccagcacttctagaattctcaaaatgaggagcatcacttaaattttgagggggatcatttttaggatggtgacccaagctctctttgtacagatgagaagtctagttatctcatgagacccagtgtgactaaaggaccatagcatgtagctgcgtaatggcacggtggcactaggagctgatccattcatttatttataattaccaaggggaagtatggggtgagatttattcttaactcttaaaatggtgacatacactattttaagaataaacctccattcttttttcggatattaatttagtgcaacggccttggacaggctccaccataagaagtgggttgcatttaaaagtgtatttattaaaagtggttgaagctgagtgcttttctgtattgtaacactgttgcaaatggggagtattcattcctaatgtggctgccgaaagctttttaccctaccatgtagctgaaaatttagcaaaaaaaattttttttttttttggagacggagtctcgctctgttgcccaggctggagtgcagtggtgcgatctgggctcaccacaacctctgcctcccgggttcaaacgattctccttcctcaccctcccgagtagctgggattacaggtgcccactgccatgcctggctaatttttgtatttttagtagagatggggtttgaccatgttggccaggctggtctccaactcctgacctcaagtgatccacccgcctcggcccccgcaaagtgctgggattataggcgtgagccactgcacccagcctagcaaaatttaaaattaagaaatgtaaagagttgaactagttagtacccattattattaagaaaagtcatgtggctctatattctcatagtacgaataattaagtaaaatagaaattcaaaagtatgaataaaatttctttgaaaatcttgaatgttgagatatcttgccacagtgaaaagaatcagactttctgttttggcaggtgtgagttctgattctggttttgcaagttgcttaacgtcagggagtgagcccaaatttgtcctttgcagaatgggaacgctatgcatcttacagagctgctgtgatggttaattgcttggcacagtgaaatacagtaggcactcaacaaacttttttttttttttttttttttttgagacggagtcttgctctgtcgcccaggctggagtgcagtggtacaatcttggctcactgcaacctccgcctcccaggttctcaccattctcctgcctcagcctcccgagtagctgggactacaggcgcctgccaccacacctggctaattttttacatttttagtagagatggggtttcactgtgttagccaggatggtctcgatctcctgacctcgtgatccacctgcctcggcctcccaaagtgctgggattacaggcgtgagccaccacgcccggcctgaactcaataaacttttatccaagcacctggataaaggatatcctgaattttttcttttctttttttttttcttttttttttttgagatggagtctcactcttgttgcccaggctggagtgcagtggcactatgttggctcactgtaacctctgccttctgggttcaagcgattctcctgcctcagcctcccaagtagctgggattacaggtgcctaccaccatacccagctaatttttgtattttttagtggagacgggggtttcaccatgttggccaggctggtctcaaactcctgacctcaggtgatccacccgccttggcctcctacagtgctgggattacagacatgagccactgtgcccggcctcctgaattttcacattaaatctgcaaaaggaaaagcagatttaatgtgaagatgacaggaattttctgggcactttcaaggtcctaaggttggtagccctagttttttcacttcagaccttagcttttatctgaaggaaaacaccagaaacagaagatacttctagggagtggaatgggggtagagggtgtgagatttcctttttacttaatactgtactatatatttaaaatgctttttacagtgataattttataataaaggaaaagaagggattaagtaaaaggaaaaactgtgtatataatttttagatataatcacaaattcagatttttaagttactacacagatgttcctcgatttaggagggggttatatcccaatattgtaagtcaaaatgcatttaatacacctaacctactgagtatcatagcccagtccaccttaattgtgctgagaatactgatgttagcttacagttggacaaaattatctagcacaaagcctatattacaataaagtattaagtatcttggctgggcgcggtggctcacacctgtaatctcagcactttgggaggccaaggcaggtggatcacttgatgccaggagttcgagactagcctggccaacatggtgaaacctcatctgtactaaaaatacaaaaaacattagttgggtatggtggcgtgtgcttgtaatcccagctactctggaagctgaggcacaagaatcactggaactgggaggtggaggttgcagtgagctgagatcacgccactgtactgcagcctgggtgatagaaccagacattgtctcaaaaaaaaaaaaaaaaaaaaagtgaatataggaaatcttccttgaaaaaacaaagatactcctacctcagcttctcaagtacctgggactataggcccacttcacctcacctaactaattaaaaaaaatttttttttttgtagagatggggtttctctatgttgccaggctggtcttcatctcctggggctcaggctatccttcgctaaagtgctgggatacaggcgtgagcagccacacctggcctgtattgtcttaatttactattttcagtggccatctaatgttcataatttatttaggtttattcctgtttaaagttctattgctttgattgctggagagtttaaacattttcttacatatttgtttatcagtattattttcttatgcaaattttctgtttttgttatgtgcctggcttctagggtcatgatgttaacttttgtgagctcttttataacatggacttgactttctctcgtatttgctacaaacattttcccttgatgtttcattgtatttgttttcttcattgtagttttaaattttattgagtttaaatgtcagtctttcgatttgtaatttcttctatcaactcgaagtctagatagtttaatttctctaaaaccttgccaaaattttcagtttaataatcgattggcttactttttatatatttgtagagatggggtcttgtaatgttgattgtaaggggaacttatcccgaacttctggccttaggtgatcctcctgcctcagcctcccaaagtgatggaattacaggcctctaatatcctttaaaaaccagctgtttattacctattagcaattcatgtctgttttgtcaaatattatgtatatatatatttctagttctggacttttaaattatggtgaaccatatttcatttttttgagaaaaatatatatgactttgttatacttcttatcattgagaaacaacatctgaagctagcttaattttaactctatgacaagtaacttgatttttttttccttttttcgtgacttgaaatttgtagaattgttgttccttgaggtataaacatttccccagttaacatgttagggttgctattggcttagcaattttgcctgcaatgtggagactcttcttggtttataatgtctcttgtttgtttattttagctttaggaaattgtccattatgcctgtggtgattagttagatctgtgtagtctattttatggctcttcttcattttgtttacgttaaataagcgttctaggtatgtgtctcacatacatcttttgttgcactgacttgattttctacagtcttgatattttttccttggttctgttaatggtagttgctttgtcctattgtagtttatatttttaattaattccttttccgtctccattcttgttaatagcttaaatgatctctttttagttcatgaagaagagtgtggcacaaaagatcctttcaaggtgaaaaaaaggagcaggtagccaagatagttgggttacatagtttaccacttccctttataatccgtaggtgttgaaatagatgtggccatgaaaaaccagtgttaatcgggcagctgagtgtatggattgtccaccagtcaaggttggggaaaaaatctggctgggctaagtgtggcccgttagtttgacctcatttggcatgtatttcttctggtcttacaggtcagagcaactgtttttatatattttaatgtccctaatgacaaaatagtaaaaatacatttgaggacccaagttggcatgttctaggaatttcattttccggcttagtgtggtgacctgcctctgattgctgtacaattccttctgcttcacagtgtcacatctggggataccagttggtagtggaacctgttttggacatttttaagccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaattttttaaaaaaatagttgtatgttgggaagaattagttatttcaataaggcattttattctagaaacctcagtactttaaggcagctaaaggaaagccaaaataatcccccaaaacaaaaaaccaaaaacctgcaatttgcaaggcagtcataatctaaaatattttctgtctgtcccaaagtcagtgtattccccttgcctctccccctcttcctcattgtcatgattagtaccgtttattgcatactttctacatgcaaggcactgtgctaagcactttatatgctttatctaattagctattcttgaagccctgtgaggtgcttattatctacatttaacagataagaaagcaaagctcagagaggttaactcattcatctaataagtggttgatccagatttcaggtttggcaagaactctgaagtcctttctcttaactgccatgttagtctgctgctgctatacttctggttctaaaaataatgacaacagtagtaactactgttaattaagcagaatgatgatgaaatttacatattacattattgtgagataggcattatttttattttaaagagggaaaaaaatagagttgataacacttttcccaaggtcatatattggaattcaagcccaggtttgtgacaccaaagctggtgctcttaacttctgcagatgctgaagtggcaacatttaagtctaacctctttaactggtgcccagagacattaagtaacttgtgtagttttcaagtcagtgagggaactccatcaatttcctgccacttattttggagtctcttccacctgccacctgagggaaagtctccagttgtcttatgtatttttgtgtctaactagcttgttggacccttcctaattgcttcccttcttcataacctggtatctgctttgaattcagcttagaaaggtgttccttcctaccactttcttgtttgttaaagagttacctcatacagacaggagtggcaaattggattggaaattgctttggatcatttggcaagaactgtatttttggggttgtgggaggaggagaggcctgtctaaaagctctatttcttctttactcagaataccttcctgttgactcattggaaatcataacaaaaagcagaaggaatattggagaggcagctgccagcctagggcttggcttctgttggggcagctgtttggggatttagacacactgggctctaagaactgtgaggtttctgcagcagaaggaaatagtattactctgataggtatttattcataaggttaaaaagtgtcagactattgcttgggattattgatgagcaacataagaaactaaaaatattttctcaaatagaattaactggtgatcctaaaaacagaatgaattgaggaatacaagagggagtgggggcaaaattagaaaaggaaaagttgaaaagaagagaaaaaaaacttacaatcattaaaaataggaaaaagataacatttaaatagaaaaagtctcacagatatgcatgcagtaggcattaatcagcaggtcattttactgtaagtaacatacatctcagatgacctttaaaacagctaaaagtaaacaaaatttgtcttttatttaaatgactattataacaaaatgtttttttgggctgggccctgtgattcacaccagtaatcccaacacttacggaggccgaggagggaggatagcatcaggccaggagttcatgaccagcctgggcaacatattaagaccctgtctctacaaaatataagaaataaaaaaaagccaaacgtggtggcacacacctgtagttccagctactcgggaggctgaggtggaaggatcacttgagcccaagagttcgaggctgcagtgagctacgatcacactgctgcacaaaaatgtgtttcttccctgaagacatgctatgtcattagtttgggcaataccttttcataattgatagtttaaaaaggtagtgtttgacaatggcttgacttttggggttttccttaaaaatttgagaatccccataggaatgttttttagatagatttggtcttaatttaaaatttttaaatttaaaacatttttttcttagaaataggtaatacacagacgtgatacataattcagagactatgcaagtatataacactgaaaaaaagtctatatccttagtcttctttctctagctattcagttattttccccacatggaactgctatcatgattgtgtctctttccggagatattctgtgcatgtaaatacaaattactttgatttgtttagaagtggttgcacactgtacattttgctttacatctttttgttgttgttttttgagatggagtcttgctctgttgcccaggctggagtgcagtggtgtgatctcggctcattacaacctccacctccagggttcaagcgattgtcccgcctcagcctcccaagtagatgggactacaggcaatccgccatcaggcctggctaatttttgtatttttagtagagacagggtttcaccatgttggccaggctggtcttgaactcctgaccttaggttatctgcccgccttggcctccctaagtgttgggcttacagacatgagccaccgttttgctttgcatcttaaaattcattccatatgagtgaatgtggaatgaagtgcctctttttttccttcacagttttagttttcggttttgaagttaacctgtcaacggacattttctcctcagcttttgctgttataaaaagtcactttgtaggtatgccattgtgcatgtatgagtattcttgcaggataaatttctaaaagtgtaatttctgggtcaaagggaatatgcatatttagttctcaaaaatattgccaatttgctctcgtaagaggttgtaccagtttgcacatctgcctgtcaataatgtacatataagaaggctgtttccgctttaattttaccaacccagagtattacagattttttacatttgccagtttcataggtgaaaatggtatttcattgtagctattttggattatctaattatgagtgaagatgagcatctttacatgtgtttaaaagccatttgtatgttcttttctgtgaactttttcggtagaatcctttgctcatttttctattggattattcatctttttcttattcattgtggtaagagctctttatatattgaggaaattggctcgttgtacaccgtgggtgttataaatattcattccactttgtcctttaattttttttttttgagaaagtctcattctgttgcccagcctggcgtgcagtggcccgatcttggccaggttcaagcgattcttgtgcctcatcctcccgaggaactgggattacaggcgcgtatcaccacactcagctaatttttgtatttttttagtagagacagggttttgccatgttggccaggctggtcttgaactcctgatctcgggtgatccacctgcctcgacctcccaaagtgctgggattacagccaagagccacctcacctggccattgtcctttaaattttgactttgtatttcaaataaagttttaaaacatatttgaacttactaatattttacttttagtttttgaattttttgcatgatttttaaagagtcttatctatactgagattatataaaaacattctcccatgttttcctctagtatgtttaggatgtaaagtgttttaatatttaactctttgatccatttggaatttattttggtgtgaggagtaagatagatcctgcttttttgacttttgaatcgtattttacattttgagtcttagcagtgtcttaggaaatgtgctctggagggtgtcttgtgctctagtttatgaactgatatcttaatttttttcagaacaaggcagcttcaactgttgagctttttgaaacatatggcttaactatcattttagggaatttggttaggattttccagagtgctttcaagcaagttatattgtaatgctaaacagattaatatcgtgtagtaaagttggcgttgagaaaacaggttttgaattaacagctttgacataaagactgtgaagagattactagacttgccaaactaacataatttattctttgtgtaaaggagagtgcaaatttggagtttgaaaaactgtgtggctgactttctagatcagtattttttgaggtatattgtgctgtgacattaaagaaagggtttagtggtgaaataagcttcagaaatactgagttaaaccaagccaaatattattcaagtggcaaattatttggaatctttgtcatagacttgtaaattctgagtctccaaggcaaaggatagtgtatgcaatattcctcaaacctactttatcaatagtgttccaggttttttttttttttctggtttgcgaacacttttttttctatcagttacggatttgagggactattttttctttcttttactttattttttatttttggactctaagactttcttcagagactatttcaaataagaatttgggagatgttcatggtcacttctcagctattttgtgttttatgatagttagtttacattctccgttgagttatcctgttcttggcttatagagcttaaattaaagccataattgtactaattggataggtataattgctcagtgatctttaaggcattgcaaaggacgggagtgtggtttttaaaaatgaggggtgcaaatgtactaattattaaaaaggaaaagataaatatgacaaattctggtctagtaaactagtttctggccaaacattggaccagaaaaattccagagcacattgtcagatgcataacttatgaacacttagcgagaaaagtgatgcttgggagccaacatgggctccctaaaaaaagccctgtcacattaacatcatttccttttggacagggtcaccagattggtgaatcagagaaaaacacacgcctggcaattttttgtatttttagtagagacggggtttcaccgtgttaaccaggatagtcttgatctcctgacctggtgatccacccgcctcagcctcccagtgctgggattagaggcgtgagccaccgtgcccggccggggtttgtttttggttgatgaaagtgttctggaattagatagtgatgacggttgtacaacattgtgaatattctaaaagcaactgaattgtatattttaaatgagtttacgttacgaatcgtatctcagcaaaaagagctgcagatttttagttcagagaaagcacttttagggcatgttatttgtaaacatttttattgggacttactagggcgtcagtgatgtgtcagtgaagttaggattttacttgtttctagagagatagttaatatattgtaaggcacattttgctttcaatgtaccgtgaatctaataatgaaattcaatagtaataagtgtgatgtcctacattggagttcaaaaagtgtataggataagggagagaagtagcgttagtgggaataacgttggtgggaaacgaaaacaaaatgaaagaaacctgagaagttcattaactcattagtagatatatggtatatgcagccaaggaaaagatggttccactgtcctctggactaatcagaggcttcctgaaattggtgtttagttctggaggccatactttaagatggatctcgtagtctagagcaaggatgttagatttgtggtaggttattttacacccacagcaagcactgctgatagatcagaatccttttcaacgtagaagctgaggaaccactcccaatcagtgggtgttggttgtccattagttgagacttagttgttgctctgggatgagagcgtgttcgatgagtatgaccaggatgataaagggtctaccaattatgatctatgaagaataattgggaatactgaggctatataaaatggaaacaagatttagaagaaatataaaatcagaatctcagaagctcaacctttcatctagtttaggaattcagtcaactgttatattaacattttacctactttactaaaaaattcctgagagatgggaggggagttcattttgtcagatgtggtgccaggggaacagaactagacaatggaaatctgcttaataggaggatagtttcttatataacaataagaaatttccaaacggtgtctgagctgctttgggaaaacccgtgttgcagattttcaggtttagactgtgtaacagtttaatggaagattgttatgttctaacctaagtattttctcgttatttaaaaacaatttttatttcatttcctgtgttattaaaaactatttttattttgaatgacttgatactattccattgctcattttttctaacatggctaagaagttgggaaaattcctccaataaaataattactttaaagcaagtaaaacacgtttttagctcctccattgttcaggacactctgggagaactgaagaagatgcgaaagtataaaacagtcctgcccttaggagcttacggattaattgaagacagggcataaacatttgaaaagttacccaacatcagagaatgagaggtctcagtgtcacaaggcaatatgtaattgctgaggaaatgatgcaaatagttaatgtgtgagagtttagacagggaaagattattttatggctgggtttttcaggataagctgacattgtatggtcaggcgtttccctttcaagggaaagcataacactatgtatacttgtcttgttctctgtgctcctttagagttgaagctctttccacttcctggtacccaatggcacctctcaccacagtgctttttacaaagtaggtgcttggggatattgttaagttgaatgagtacagagttgtgtggtatgtgggggttgtggtaggaaaaagaatttcagtgttatggtgataagagcttggggtaattttctgttttggtttttgtttttcttttattatttggttataattgagaccaggagtaatacggtccctaagcaagagagaaagagcagtgtgtgtctttcagtagagtctttctaatttattcaaagataaattagaaaaggattctacccttatgtacataaataactattaggcgataaagagatataaagtgccataagaaagtttagaggaagtttggaacgagaagagattatttctgatggtaggtcatgaaaaggttcgtggaggagaggtgacttttgaaggtaacatttgaattggcagggatgggtggggctgatcacctaaaagttatactaaaccttgtattctttgtgggcatccctgtctctaccttcctgcatcgtggcttgatgacatctattttctctcaaaacttcttcacattttggccctaacaaatttaccccatctcatttaacatgctatcacttaaaaaattaattaattaatttttagagaaagggtcttgctctcttgcccaggttggagtgcaggggtgcaatcatagctcatggcagccgggaactcttgggctccagccatccccagacctcagccttgtgagtagctgggactgcagatgcatgccaccatgctggcttaacatgccatcttgacctctttccctgtagcagtgggaaaaacgtatttttctcctaacacttaaccttctatgtgtgatctagatcctatcccttcttgtcttctagggttcttattccaatattattttcccaactataacttgcactttttttcctgctgcttctttctctttagcacatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttcaagcgattctcctgcctcagcctcctgagtagctgagattatgggtgcccgccacaacagccagctaatttttgtatttttagtagagatggggtcttaccatgttggccaggctggtctcgaactcctgacctcaaatgatccacccgccttggcctcccaaagtgctgggattacagacgtgagccactgcgccaggccttaatttttacatttttttgtagaaacgggtttcactgggttgcccagcctggcctcgaacttacgaactcaagtgttctactcaccttggcttcccaaaatgctgggattgcaagtgtgagccactgtgccctgcccctatattcacttccttaacttaactcatttggatgtaattcctgtgccttccttttccccattgaaatttctcttgcttagttccaccaacagtgtaaaagtgttcctatttctccacatcctctccagcacctgttgtttcctgactttttaatgagcgacattctaactggtgtgagatggcatctcattgtggttttgatttgcatttctctgatgaccagtgatgatgagcattttttcatgtgtctgttggctgcataaatgtcttcttttgagaagtgtctgttcatatcctttgcccactttttgatagggttgtttgtttttttcttgtaaatttatttgagttctttgtaggttctggatattagccctttgtcagatgagcagattgcaaaaattttctcccattctgtaggttgcctgttcactgtgatggtagtttcttttgctgtgcagaagctctagtttaattagatcccatttctcaattttggcttttgttgccgttgcttttggtgttttagacatgaagtccttgcccatgcctatgtcctgaatggtatttcctagttcaaccattgtggaagacagtgtggcaattcctcaaggatctagaactagaaataccatttgacccagccatcccattactgggtatgtacccaaaggattataaatcatgctgctataaagacacatgcgcacgtatgtttactgcggcactattcatgatagcaaacacttggaaccaacccaaatgtccatcagtgatagactggattaagaaaatgtggcacatatacaccatggaatactatgaagccataaaaaaggatgagttcatgtcctttgtagggacatggatgaagctggaaactatcattctcagcaaactatcacaaggacagaaaaccaaacaccgcatgttctcactcataggtgggaattgaacaatgaaaacacatggacacagggtggggaacatcacacactggggcctgttgtggggtagggggaggggagaggggggagggacagcattaggagatatacctaatgctaaatgatgagttaatgggtgcagcacaccaacatggcacgtgtatacatatgtaacaaacctgcatgttgtgcacatgtaccctagaacttaaagtataataaaaaaaaaaaaaaagaaaaaacattcccaagatcccctcaaaaaaaagaaaaagaaaaagaaatttctcttgctcatatcaccaatggcctaattgctatgtcccatggaaatttttctagtacttaatctctgcagcatatgtcactctttcctgttcaattcatggagttttcttccttttaattgggtatcttttttatgctttttgaatttcgaactgtgtattgaagtattgacctgtgtaaaaaatatattgcctatctaagaaaatcagttagcattcctctgggaaactcacttggccatccatccttaccccaggtctaagttagatgttcctctctcatgtatctttattataacttttctctttcctaatgcactgttagccttagaaggcaagtactacgttctttctttctttcttttcttttcttttctttttttttggagacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttagtaatgattaggctgtagagctgctcacaggttagtaatgattaagctgtagcttctgagacttagctatcatctagatttaactcagttttggaatttcatttcatttcatttaagattaaaaggtctttcatgctccatggtaagtggtaaactagggatggatggatagatagacagctgaccatggtaatgtttcaccagactctggatctgaagacttgatcaaggagtaagtaatctattagccgagacttaaacaaacgaaaaactttattggagtttaatacacatcccacaaaatccacctgtttttttaatgtacaattcaataatatttagtaaatttgctgagttgtgcaacccatcactatgatctagtttccatttctccaataagaccagggactctattaaaataaaacaattagacatgtaattttgacaagtagacttgacctattctatctgattatgctaagaatgaagtgatttgctcaggggtctgtattagatataaatacacacagaagttaaatatataacttgaagcaaaaacatttccctgtttttcacttattcctatagcttttcagattggcctaatttatactcaggtttcctttaaaacagatactatcaagatttctcattttgcttgtatggtttgaaaaacaagccttttttgttccttggctggattactgcaatactttctttagtgtctcctcacttctctctagccctttctcctacaactgctcagaatggtcttttgaattaaatcttattctttaattcctgtgtaaatccttccaagggtctgcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaaaaaaataaaaagacactttcccaggacatgtcaccatctcagactaactccttctccgttccccctagtttttcctcttcctttcttacacttctagaaaaagaagttggctgggtgcagtgactcatgcctgtaatcccagtactttgggagatggagaagggggcggggagggagttgggggttggaagtcaagaatctcttgagttcaggagttccataccagcctggacaacatagtgaaaccttgtctccattataaaaaaagtaataataataaaataaaaattagaaaaagaagcctacatttgctgcctctccttcctacttttagttacttttctagttattttaaatggactcctgtgtcaccactccactaagactccccttacaggagccaaagatgaccttgcttgtgtgccacattcttttctcttcaccacccgcctctctgcagcattgaaagctggtgacctctaccagtttgctgattttttccttccgtgattgccattgtgtgattctctcctggttcttaacttgatcacagacgctatctttgtctctttcacctcttaagtgttggtgttctctgaggcacagtgcttcagcttttacatttttctccacagcctctttctctgtgggcttatctactcttgtggtgccattttccagatttaggtcttcagcaacaggtctccctcctgagacctgtgtttccaactgcctacaagatgccactgtctggacgtcccgttgacatttcaagctgaacatgtttcaaccgtgaattgctcatcctctccggcttttgtgggtgtccccattcttgtttaatggcatcatcttttatgtagtcatccatgccgcaagtcaccaaatcatcttttaaaaaataagaaaaaaaccttctcttttcgttttatagaagtgtttgtaagtttgctgtagatggtatatggtgccggattttctcctagaattgtgtgtcagaatgtggggcttctcgacacactggacaacaatgttattttaaaaaatctttgctagtctgatagctgaagatggtgatattgttactttactttgtatttctttggttagtagtaagattgagaaattttcttataaattactggctatatgtatattttatgaatttttaaatttgtgtttctagcatatttttctagggaaatgtttgccattttatttcaagtgtttaaaatgtatatacatgtaaagattatggaatattgttagctctttgttatatgttgtgattttttttcctccagtaacctttcctgttaaagttttatttagttttttaaaaatggccttacagaagtttaaatactagccaatttatcttttcctttctgatttctgcttctgtagtagtgtttgtaaacttctttctcattttaagagtatataactattttttcttttttaaaaaattctctaatccatttggtgtttaatgttagttgtgaaccgtgaggtctggagctaactgcttccccaccctccatgccccctgccttttcagtcatctgtgagatttcacatctttcccactgcccttctaatccccgtgcctcatctaacagattgtcaaatggggtcaattctacctttgtaattgttaatcattctctttccaccattgtcccagttaaagactgtattaccactcacctggattaccgaaatgtttgcctgatatttctcccttgaatctgtcgtccatgctgctgtccaagttctccttctaagtctacttgaaaacctcccatggctcccattcctgcaggttagattactaatccagatacttttacacctacttctctaccacagtgacttaccgttccctgaatgtgccatttgttttcagcctttttttttgtcctttgtattatgctgttccttttttgttttttaatttttttatttattatactttaagttccagggtacatgtgcacaacgtgcaggtttgttacataatgtatacaggtgccatgttgatgtgctgcacccattaactcgtcatttacattaggtatgtctcctaatgctatccctcccgcctccccctaccccacaacaggccccagtgtgtgatgttcccatgtccctacaaaggacatgaactcatccttttttatggcttcatagtattccatggtgtatatgtgccacattttcttaatccattctatcattgatggacatttgggttggttccaagtctttgctattgtgaatggtgctgcagtaaacatacgtgcgcatgtgtctttatagcagcatgatttataatcctttgggtacatacccagtaatgggatggctgggtcaaatggtatttctagttctagatccttgaggaactgccacactgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacgccattctcctgcctcagcctcccgagtagctgggattacaggtgcccgccaccacgcccagctaattttttgtatttttagtagagatgggagttctccgtgttagccaggatggtctcgatctcctgacctcatgatccacctgccttggcctcccaaagtgctgggattacagacgtgagccgctgtgcccagcctgtttcttaactttttaatgatcactattctaactggtgtgagatggtatctcgttgtggttttgatttgcatttctctgatggccagtgatgaccattttttcatgtgtctgttggctgcataaatgtcttcttttgcaaagtgtctgttcatatccttcccctactttgtgatggggttgtttgtttcttttaaatttgtttgagttctttgtagattctggatattagccctttgtcagataagtatattgcaaaaattttctcccattctgtaggttgcctgttcactctgatggtagtttcttttgctgtgcagaagctctttcgtttaattagatcccatttgtcaattttggcttttgttgccattgcttttggtgtttcagacatgaagtccttgcccatgtctatgtcctgaatggtattgcctaggttttcttctagggtttttatggttttaggtctaacatttaagtctttaatccatctcgaattaatttttgtataacgtgtaaggaagggatccagtttcagctttctacatatggctagccagttttcccagcaccatttattaaatagggaatcgtttccccatttcttgttttggtcaggtttgtcaaagatcagatggttgtggatatgtggtattatttctgagggctctgttctgttccattggtctatatctctgttttggtaccagtaccataccatgctgttttggttattgtagccttgtagtatagtttgaagtcaggtagcatgatgcttccagctttgttcttttggcttaggattgtcttggcaatgcgggctctttttgggttccatatgaactttaaagtagttttttccaattctgtgaagaaagtcattggtagcttgatggggatggcattaaatctataaattaccttgctcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaagtatttttatgctgttcctttatgttacatgtctccttttcccatttttcactattggaaatagaatttatttgagcaaagcctagttcagatatcatctcctattgtagctagctgttaaagcataactgttaccagagagtaattcccttgaaggtgctgactggtattcagcacaacgttataccactgataagtgttccacacagtagtcagttcgaaatgtttcctgaatgaatacgtgggtgtcagaatagacacctttttttttttgaggaattgacttaaaatacttaggaaaaaaactttaaaaaatagaataaatatgaaaaggtataagaattactatgtaggctgagcagagtggctcaagcctataatccttgcactttgggaggctgaggtggaaggatcccttgagcccaggagttggagaccagcctgagtaacatagggagttgctgtctctacaaataattttaaaaattagcctcgtgtggtggtacacacctgtggtcccagctactcaggaggctgaggtgggagcatcactgatcccaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctctcccttagtgcttgatagaagtaagggttgttaatgaggttatatattgtggtgtgggatacttcaggaagcccaatttcagaacttgagcatttgtaagggaatgttcagtaggtcgtaactgttgttattgttgaaggaggaagtatcctgtagcaattaagagtatcagcttcatactggttcgtggctcacgcctgtaatcccagcactttgggagggtaaggcaggtggatggcttgagcccaggagtttggaccaccctgggtaacatggtgaaaccctttctctacaaaaaaaggcaaaaattagccgggtgttgtggcacatgcttgtgaccccagcttcttgagaggctaggtaggaggatccagaggatcgcttgaaccctgaaagtcaaggctgcagtgagccatgatcacaccactacatagactctgtctcaaaaaagaaaaaaaaaaaaaaaagccagagtatgggcttcagaatcacaccaacttgggttcaagtgagagtttacttgccagataatcttggaatatactttttggaacccacagtttatctgtaaaataattacaataatacttcagaggttgttgcaaagattgagataataatgcatgtaaagtatttggcttcatgtctgccacatggtgtgaagattattttttaagtgtcatttatattgaaaatgagtcattctatgttacttctttcctgtttagtacttgtgtttcagatctgacatcacctttttaaaaattttgcatttgagtgagatttgctaaagcagttctggggttaaacttgaagagaaaatattgaatatttatatttaatatcccatgtgagaggagagattaagaaccctgttgtctgcttgttacatctcttgtgaaaaacataaaaaatataagagttttgttactgaactctacttgtggttttggtcgagtctatcatgaaggtatgttgtggagattagtgcaaataatgatttaaatatggaattataaagtttagcagctctatattcggggaaaaacgagtctctgttgattgaaaaagcataataaaataatttattctgaggctttgtggttatgcagtgtcagaatgaaaaagatgatactcctgttccatttcaggctggtcagaccatacctggaacacagtgttcagttggagaaagttcagagatgagcaaaagacgtgagggggcagagatgatgtctaacactgctaatataatacctggtaacgttttgagtacttactctgtgccaggcactgttcttagtattttatatgtactatcatctctttaatcctcataaacattctgtgggtaggtgctattattattctgtttttatgactagtgcttgaaggagctggaatcattttacttatggaattgtcagcatgtgactcatcatgaggggataggaggaaaggcacaaatatttttttcaatacccagccaagcactgtgctagctctatttcacttgcaatcttatttaatcctcaatgacaaaccttggaagatcctgttagccttttttaacaaatgaaagaactggtcaagtggcttgctgtctttctcggtaagtgcgagagacaggacatggaaccagatctttccaagtccatggccagtgctactcacattatgcttttatttttacgttctcttgctccaggaggcagcttagggtgccagtagagaattgatgccggcttagcaaaaaccttctgactactggagtccagaaatgaactaggttaccttgaatgtttgattctctgtcagtattcaggctcagcctgcttcctgatttggctgagatgttttgggaacatcaaattggggatggagtagaacatgtgaggggagtggaggaattgagatgggctgaaagatctttaatgagccttccatccttgagattctatgattattgctaggacagggttaaatatgagaattggtgaaaagttgtgttggccagtgatttttcttttgtgcatagattgattgattttgagacaagagtttcactgtcgcccaggctgggaatgcagtggtatgatcactgctcactgcatcctcaaactctcagactcaggcaaccctcccacctcagccatagttttatttttaaatgtctttataggccgggcacagtggctcacgcctataatcccagcactttgggaggccaaggtgggcggatcacttgaggtcaggagttcaaggccagcccggccaacatggcgaaaccccgtctctactaagatgtacaaaaactagccgggtgtgctgatcccagctacccagaggagacgggagaattgcttgaacccggaagccagaggttgcaatgagctgagatcgtgccattgcactctagcctgggcgacaaagcgagactccatctcaaagaaaaattttttttaataaagtcttcataaagctaaatttataaaaaagctagaggctgggcgtggtggctcatgcctataatcccagcactttgggaggccgaggctggtggatcacctgaggtcaggagttcaggaccaacctggccaacatggtgaaaccccatctctactaaaaatataaaaattagccggttgtggtggcacaagcctgtaatcccagccacttgggaggctgaggcaggagaattgcttgaacttgggagacggaggttgcagtgagctgacatcatgccactgcacttcagcctgggcaacagagcgagactccgtttcaaaaaaaaaaaaaaagctagagatatggtttagcagctctatatttggggaaaaaaggagtctctgttgattgaaaaagtgtaataaaataatttaagctgaggctttgtggttatggagtgtcataatgaagaaggtgatagtcctgttccatttcaggctggtcagaccatacttggaacacagtattcagtaggagaatgaattcagccaggtttgtttgtttgtcttttaagacagagacttgctctgctgttgcccaggctggagtgcagtgatgcaatctcagctcatgcctcagttttccaagtagtggctgggattgcaggcatactccaccacacttggctaatttttgtattttttgtagagacggggtctcaccctgttggccaggtttttctccaattcctgacctcaagtgatccacccgcgttggcctcccaaagtgctgggattacaggcgtgaaccactgcaccggttctaaatatttaagttttataagaaaggttttgtgtctaagttgagaatcactggtggatttagttaagctaaaatacctttaattattaaaaagtaggcagaatgtggagagataccagcctttttccttcttggtatttctgcgatttttccctttttagacagcctgtggagctcaaccccttttggcttttcaggtgatatagtgagagcaagagtgatactgtgaggaggattctaaacctagcaatcagtcttgttattccatctttgccactagctattggatgaccttggatcagcctcattcttatttgtaaatgggaggaagtgcaaatagattattagcctctgagcaggcttgtggccagttagattctttttcaatgtttatatttttaattttggagttgtacttctaaggacctttactaaggaattaattctaaataaagaagaacaccgtgcacaaagatattccttgcactattatttaatggttgaaaacatttagaaatgacataaatgtctaagataggtgacttattaaggacttggttaaatttttatgtaaacttaaagtcttcagaaactatataataacatggaaaatataaacatttcagaaatgtttaataattgtctcattcatatatatatatatatgtatatatatatatgtatatgtatatatatatatgtatatatatatatatatataatttttgagacagagtttgtatatataatttttgagacagagttttgctctgttgcccaggttggagtatggtggcacgatcataactcactgcagccttgacctcctgggctcaaacggtcctcctgctgcagcctctcaagtagctaggactacaggcatgtgccaccacgcctggctaatttttaaattttttgtagagacagggtctggctgtgttgccaggctggtcctgaactcttgggctcaagcaatcctcctgccttggcctcccaaagtgctgggattacaggcgtgagctactgtgcctggccatttttagatatatattatattaaaaacaaacaaagggattttccctagaagtgcatttgcttcctggctctcaggttttctgattctgtgatttagtagaagaaggggaaatctcatgtgagctgtagagaaagactgaaagaagtgtttgttgtgtcatcttggaattcgagtagaatccaaacttctgctaacattaaaaatgttaacatggcactttacttttcaaagcagtttggtcctgatttgttcgtttgtgacagggtttcactttgtcaccccagttagagtgcagtgccaccatctcaactcactgcagcttctacctcccaggttaaagtgatcctcctgtcttagcctcccaagtatctgagactataggtgcacaccaccacactggcaaatttttgtatttttagtagagatggggtttcgccatgttgtccaggctggtctggaactcctgacctcaagtgttcggcctgccttggcctcccaaagtgctgggattacaggtgtgagccactgcatcctacctagtcctgatttattttataaacaaaccaggtgatactccattgtgaaatagctcagattggtgggcaagccacatatgtggtgaggtgacttggaaggcagcttcaggtttgagcagttgtttagaaacaatgtattttgcctccctgtttattctagctcattctttctgtttaataactttcaccaaatcacagttggcctttcttctctgacctgacacctgtgttatataaagagcattctacccagctataggaaacatctaagtcaggactgttttatagcagttggactagggaaaggaaatataaagaatgctgggagatgttaccatgggctctccttttatttttgtctagaaatctcagaaaagaggaaaacctaaatacctctggtaactggctctgattcaaggcaaaagtatctactgtgctctttatccgtagttttccctgtgtgtttacttcattttaaaaagaaaaataagtaactttttttttttttggtactgttacgtgcttgagggccatttttggcttaggctgaggttgttaggttttcactgttaatgagaacccaagttagattgtcccctgagagctggagttgccagtagttgtttgccagaatgattttatcaacatcctttttagcagtaaaaagatgagatgtgtccttgaactacactattttccgtaccgacaactgccaatcttttccacattgccctttgcatctttaggctgaatagaggtatagtttagatttttgtagccatttcaaattggtatctcatttattatgacaactcttctggaaaactcatttgtttcatttttcccctttctgacaatttaagttctactatttgaaagaaagaaaagacagcagagaagcttatcatcgagtataggaaacaaccagaaaattatctggcccattcatatacccatcaggcttcatgtgttagagagtacgctgcctaatttaaaggtagagtagatttaaaagcaagactgagctgggaacggtggcttacgcctgtaatcccagcactttggaaggccgaggtgggtggatcacctgaggtcaggagttcaagaccagcctgaccaatatggtgaaaccccatctctactaaaaataccaaaaaattagccaggtgtggtggcacaggcctgtaatcccagcaactcgggaggctgaggcaggagaattgcttgaacccaggaggcagaggttgtagtgagctgagattgtaccattgcactccagcctgggcaacagagtgagactccaacttaaaaaaaaaaaaattgagtgaaataattttaaattaggagttttaaatctagggttcctagagtcaatgaagtctctgaaattacatgtaaaatttaagtatatgtatatttttccaggggaaggttctatagctttccttcgatattcacaggattctgtggctcagtggttgaaaactgttgccatggtccgggtccagtggctcacacctgtaatcccagcactttgggaggctgaggtgggcggatcacttgaggtcaggagtttgagaccagcctggtcaatatgacgaagccccgtctctactaaaaatacaaaaattagctgggcatggtggtgcatgcctggagtcccagctactcaggaagctgaggcaggagaattgcttgaacccgggaggcggaggttgcagtgagctgagatcatgccactgcactccaggctgggcaatagagtgagactttgtctcaaaagaaaaaagaagaaaaggaaaaaaaaaccattgccataaatgatctttagttacctatgtttccgttggtagaaaatacatgtaactaaactttcctttgttttatcttaggctttcttgaaatgtactaagagatatttgaaggggaaaatacagttttctttttttctttgttttattctttttctttttggaaaatagttttcttttcctatcctttttacaacctcctccctgcctccaaaaatctgagaattcattatttactgcttccataggagtttcttttaatattttagctgaaataattgagtctgttttgataacccccaagcaaccttaaaacttggacctagaaattcactgtggattctgagttctgcaactggaagagaatgtcagcaacaaattaaagcttctgaacagttgaaatggtggcttcagttaccaatggcttttcttaggatttgttaaagagcaacttaaggactgagggaaagggtctgaggttctgggagcagtcaggatctggggagccagctggctgtgttgctgcagcagaggaaagtggggtggagaagaaagtggcatttatgctcaggaattttcctaagttccccgcctctgagatctgactgggccaggcagggaaaggatgtgtgtggaactgattgtaaaagagtgctattatgttcagtttaagcttctccaaggagaatggaaataaagcttaaaatctctaaggaaaagttctgaccttccctttctttttttgcatcctctctcctttggtgcaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggtgagtccttccttgctttgtgcttagatttctgtcaacttgagaaagttagcatgttttattttgtgtaagagttattgagaagtctgtgtaaggtgtgtttgttgcaacaaattatagcctttaaaatgcctggcagaatggagaaatttgtgcaaaggcaatatgtactaggcaaatattattacatctcttttagaatttatctggaaagcccgcctcccccctaccctgtccccccacaaaaaaatatgtactaggaaaagaactttagctgtctttgtttctggtagaattcttatgatgttatatatctagaaattttcctagttgtagatgaattttttaattctttagaaggtagaagaaataactaggggaattaccactttaaatctagttttggggccgggcgcggtggctcacgccggtaatcccagtactttgggaggctgaggtgggcggatcacaaggtcaggagttcgagaccagcctgaccaacatggtgaaaccccgtctctaccaaaaatacaaaaattagccgggcgtggtggtgcatgcctgtaatcccagctactcaggaggctgaggcaggagaatcgcttgaacccgggaggcagaggttgcagtgagccgagatcatgacactgcactccagccctgggtgtcagagtgagactccatctcaaaaaaaaaaaaaaaaagaaagcctaattttaggctgggcacactgattctcacctgtaatcccagtacttggaaggccaaggtggtaggatcacttaagaccaggagtttgagagtagcctgggcaatataatgagaccctgtcttacaaaaaaaaaaattagccagacatggtcacacatgctgtagtcctggctacttgggagactgaggcaagaggattgcttgagcctaggaggttgaggctgtagggagttagtattgcgccactgcactcccacctgtctcttaaaaaaagaaatgaattttaagcactgagatttgttggcaaattgaatgcaaaagtaacttcatgaaaaaacatcaccctgcgttgctggagttcaaggtacaatgggaaagtgattcagtttcagaaaattgagataagtgagagggtttgattcctgtatctcaaggtgctataaaaaagaagactgactgcttaattaagttggaatgttgggccaggcccagtagttcatgcctgtaatcccagcactttgggaggttgaggcgggcggatcacttgaggtcaggagttcaagacaaacccggccaacttggtgaaaccccatctctactaaaaatataaaaattagccaggcttggtggcgcacacctgtaatcccagccactcaggaggctgaggcaggagaatcacttgaacccaggaggcgggggttacagtgagctgagatagcaccactgcactccagcctgggcaacagagcaagactctgtctcccaaaaaaaaaatggggatgttgacaaggaccaaattttcttgtctacagaggttacctgtgaatccttatttgaaaaatgatgactatgaaagatagtggagaattgcattaccaagaccaaatgtaagggtggtcagctgtaataactgggcccaaactcagaatgagtaaggctacaatgtcaaagagataatttttatgttttatgtttaaattcaagggaaaacaaggaacggtataggtactcagccaaaattaacatcataaacagaaactttccttaaacaaaaagacttatatgttcagtgggttttttttgttgttggttggttggttggtttttgttttgagacagggacttgctgtgtcacccaggctagagtgcagtaatgccatcatggctcactgcagccctgacctccctaggctcaagcaatcctcccacctcagcctccctagtagttgggactatgggagcatgctactacaccaggctaatttaaacaaattttagtgtagagatgggggtctcactatgttgcccaggttggtctccaactcctgggcttaagttatcctcccaccttggcctctcaaagtgccaggattacaggcatgagccactgtgcccagccctttgctcagttttgaatacacagttattctgaagacaactctggagctattctgtaggcagaatgggaagatagtgtaaaaggagagcggagactctgcagcaacaataaaaaaaaaatggctgggaggagtggctcatgcctgtaatcccagcactttgggaggctgaggtgggagccctcacttgagtctaggagtttgagatcagcctgggcaacaaggtgaaacctccgctctacaaaaaatagaaaaacaattagatgggcatggtgacatgcactcgtagtcccagctactcaggaggcaaaggtgagaatatcgcttgagcccaggaggtgaggctgcagtgagccgattgtgccagtgagccgattgtgccagtgcactgcagcctggacaacaaagtggagccctgtttcaaaaaaaagcagacattgaagtttagaggggatatctgtatatatagaatgaaagccctgattgattttttttaagacagagtctcattctgtcgcctaggctggagtgcagtggtgccgtcttggctctcactgcaacctctgcctcccaggttcaacgattctcctgcctcagcctcccgagtagctgggattacaggtgtgcaccaccacacctggctaatttttgtatttttagtagagatgggatttcaccatgttggccaggctgatctcaaactcctgacctcaggtgatctgtccacctcggcctgccaatgtgctgggattacaggaatgagccaccgtcccagcgtggtatttttatacagcattttgtgaacatctatgtattcagacaccatactaatttgttcatgtgcattatctcacttagtttttatacatacaaagcagctgttctagatggtaaaactctgtccctaaaggatgaagtggcttttccagtgtcaccagtagattactaagccagtaattgaatccaagataatttaactccaaagaccacatgttctgttgagcacactatacacaagaaggctctccaggtagttgctaagtgagaggagctgagatgtggatttggctttttggtattggaatgtgagcataatgacatcaaaattaaggaaaatttgtcaaatctcttgaggaaacttttgcgaagagagtttttatttaatatttgcttcaatacagccaataatacctaattttcttttttttttctaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctcatacctgtttcatcttaccctagagaaattccctgtgatgatatctacttttactacatcaaattgtagacttacattttactatttttccttagatagaattcacatgctgtgagattcaccattttaaagaataccaaatcagtggtttttatttattcacaaagttgttaacattaaaatttgacctttggaaatataaggaaatattttagaaatctgtagggagtatgaagggtcattttttattttaaattgtagaggtggtagaatgacgtttacttcctggatctgtttttggtcatggctgcagttttgtttggagtgtacatcttctgggtgttctgctcaggagtttatttagtgttgctttcagtgaaattgccatcccagtcctgtctgaatctataactgccacactgtatggtcactcttagagacatgaatggattgattgatttcattctttcttttgttctcatttttttctgtttatatcctttgacgtaagaattccgcttctgggaagttatccgaagtaaataatcagaaagcaccaaaaaaatgtatacagaaggattttttagcattgattatgatagaaaaaattgatagcaaagtacatgtttctttacaaggggtattaattgtgttacagccaaatactagtgccatttaaaaggatatcaacccaagtaaagggcctttgatgtattaagtggggaaaaacggttgaaggttataggagtttgtgttctagctaagatcagatcactatttttgtgtaaaaataaagtgagtgttcttgggaaaaatttgtaaggagataaaatggttttcatttctgtgtgatgggattaagggtggtttttattttccttgtactttcctgtagagttcaaatttttgtaaccaaaggaaaatttattttaaaaaagtgaggtgtagggtatcagaaggtggctaaaaccattttatattttgtattttgttcaatatagaaatattgtatacattttatattttgtattttgtgcaatatataaatattgtatacaaatatgtatattatatagataaatatatgacttatacaatatattacaatatagaatatattgtaatataattttacaatattatataatatacaatatataattacatattgtaatatataatcatatatacaatatattatatattatatatacacaatatattacaacatgtaattatatattacgtatatagtatattgatatgtatacaatatacaacagatatgcattgttgcatacatacctgtggaattgtgttaaatcagaactgagtctttgcagaagactagcttttctcctctttttttcagagaaagttctgaagttctcttccttgccactggtatgtttgagaattaggccccacaattgttaggaaatgcagtacgtcaagttcttacagctacgtggcctgtctgtgcacctgtaatttcctttccctgttttttaatatagtataaaatactgtgctatatagtgtaaaatattacactgtgcacctgtaacttcctgtttctgttttttatatagtatattgccagtgggcaatgacaataacctcatttgaatgttactaagagctttgttaatatttgcaattgctagtagtgttgttactacgagatgcttttttaatgatgtaattttgttaccttttttggtttactaacagtagtatattgtcctggactacaattgcaacaaacacagaatgtattaaaggctttcaggaacaacttgataatcatggctgtaagccttgaattgtccaccctacgtttaggcccagaagacttctgagtaataagaactaatgataacctaaaaatgtattgttgttcttaatataatgtataatacgtaattgacaatacgtatatggtgtttattgggatgtcttttctaatctctttatatggtacatgctggcctattatagaaaattcatgcagtcattttttggttcttatcctttttgactctttattataattggtactgttggctgccttttccctgagatatttcttagtttgatttttaaaattgtttttaatctgctcaactagtcctgttttctttaattattctaccttccatgtcctagtgatggacatactttaagatgcaatccttgttagatacattttcccattttcatggtttcatttattctcaagacttgctgacataagataaacacggtatcttcagttggctgctggacatttctccttggatagctttctgtcacctagaatttttcatatctaaaactaaatctaccttttccccaactgaacttcccttcctctataataaatggtaccatgtcatcattttcccagtcatccagtctcaaaaccttggagataccttgaacttctaaatctggtcattccctaagccttctccatttatttgaaatatctcttttatccatctactgttacaacagcctcccagcatacctccccagctcccatctcccattattcaacatatgctgtgtcctgtctccagtcagatctccccagggctctatttttatccttagctccaaagctaggctacttctttatgtcctgcttatcaagttcagacttgtctgactttcaagttgcttataataatctgattttatcctacctatccaaccttatttttctgttattttctagaacgtattctgtagattttaaaaaacaatagggtatattgccttactgtctcacaaacacatcatgattatttttgctttatttattctggctatttctcttatttggaaggccttttgctctctatcatgattcactcatttctttagtttatgatttcacagtcttaatataggcctttattgcttatccaaattcttctcacctcattattcagtcttttgcttctccgaaccactgtcaccccttatttccctaaattacagattgaattgtatggtgccacatgactgtgagaataggccttgaagttcaaggctattcccagtctaaatctactctgttcctatcctacctcattcactaactcatcgaatgtagagcttccatgaccctggctctgggcttgatatcaaagatatggcagttaataaataacatagatctagccctgccttcgtgtggcttatagtctgttggagtagccaaacagataaacacaaatgatcgattttggtaagtgctaccgtggaaaagtacttgtcttccaaattccctcatacatgctctattctagctacttcatctgtgtagcttcccatttctcctaagcattaaacacattttaatattttatagtttttttcaatgtctaaatgtagcaggttgcacaaactaaagcacttagtaaatgttcattgttgagttgtttctccatctaggcatggtagatagtaactaggagcattgtagttctgaaagcctcatactcagatcagtccagtgatttaaactggactagaacttggtcttcatatgcctgtgtctgggtctgaaataagtaaatcaccttctcacacctaatgaaattcagtgggttgtccaaatagagattttccaagtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatcttactctgtttcttttatttctccctagattttttacccagaaactacagatatctatgatcgaaagaacatgccaagatgtatctactgtatccatgcactcaggtagtcaaattttcttggcaaaataaggaaattatgaataacatctgaattgagtgtgtagttttttatccttgaggtaagaatgaaaaagttttttgattagtttcaaaagttccaaataggataaaatactattatccgaacaaaatggtgagaaacagctgtgtttttctagggagtttggagaagggatttatttatttaatagcaggtaattttcttctaaaaacatggtatctttcataattgatctagtatttctgtgaactatgcattcacttggggtgcagtctcttgtttagttaggtaggtccttgccattgttaagccatttgttcattcattcaataatttttataagccggatgcggtggctcacgcctgtaatcccagcattttgggaggccaaggcgggtggatcacctgaggtcaggagttcaagaccagcctggccaacatagtgaaaccctgtctctactaaaaatacaaaaaattagctgggcatggtggcgggtgcctgtaatcccagctactcgggaggctgaggcaggagaattgcttgaacccggaaggcagaggttgcagtgagccaagattgcaccattgcactccagcctgggcaacaagaacgaaactccatctaaaaaaaaataataataatcataataataataataatttttgtaccaacacaaacatgatagtaagaaatgatacaaaatatatttttttcccataatgtcatggtaaatttggaatgtgacttaattttcaggtccccagaacactaaattaaataggaaggaaaagatgcaagtctggaaggatggtgggatggcatattagtagatgcttatacaggttgaatatcccttctctgaaatgcttgggaccagaagtgttttggattttgaagtatttgcattatacttaccagttgagcatgccaaatctgaaatgcagaatgctccaattatagcattgagggtcatgttggtgcttaaaaatttttagattttggagcattttggattttggattttcagatttggtatactcaacctgtggtacagtagtgtagtattttagcagatttacttgatggccacaggactaaagaagaagatggcagagcaagtgggacatgagtgagatatttgcttgggctgcacttcttatatggcatcctctatgtgtgcttgctaagtgttaattacattggagtaggtatataatactgatctataagaagactattgtctccagtttcttgagcaaacatgtactagatctgtggtatcattggaatcagtgtgaaacatatgaaagaatgaatatagctgagaacttgtggatctcgtgttgagaatgtagcaatttcaaatatgtgtctgaggctgggtaggtacagtggctctcacctgtaatcccagtgctttgggagaccaaggtgggaggattgcttgaagccaggagttagagaccatcctgggcaacgtagcgagaccccatttctacaagaaataaaaaattagctaggcatggtggcattcacctgtagtcctagctactctggaggctgaggtgggaggatcacttaagccgaggagtttgagactgcagtgagctatgattgtgctactgcacttcagcctggatgacagagcgagactctgtctctaaaaaacaaaacaaaacattaccaaatatgtgtgtctgagtccagatcagattaattctgagtattttgtttggcttagtgttgcatgagatttgtccatgttgataatcttgtgaaggccttacctgcaatggatatctgaacgtggaagcagaattcctctctgctagttgtgtagccactactctgcagtgtaacctgggttccaggccctcaaattctctgtagtagagcctaaagaattaactatgccttcctagtggtagagtcagaatgagaaagagaggaagtctgctattgttttccatttctcttgaatatgtagtctgtgcttagaaagtatatatagagcagtgtgtttcgtgatttatggtttcttttttatggtgtttttcctgaagggtggattggcaacatttgataatatgtaggaagtatttataattgctgaaagtgccttcttttaccacaaaacacagccatgttcaaagcaggttcctcaccttgctatattggataaggctccatctccctttggatcaacagtgacagaaaaatactacctctctgtctcctccctgcttgcctttttttttttttttcctctaaagtcttgattggcattattccagagatagtcactgtactttaatcatactaaattacttttgtagataacattccactctcagataagaccccagttttccattctcaaaatacttgtatactaagtttggtgtaagctcatttgtctccttagtatgattatgtttgtgtgtttctctgcagaaagtaatggattggattgaggatgctgccccagggcttgctggggatactttatgataccatatacactgtaaatagaaatacactttctaatatctgagaaattcaatattcagacatatctggctccaagaatttggataagggactgtggacctgtagtagattctgtttcctaatcacctgctgtgtttcagggtctttattaataatctttgagattggcatagtgacttctaggttactcaccattcacagaaaagataattagaatccagatagattaacatagcttccttctgcccattgctacaaagtacagcttaagtaggaaataagaaaaataaatctaagtgcagttacaggctgacgcattatagtgcctaacagtatatttgtagaagtaggcatgggagagcaggagcaaagattggaaagtgctgttcaccattagggtttataagtttcagtgtgaagctaagtacttttgattgtgggtaagaggacttaactggccgttttgaatcctttcatagctccagtgtctccataaaatactcgtaataattaaagagagttaaaagaaagatggtgcccatgtctactttttatattagccagtgatacggttgtagcacctttaatttaccactgaaagacattaaaagctaagtcagtgttcctggtactgtgaaagcaactgtattagtccgttcttgtactgctataaagaaatacctgagactgggtaattcataaagaaaagaggtttaactggcttaaggttccacagcctgtacaagaagcatggctggggagacctcctcaggaaacttacaatcatggtagaagacaaagaggaagcagtcacgtctcacgtggcaggaacaagaggaagagagaggtggggaggtgcttacatacttttaaaaaaccaaatctagcgataactcactcactgttaggagaacagcaccaagggggaaacctgcccccattgatccaatcacctctcaccaggcccccacctggggattacaatttgacatgagatttggacagggacacagacccaaaccatatcagcaacattcttgaactttcttaaaatttcttgttcgctatttccaagtaggaataaatgagaaagaaattcttggagaaaaatattctcttaattaagaatgcagatgtgatgtattagtgagaaaaatatataaaaaatatataaaaatgtataaaaatatatagaaagttattagttattttgctttggaatttcttttttaaagaggcagggtcttactcttttgcctaggctggaacgcagaggtgtgatcttgactcattgtaacaacctcccaggcacaagctatcctcctgccttagcctcccaaatggctaggactacaggcatgcaccaccatacctggctaattaagaaattttttttgtagagacaagtcttgctatgttgctcaagctgttttgaattcctgacctcaagctatcctcctgcctctctttctcaaagtactggaattacaggtgtgagccactacacccagtctggagaattttttgaatacatttaaaatcttctgagacaggcgctttatatatccatcttgagtcttttacctgaaagaaaagcatttaatcatatacacatgacttatacttgcacttctctgagaaaatgtttagcttctgtggatgtataaattctagtgtgttttgagaatacttgatttttgtttttctattatacatttgggtttattatatacaatttaaattttgatcagttctgtgattgcagtgtacatgatgcgtgtttgtatttagatgatattgaggtttatagattatttacaaaaactgtataccactttaagtttctatgatttatttcttatatatttcttatttccctgcttactttaaactgtcaatatcttgcttttgtcagtatctgtaaagtacccttctgatctcttctaatttattgattctgatcagttagggctttagaatccacttaataacacaggcttatggacattaatttatccgtccatccatctgtcaaatattgattaatgtttattaatatatgctaggctctgggtaaacattagtgaatgagccctgtattgtccctgctttcatgaagcttagagtctagttgatttttttttaagtttaaaaagtaaaaataattttcaccaacctgataattaaaaagtaaaaatatatgaaatattctttatctaaaactgttaaattacctggattaaacttttccatcagtaatatgaattcagtttaagtaagatttgccatctgaatcatttttatgaagcttttctaaaatgtcttattatttaaaacttattgattacaggaaggcaaacaaatgaagagacacttcacattatattaacattaatgttaacatcttttttttttttgaaacggaatctcacactgttgcccaggctggagtacagtggtgtgatctcggctcactgcagcctttgcctcccaggttcaagcaattctcctgcctcagcctcctgaatagctgggattacaggcacatgccaccacgcctggctaatttttgtatttttagtagagacagggttttgtcatgttggccaggctggtctcaagctcctgatgtcaggtgatccgcccacctcagcctcccaaagtgctgggattacaggcatgagccactgtgcctggccattaacatctaattatgcattgagtttgtgccagaaccgggactttaatttgtgcctactgatttctcccagtccagtgctctttgcattgtgttatgtgactttttaggacaatgttgtcatgtaaactaaaaaaaaaaaactgaggtaaatagcgtattgtaactacaaaggagactgtcgtaggtactgggagtctcagtgttcagaatacttctattttatacttcatgctgattttcgccttttaagggtggcagctaggcacagctgggaggcctaaccttttgcatattgtatcttctagtttgtacctgttcaagctaggcctggcccctcagattcaagacctatatggaaaggttgacttcacaggtaaggagttagatacttggcaggaaatgcttgaattatgtggaaatagcctggagagccagcagtaccaattttgaagacctagggctttaaaaatacactggcagtggaggtgaaaaaaatacgaataacttgcttctctaatgtggggtaaagaacactaaacttgaaatttcaagctctgttctctcacttaataatgtgaacatgattagtgagtctcagttttcttatatgtaaattggggataacattaacatatataaaacataataatgttaacacataacactaaatgttcgggtatgttgaaaaaagctttataactatctttccctttccattccagcaagcatctgttgtgggcaaagcaagagggagagtggggagtgagatgacacaaagatgccaatttagtaattttaaaatttaagcttatttgggtgggtgtttctatgtgtatttgctatagccagatgcttgaagagatgaggggttggggagaaaaagggcagtggtaatactgtttaagggtaagatagattcaagtctttcaaagtggtgattattttgtaggcttgaaagtttaaaaattggtaagaaagtttttgtccatgatattttttccttccagggaagttattcaccagacctggggaaaggaccagaccttacatgttttctttatcatttggctttctgccttagaaatgaaattgttgaatagcagctaatgattgtaaagactgagataactgacttagtttgtgattcacttattgttgagctcacgttaaagctgttccatttataagttcattgtaggaaatgccataagtagcaattttgaaaaactatttcctgtaggaccttctcactttatagttatttttgatgcccttgataataataacgtttgactacattttatatactagttactgtgttaagtgctttccatacattgtatctttatatccttataaaaccctaaaaggtaaatgccattttatcccattgcatagttgaggaatatgtttccttctcttggttatggaagggtgcttagcttgattgactgattattaattccctcctgtagaagaagaaatcaacaacatgaagactgagttggagaagtatggcatccagatgcctgcctttagcaagattgggggcatcttggctaatgaactgtcagtggatgaagccgcatgtaagaagagagaaattttgtgggttcaactgggattgttgccactatttccaataattaattctatagtgatgatctaggacattatgaatcttgccagcaagtttaagtccacagatgtagttgtaaacacatagtcttccatgctgttattatttggaaatacatgattaattctgattaaagtgaaagcatttagaaaggaagtcctggctgggcgtggtggctcacgcctgtaatcccagcacttcgggaggccaaggcgggtggatcacctgaggtcaggagttcaagaccagcctggccatggtgaaaccccgtctctactaaaaatacaaaaatttagccgggcatggtggtgtgcacctgtaatcccagctactcgggaggctgaggcaggagaatcacttgaacccaagaggcagaggttgcagtgagccgagatcatgccattgcactccagactgggcaacaagagtgaaactctgtctcaaaaaaaaaaagaaaaaaaaagaaaggaagtcctacatttccgtggctcattgagtttcttattgttttatggtgtttacttggtaattaaggcagatatctccagagcaagtgttccttgcaaggctctcttatgagtgtttctctgtgagattctaaattcaccatcccagacatggatcacagatggagctgtggctttgcatactgtaaggaagaggctaggctcatagcctggcccagggagccagtcttcgaaccccagttgttatttctctgtgaaaaggagcctctgtctctaatggggggtgcaatgttgctttctgttgtgatatacatcctgtaatctatataatctcagtgtttttgttggtttgtttttttgtttttttttttagtacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacagggtaaaaatgcaacatctattctttctaattaatttatattattccgtcatttgatatggctccagtttaaacatcagttttattgagatgcagtttacatacaacaaaattcaccggattttaaatgtacagtttgagttttgaaaagtatatgtgatcatttaaccatcactcccagaaagttccttagtgcacttttgcaattagtttccaccttacccacacccctgagcccaggcaactaccagtctattttctattgctgccattgacctttttaagaattttatacaaatggaatgatgcagtatctaatcttttggtgtgaggctccattttgacctctgcttcttgaattttatataaataaaattctagagcgtagccattaaaattaatagtgccctttggaaagattatctctaaatattaacatagtctttcctctttcccagattctctggggtaaaatgtttgtgtacagttgttatgggtatgtggaagttagttaaatgattctgacttgaaaaaactgaatctgaggatctcatttcccgaggtcaggagtttgagaccagcctggccaacatggcgaaatcccatctatactaaaagtcaaaaattagcccagcgttgtgttgggctcctgtaatcccaggtacttgggaggctgaggcagcagaatctattgaacctgggaggtggaggctgcagtgagccaagactgcaccagccaggagacagggcgagactccgtctcgggggggaaaaaaaaaacttcacacaaatttatccaccccttgttaaaattagtggttgatgacaaaacgaagacaatcctgctctcagaacattctttgtatctcttatcatagagcagggatttcagtttcccagttaggtgccaaactggcctgcaggcaagtagctgctgccctgcctctgcctatgtcaccagtgagactccaggattgtggatctgtatgtgcccattctgctcagatctgaggcaaggatgtgctgcccctaatcccagcactttgggaggccaaggcgggcagatcacttgaggttaggagtttgagaccagcctggccaatatggtgaaaccctatctctactaaaaataccaaaaaaattaactgggcatgatggtgcacgcctgtagtcccagctactcaggaggctgaagcaagagaatcacgtgaacccaggaggcagagtttttaatgagccaagatggtgccattgcactgcagcctgggtgacagagtgagactctgtctcaaaaaaaagacagaatctcgctcagtcacctaggctggagtgcagtggcacggtcataactcactgcagccttgaacttctggggaaagcaatcttactgtcacagcctcctgagtagctgggactacaggcatgtgccaccacattgggctaataaaaaaaagttttttgtagagatggggtctcgctatgttgcccaggctgatctcaaactcttggcttcaagccatcttcccaccttggccttccaaagcactgggattacaggcatgagttactgtgcctgctttgttctttataaagggtcttaagctacacccatattcttggtagtgttatggtgcaggaggagcacacgtgtatttatgtggtcttcttagacaccttaagctaacttaattacgctttttactcatcctcagacagaaaactcagagagagaaagagatgtttatgaggagctgctcacgcaagctgaaattcaaggcaatataaacaaagtcaatagtaagtatgttcctgaatcaggcacctaaagggatattataatataatgtgaatgttgatctattctgggacttacaacatagtttgatttacttactttagacattcgtggatttgtttagcaataattgcttgttaacaatcttttgtgtttctatgcctccgttttaattatttatcttcagtcagccgcttgttcctacactgacagtagcatcatagtagtctgtttggctacagtttcactctttcaccctattacatgcttttaaatattattttcctggccaggcacagtggctgattaatcccagcacttacatatctgtaatcccaggactttgggaggctaaggcgggtggatcacctgaggtcagaagttcgagaccagcctagccaatatggtaaaaccccatctctactaaaaatacaaaaattagccgggcatggtggcgtgctcttgtagtcccagctacttgggaggctgaggcaggagaattgcttgaacctgggaggcataggttgcagtgagctgagatggtgccactgtactccagactgggcaacagtgagactctgtctcaaaaaaaaaaaaatatttttctatttttttaaagtaacattatatttttgtttttcctttaaagaataatgcaagctgtctagaaataaaaaataaaccacaaaaattagactccttcacttagaaataatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatccttctgtttcaaattctctagtagctaggactacagtcatgcgctgccacacccagctgatttttaaaatttttttgaagagacagggtctcgctctgttgcccaggttggtgtcaaactcctgatctcaagtgatcctgccaccttggcctcccaaattgctgggattacaggcatgagccaccttgcccagcctccaaaacatatttaaacaaaaatgagattatacttttaatattgacttttatatatgtgttacttttgggaaattaatttattgaaattatcattttgtcactactctgctaaagaactcaccatgactacttcatacttgccagacaaaatgcagatccctagcctagtgcagttctttatgcaatatttcatgcatacagctctttgtagaagctcatttgcctaattacctcccatactcattctgtacattttatgacttaaaaggaatctgggccaggcaattccagcattttggaaggccagggcaggtggattgcctgagcttaggtttgagaccagcctgggcaatgtggcgaaaccctgtctctacaaaaaatacaaaaactagctggacgtggtgacatgcgcctgtagtcccagctacttgggggctgaagcaggaggattgcttgagcccaggaggttgaggctacagtgagctgtgttcgcaccactgcactgtagcctgggcaacagagtgagaccctgcctcaaaaaattaattaattaattttttttttttaaaaaagaatctggctctgaagtggtactgacctggtatttgatctcttgttcctctgttaaaagctgtgtaacattgggcacctgcagtagcgttgttagacatataatacgagatagtgtatgtaaattgcctgctatttagtaagtactcaatgaacattaatattatcgctatgtcatgtaatctccctactgtaatgccttcatgcctcatctcttcctaatccaaattgtacccatcattcaagatccagttcaattttcacttcagtgcctgtcacagttcaatatggttgactttcaaatctcctgtgtcgtacacaggctcatccctataaatttgcacttaattatatattgtcttgtattgcttgatctttatttctgacatctttgtaaactccttaaagtagagattacgtattctgcttcttttgaagtcctcctaattcctagcataggtttagactcaccaaaaaaactaaaaggtttgatttcaaccaactaggtcaggcttaatcttgttttgctcaagatactcataacaataataatagtaattgttctcattgttcatttggagggccaaatttctcatttgaactaatactaataactagagaggatttagaagattttaccaattgcataggattggagttttaagtcctgaccagcattctttttttttgggttttttttttttttggagacagagcccaggctggagtgcagtggcacgatctcggctcactgcaacctctgcctcctgggttcaagagatttcttctgcctcagcctcctgagtggatgaccagcattctttgtattctgctaccttctggttcatttaggataatgaccttcctagcagaataatccattcaagtgtggatggtatcttgtgctgaatctgtattaatccttaagtcagcaaatataaactggagtgtccttatggttggttctctgtgagaagaaagtccacgatgtttcctgttgcatagagtacataaaatattttttgttttactgagggatttttctctaccttactgtttggtattttataacctttatagttttaccttgctaattgtataagaatcagttgtgagcacatgtaaggaaataataatatgttcttaaaatgtcctattcatattattattatgtagtcagaggagcaaaataataaaaattccctcaaatacctttcagtatagtggggaagatagacatacaaatgagtacttttagggcagcttgattagagcaagatgccaagagcacatgtggtgcagtcatagaataaagaagggaatgatgacttctgcttagaagtttgagcaggttttcagtgtacatggatcttcacagggatccttaggatagataagagggtgaggataaggcagaattccctataaaaggacagtcttttcctaattgtagagaaagtcttgaggcaaaggaaagttagatgccaggaggatatagggacttcgggttccaggaattaatgtaattatagataagattctttgcctagagcattcgaaacagcaatgaggccattgatgctgccccaggagaaagctgcaggccaagcagttaaaaattagaaaaagtttttattttattttttgttaagtagactaaggaaaattagagttatataactaaagttcagtgagagaaagtatttaagtaatgttccacactttattatgtttgcaatataaatgtttatagatattcatttaatatttacatatttaagtagtatgtgtacacttctagaaaaagcaaaatttactagatgcttttgtagatagataatctaagactctatgctatatacctagagaaagtctagtttgttatctacattgattttattttctgtccctagctactatgaaagctccttgaggacaggatatttgtttttttcacaattatatttgcaacatatagcagatcctcagtaaatatcattgaaggaatggatgattagttggctaacagccacatatacctgcagacatgacttgagaagccaccaccttggtatggtgctcagttgaatggcaggtatgaatattaggaagaaataaacagtatcttaggagcctacagtgagacctcacatccataccaatgttttaaccttttcttccgccctttttttaaatagttctagtctcctcattgcccctacttcccattttctagtttgagactttattttcccttgggctgttttgattttctttataacagcttattaattttattttgttttttactaatgaaaacatttgcaattgataagtactattatgccccagatatttttatttttggtattttattgatttctttttgctactgtgataaaatcagatgtttatctgtgagtggtggtagggacaggcattttctcttcaaaaaataaggaaacggaaagtaaaaaagtaattatgattccttagtggctatcatttctgaaatcagaaattatcttattctgtctttcaggctaagaatacctttttgttttgttttgttttttttacaatatataaagtgcttttatgtatatgattttatttaatcttaaaaatattcctatgacggaaggtatcttcattatcattttcagatgaaggaacatctgggttttcattgtcatgtattgtattatagagcttgtgtgacctcaggttctatgattagaagagagaatgtggaaaggggaagatgacccctttcactctgcacaggttggaccacccttgatagcagggcactgactgttgtgggtggagtgtgttcaggaagtatcagggtaatgagaggattcaaaatggtgctatgtaagacatggttaaaggaaataaggctgctagtaaggcatttgctgtcatagggaggggcagtggaatgtattcagtgtgaactttagggttggagctttaaaaatatttttgaaacaaaattgtccaaagatgtagtaagtggccacgggagatactttctcctgtttggtagtctgtaagtataatctggacaactacttggcattttaagggaatttaagcgtcatgttggtctggattggtggctccatattggtgctgagctgtctacatttggaagtttttaagtaggctgggagtgtggcccaggaatctgtatgaaatctgatgaatagcttgttgggaacccctggacttgatgactctaaggttcttttccaatcccaagatcttatgcttctgagaatcacagagtaaaggctctctgagttatatttccttatctggaactgagattggttttggggaaggaaaactattctaggctcttctgttaacatagtcctttcacaagcttttgccttttttcctcagcattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacaggtaaacatagtctggattgaagctgcaagagtttgtatatatccattcgaatcccatgctgtcatttaaagatatatatgctgcctttgtttttcccccaatacgactttttcctctgcatataaattagtttaaaaaaaaatcctcaggtaaaatacacattgtcttcagctcacttttgcttttagagctatgaatcctcttttaagataaacagacaatacccacccatccccagtctaatcactccttcacttcagctgtctctctctccaactaaaagacattggggaaaacctgaatatttttgcattcttacgtcaggaatttgcactttaaaaaaaaactgcaccttattagtttgctctggccaaagctggaaaagtacttactgtgcagtcagggtagcttgtgtgggattgtatttcgtgggttttttttttttagaacaaacatgaggggctttcttttttgtctaaataagggcaagtatacattttacaaatatccagcgtacgttggtcaaagtaagtagcattaacgtgcttaagattctacaaacactttttccttagaactttttgaggcttttcatgtaatatgtttaagaatgtactggtatctgtaaagtcactctaccccagctttggcaaaggcatttggctctacctggggctgccaccttggctgcatgtagcctgagctgtcacttatgactatggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctccccactacccttcccagcttctgggaaccaccagtcaactctacctctgtgagatccacttttttagctcccatatatgagtgagatcaggaggtatttgcctttctgtgtctggcttatttcacttaacataatgaccttcagtttttatggctgaataatattccattatgtgtatacactacctttttttttttttttttttttttttttttttttaccatttattcattgatggacgcttaggttgatttcatatcttggctattgtgaatacagctgcagtaaacatgggagtgctgatttcctttcttttggccatatacctagcaatgggattgctgaatcatatgtagttttattttaattttttgaggactctccatcctgttttccgtagcggctatagtaatttatattcccatcaacagtgtatgagccctttctctgcagccttcccagcatttgttattttttgtctttgataaaagccattttaattggggtgagaaagtatctcattgtggttttgatgtgtatttccctgatgattaatgatgttgagcattttttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgttgtctcttcactttgttgttggtttcctttgctgtgcagaagctttttagcttgacatagtcctgtttgtctatttttgctttcgttgcttatgcttttaaggtcttagctaaatggctttgcttagaccagtgtcctgaagcatttccccaatgttttcttccagtcgcttcatagtttcaggtcttagatttaagtctttaatctattttgatttatttttgtatattatgagagatagggatctagctttattcttctgcatatggttatccagttttctcaacaccatttattgaagagactgtctgtctcagcccattttacgtggctataaagggatacttgaagtggggtaatttattagctcacagctctgcaggctgtgcaagaagcaaggcaccagcatctgctcagcttctggtgagggcttttgtgctgcatcaaaatatgaaggagaagatcaaagggcaagtgggctcatgtgaagagagactgatccccggggtagtgagtaggggtcctggctttataacaacccattctaatgagaactgatccgttctccccaagaaccaatccaatcttgcaagagctcactaccatgagaatggcacaaagccgttgatgagacatttgctcctatgacccacacagctcctactaggccctgcctcccaacaccaccacactggggatcaagtttcttctttttttttttcatacccttagggtgatgtcaggtatcagatttcaatgtgagatttggtagggacaaataaaccaatccaaaccatagcactgtcttttccctgatgtgtgttcttggtgtctttgtcaaaaaatgttctcctcatggctgtaaatgtgtggctttgtttctgagttctctatggtgttctgttggtctgtgtgccctttttttttttttttgagacggagtctcactctgttgccaggctggagtgcagtggcacaatttcagctcactgcaacctctgactccctggttcaagcgattctcctctctcagcctcctgaggagctgggattacaggcacgtgccaccacacctagctcatttttgcatttttagtagagacggggtttcaccgtgttgaccaggatggtctcgatctcctgacctcgtgatccacctgccttggcctcccaaagtgctgggattacaagcgtgagccaccgtgcctggccaagttactccagttttaaaggtagaactggagtcaatatagcctcactttggctcgcacacacttcatgatttgttagggaaatatctggaggaggtgagacttaagggatcgctaagatttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagtagtggtagcatataggatgaattgaacgggaagaaaatagggatgaggagaacagttaggaggctgctttttgaagaaaacatcttgattgagacatggttcacataccgtacagttcacccttcttcagacaaaggaggctgcttttttaaagacgaaagttccacttcaaacttcatggctgatagccacagaatgtgatatttttcccatgaagattggcaccttcttcccctgagggctctctaagcccactgcgtttctgactcctgttttttacacaggattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaagtgagttcactaaacctgtcctgtttgtgagcaaagttgggtggacgtgagtgtaatacccacttcttcctgtggttaggtagaacttttttgcataaacttggttttcttacagttttattaaacttataactccctgggtcttggagaatgtctttcctcactgttttcccttctgtccctttctgtacagcataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtgggtgtccagagtgaagggaataaatccattacgtagctgttaaccctgtcttttgtatgtcagtgctccgattttctttgcaggcattattactttatcatggtcatacttttgtttggttctactttgattcacttaattctttgttatgctgaaaaatatgacattccgttcctaaatatataagtaggcttaaatatgttacatagtcaaaataacactatctctgacaaagttaaataatactttttaaatatcatctaaccctagctagttcattttcattcttcatttgttcccaaactgtcctttatagctgttttgttgaaaacaagatctagcctaggaacatgtattatatctggctgttgtgtcccttgagtatcttttaatctagaattgtccctttcttcatgagactgacttgttaaagggatgggaccaattgcctattttatggatagttctagttgctttctcatatttgccttattcctgtaaattggaaattaaatttctaggcttgtcacgattcagttcaacatttttgatgatgtgtatttcatattgcctcatatcaataggcatataaaacccacttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagtaccttcagtaaaagttgctgaatgatgatttgttgctctgtcattcctcctgcatttattagctcatgtgtagcctttttttcttgtctatggaggaattgcttgaactgctgcctttaattctagagttagtcttaacatggaatttagaatatgtaacaggatattgagaataagtgatttctgttgcatttttgcactttgtttaaagtaactgtgcagttccaaaactggtcttgagaatatatcaaatggttgggataccctagcaatctttgttccttgaatatttaaacatgctgtgcttaatgctctttttacttgggggtctggggcaggtatctcgatgagttgatgaaactgaaggctcaggcacatgcagagaataatgaattcattacatggaatgatatccaagcttgcgtggaccatgtgaacctggtggtgcaagaggaacatgagagtgagttatcttcctgtcctccccaaataatgtcaccattaatgatgatgtgattccatgaagtggttcaaaatactactcctagaaggatttttgggtgagagattgaaaatatctatataacacaaaaggctaaagttggatattgttttgagaacaccaggcaattgctataattaggtatatgtccagtaagaactaaattttgggggaggtgaattgaacatgatctgttatttttaaatgctgttataacaagtagtcctgacactacatggaattaggttgaattgcacaggttgtaggcatggtcctccacaagactcctctcacttcagacacaagctgaaagctgcagggttcccaggccactgtacttctgaacaactggctgcaaatttggaggatcccttctacccgctcaggtttaataatttgctagaatgactcacagaactcaagaaaatgctagacttacgattaaaattttattacaaaatatgtaaatcaggatcagctgaaagaagagaatcatcaggcaatatctgtgagagtccccaatatgaagcttctgtgttctcaggatgtgtcactctcctggcacattgacgtgtatcaccaaccagggaaacacacctgagttttgggtgtccagagtttttatttgggttcgttacatatgcgtgattgatagtattggctttgcgattaaactcaattttcatttggcctctgctccctggagaatgggaggccaggctggtatcacgtgactctatacctcagtggttgatctttccagcatggccagcctccatccttaaactctcatgaggccaaccaggagtcattggttggcataaattcaggtgtgggcggaggggcccaccatgaatcacagaaacatacctatcactcaggatatcccaagggtcttagacgctcccccagagacaaagaccagccagactttttattatacagcagagtccttacaaaagcagtacggctgcctaagatacctggggagtgaacgttcctaattttaatttgtatttcctgggagaaatattcaactgacttggtgggaagagccttgcttcgcattagggagccctgcgcttggatctttcttctgccatttgtttgctgtgtaatcttggagaagagattgctaagccttgttatttcttctataaaagtgttgaattagatgactttttaagaacccttgaacctttttaagactcttcgtgaatcctttgtgactcaagaatgtttttgattacacattccagtgtacctgaaagctatacagtaaggccagtttcataaaaatcctcatcgcttttaagttagagcaattaaaaatgaaacaaaaggacttgagcattcaataggaatatgaatacaagtgagtttagttgaaataaatactaattaaaaaatgaaaacagtgctgcttaacggatggtaagttgcagtttgaatcatggttactcttaggtggatttatgattagttagcatgttccatgattgatttgtttatgtacttccttaattagaaaaaaaaaactttctgtctctttatatttagggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggtgagtggcatcggaattgttctttatgttcagagcacctcagccctcctagaacaaaggtagaggtaggaatatcttccttgattcattcagtgaatgccttctgggcacccttagattcaaagcactggagggacacaaaaatgtgagagacataggctccacctactaggagctcatgctgttttacacatttgggtttttgttcttttgtttgttgttgacagtcttttgtgtctctttcagtaaattctttactgaaatataagatccagggctgggcgcagtggctcacgccttgtaatcccacagcactttgagaggccaaggcaggcagatcccttgaggccaggagttcaagaccagcctggccaacatggtgaaacctcatctctactaaaaaaaaaaaaaaaaatacaaaaattagctgggcgtggtggtgcatgcctgtaatcccagctacttggtaggctgaggcacaggaattacttgagcctgagaggtggaggttgcagtgagccgagattgcgccactgcactccagtctgggggacagagtaagactccgtctcaaaaaaatatatatatatatatatgtgtgtgtgtgtgtatatatatatatacgtatatatataatatacgtatatatacatatatacgatccagaaaaaaaaatatatatatatgatccagaaaaatgaacaaggtagatgggtatgcaattgcataaattttcaaaaggaggcacacctgtgtatttggcagtcagattgtagaacccattaccagcaccacagagaccttcctcatatccccttccacccttagccaccctccatttggtggtaagcactattctgatttctattaataacaccacagttcatttccgtccacttttgagctgtatttaagtgggatcataccttatgtgctcttttgtgtctggcttctgttgccctaaataatgttaatgatatgcatccatgtggttgcatggagccatcctttgctcattctcattgttgtgtactatttcattgtgtggttatatgttattggtgaagttttttgttgttttgtttgttttttcagactgttgtaaatagggcttctttgttttttttttgagacggagtcttgctctgtcacccaggctagagtgcaatgacgcaatctcagctcactgcaacttctgcctcccaggttcaagcaattctcctgcctctgcctccccagtacctaggattacaggcgagagccaccatgcctggctaaaattttttttttttttttttgtattttttgtagagatggggtttcaccatgttggccagtttggtctcgaactcctgacctcaagtgatctgcccgcctcagcctcccaaagtgttgggaattacaggcatgagccactgcccatggcctgtaaatagtgcttctatgaatttttaattttggttaaaaacatatatgtgcatttctgttaggtatacattttggagaggagttatggccatagggaacacatatatgaagctttaatagataatgtcatgaaggttttttgtgacaacttaattgaaacgtaattcacgtatcaggtaattcagcgtcagtggactttagtacgttgatagaattgtgcagtcatcaccacagtcaatttttgaacatttcatcaccccaagagaaactcagtacccattagtagtcactcattttcccttaatctcccccagccctgggcaaccatcagactgctggtttgtctatgggtttgtctattctgaacatttcatataaatggagttatgcaatgtatggtcgtttgtgactggcttcttttagcttagtttatccaagctgtagcagtagcacttcatttctttttgttgctgaataatattccattgtatgactgtaccacattttatttatttattcatgagttgatgacacatggattatttccactttaccacattttatttatccattcatgagttgatgacatatgaattatttgcactttattcgtgatttgatagacacttagcatgagtgacagctatataagttgtatcttcaatctacttccctttttagatatggaagccgacctagcttattctccgaaaccccactcctctgacagtcagatataaggctccctttggactttcttagcagcaaaaacaaacattactaccactagcatacatagaatcattgcagcctgacacattagagattctgaatcagtagaattagactttaagcttaggaatctgtattttaaaaatgactttttcattgttctgatgaccagccaagtttgggaaacactaatctaataaaatgaatcaaagacagagacttccatttctagcttccctagagccaactacttcttatccgagtaagtaaaatcagttgatctcaatttcctggctatgaaatagcagttgtgattcaaccctctccacagcatcaagtgacattctgcataattatatctcttaaatgaaacctggtagtatctatcagatactacacttacatgattaggacatggtaatgtcaactactgccatgccaatgtaatcaaaggagatcagtcaacatcataatattaccaacatataaaattgcccactcctctacccttcaccaaaacttacagagcccacacgagtgtcagtgtgcaaaaagctccaatacactaaagccttggtctgtttttatacgtctggctactcagaattaaaaatttcttttagcccttccgcttgctgcctcacttcaggagtcttctgaaggctatggttctatccagttgttgttacttagtaagcactgaaaaggaggtcaatcacaattagaaaacagatgttaattatgctttaatcaacaattatttgagggcctactacatacaaggcaacttcctagacagcaacagcataaaaagaggcataaaccttgtcaatttcctcagcaaactaggtagcgggtaagacaaacattttaaaagatgagtttatgttacaattactttaacaactttatcttcatagtagcattattcctgatagccacagtggaaaaaaacagtatgtctatcaagtcaggaatagataaagtgtaaataattcaaaaggctgtgtgtgcgttttgtttgggtcatcggagtaaaactttttgaggatgtgactatagagtttgaagcatttcctttgctgtggaataacttttcagacttcatcaaaggcggaggaagtcgggggagttaaaggaaaaattgcttaacattgccaggcccagctgggtgaactacacattgggtggaattgttttttgtttgtttgtttttggtttgggttttttgttttgttttgttttgttttttgtttttggcatcacctgagcatctaagtctccatcagccatttgggagtgtttttaaaaatatttatcactgagttacaaatttagagagcaaaagatcttaatttaaatttggtctgtagttttattttcttctgatatctttgtgtttggttttggtatcagggtaatactggcctcatgacttgaagtgttccttttatattttcaaagagtttgtaaaggattagctagttctttaaacatttgttacaagtcaccagtgaggccacgtggtccggagttttttgtgtgggggatattttttgttttgttttgagctgcagtactgtgtaggaaaggggtcccgatgcagaccccaagagatggttcttggatctcacacaagaaagaattcagagagagtccatagagtgaagtggaagcaagtttattaagaaagtaaaggaataaaagaatggcttctccatagacagagcagccctgagggccgctggttgcccattttatatttcatgatgatatgctaaacaagagctttatcagatcttttctgagcatgtgcacagcccacacatgcactgtggcctcctagatcccatccaggaatatgtcaagttgtcagagctctccatgaacatctcattctccagcttttccttataaggtttttagttagtctcttgtttgcctaaactgttatccttaatgtttttgacaattgcttttggagaaaaggctgtttgcagtggatgagctcttggtcaggtcaaataaagacagccatgcgagtgtgacctctgaacaggtcagctaatgacagttctttgggaatggggctttgaagggatggtaggaggggcagattggaataggggagtttaaagcaccacagaactcactgttcttactgagtttcagctgtttttcttgaatgcattctccaatttctgcaagcctttggttaatttctaccgtattgaaaaaactggccgggtgcagtggctcatgcttgtaatcccagcacgttgggatgccaaggcgggtggatagtttgagcccaggaatttgagaccaggctgggcaagatggtaaaaccctgtcttaacgaaaaataaaaatattagctggacacggtggtgtgcacctgtggtcccaggcacttgggaggttgagatggaaggatcacttgggcctagggggctgaggttgcggtgagccaagattgcaccactgcactccagcctgagtgacaaagcaagaccctgtctttaaaaaaaaaaaaaaaaaaaaaaaagggctgggcgcagtgcctcatccctgtaatcccagcactttgggagtcccaggtgggcagatcacctgtggtcaggagttcgagaccagcctggccaacatggtgaaactccatctctactaaaaatacaaaaaattagccaggcgtggtggcaggcacctgtaatcgcagctacccaggaggctgaggcaggagaatcacttgaacccaggaggtggaggttgcaatgagcaccactgcactccagcttgggtgacaagagtgaaactccgtctcaaaaaaagaaaaactgatgctggtgattgtttgccagtgtaccaatgttttttgtttgtttgtttttcatggtggagaggattttcagaggtctttaccattttcactaatgtcacgtttctcttcattaaatttagtgtttgtgggactcttgataaaagtggattactagtcgtgagtagtacagtctgaatgcaagacatggatatcagggctcctcaagaactcattttataattaagaatatgaatgacttaggccgtgtgtggtggcttacgcctataatcccggcactttgggaggtcaaggcaggcggatcacttgaggtcaggagtttgagaccagcctggctgacatggcgaaactccatctctactaaaaatacaggtgtggtgtacacccctgtagtcccagctactcaggaggctgaggcaggaggattgcttgaacccgggagtaggaggttgcagtaagctgagatcataccactgcactccagcctgggtgacagcgaagctgcatctcaaaaaggaagaaagaataagaatgacttaaatcggctgggtgcggtggcttacacctgtaatctttgtactttgggaggctgaggcaggtggatcacgaggtcaggagatcaagaccatcttggctaacacagtgaaaccccatctctactaaaaacacaaaaaaaaaaaaaaaagaaaaaaaaaaaattagcccggcatggtggtaggcgcctgcgcctttagtcccagctactcgggaggctgaggcaggagaatggcatgaacccaggaggtggagcttgcagtgagccaagatcgggccactgcactccagtctgggcgacagagcgagactctgtctcaaaaaaaaagaatgacttaaatctctctctgacctccatgtgtgtatatgcacttatgcacacatgcttatatacatgtagctagtaatcagctggttcacaccagcacagctgtaccagttgttaggacattgaaattcttttattttgtttggtacattgttactgtcccaaccctcccatatctttgccatcactccccaactctaattgaaatcccactatatggcaactaaaccagcagtgaccataaggactctgctccatcctgattggtcagtgcttatgttgtgtagttgataaacgtgttgtacagatttgtgtatgtgtgtttatgtgtgtatgtggtatatatgtggttatatatttatatatgtaatattgggtctatcatcacacatgcaaaccaagccacatagtaagtaaagtctttttaaaaagttttgagtgatgagaagtgccctttagaggggtgtgtgagtgtgtgctttccatatatacatgtacataacatagtcattcctttgcctcttcccccttttcctgtgtttgtggcttcttcacctcttctacctccaatcattgcccactctttttttaaattctgacttctggtccctatctctttacctcttctgaaatgcaatcagcgtgtttctaagtgtcagagttgttagggagctgtgcttgaatatatcttagatagcatttttacagcaaatctgttttctctccataatatctagcctgggctttaacactctgctcagtcatttgagttaatctttaggtaatctctttaaaacaaattttaccagaaggatttgggttttgtcattttattcagtctaattggagcagaaagaacctgttctttcttcttacactgggatgaggtgtagtgtatgctgtctctctttccttcttcattctggtgaggggcttttctgtattaatgtttccctgaaacacctgagacacccatccattcactttttcttgcctttcatactattgctctattgcttatttcttaaggagtatgtatgaaaggttttactttaatctgcatggggcagggaagaaagaattctgaatgcttagaaaggttctacctttctcaatgcaagggaggttgtgctaagtctcacaactttgcttacagcagattctgctcagatatctgttgtatgattatcccagaagtgaacccaaaatggcttgattctgtggaaatgcttctgtttttatgatacgaggatttttctgctgcttctcttggagactagaccatcagccctctcgcttatgacttcacaatttaagttgtcacaagcctgcagctgactcattgtattgtctcacattggaactattgtctagtatttccagtagttattcttaggactctaggggatggtgtgtggtcattttctattttcagtaatagaaagcgactagtggtaggaaggtactaggttctgcagcttttaagtgatttatttgttcttgcattctatttatctgtttactctttccctttcccaagactgtgagcttcttaaaattgggacagtgcctcttagaattgtaaggccagcacctaccataattaggttaaatgatctttctaaaagactgcatttaagagaaatcactgctttcaatttcagatgctttcctttggccttatcctgtcacctgcactctttataaattgcagggattgtggctgcttcactatatggagtgaaatgttgtgtctttctctaataaaacaggaggaaagccaagccttccctaaggttttgtgacttcaactgttgggcagtgaaacgtttcactttgcctcaaagctcagaccctgcctcatttaggcacatagttatggtgatttactaagttctttattctgcctcattcatgccttggcaaattatattcacatcgagcaatctaaatgaatttttgagctgctatttataccaactgctgttagctcaagcctcaggagtatgttaattttgttgggtctgcgtagatcaccacaaacatgactctcacaacctggccactttaaaacctgaagtgccttgtcttttctagagaagattgccccagtaatctgctgaattgatgctctctgtaaagaccttacaggcatcttaataaagaacccccactcttttgagatcgttgaaacctacataacctcagtatgaccatggaaatctaatggggtatcagcagtggtttctgattctatcacactgagagtaggtagaagtagaatcctattgtgctaactctcagtaacagtagtgactacctggggctaatccataagctacttccccaaattgaaatatggcagccacattcttgaaaattggaagataacggccaggcgcagtggctcacacctgtaatcccagcactatgggaggccaggacgtgcagatcacaaggtcaggagattgagaccatcctggctaacatggtgaaaccccgtctctactaaaaaaatacaaaaaattagctgggcgtggtggcgggtgcacgtagtcccagctactcgggaggctgaggcaggagaatggcgtgaacctggaaggcagagcttgcagtgagccgagatcacgccactgcactccagtctgagtgacagagcgagactctgtctcaaaaaaaaaaaaaattggaagatattagaggaaggtatttctactaatctaattctgtttaaaatgccattcagagcaaatggtcaccaataagcgcctttaaaaaagaaacttgtcttaacgaatttaggaagaggaaagtaagtcacctccactacatcatacatcatctctatccacaatagtcaactcagactatgctgtgaggcttttgttagctgtactaaggaaagtaatcacaacattcattatatttctgtgtgaaaatttgcttttaagttcccagcaactgatttaacattcaagttttaggatatcagctagtgagaaatgtagattgcctgtagtgacttctggctttaaatgtgatgagtcaaagattctggttaaagtaagacttgacagtcttaaaaacattagtagtcatagagaacgttaacttcctctgaacattgttggcaaaggaggctttcaaataagtactgcatattcatatatataccctggcccttgtcaccctgttaaagtctctggaccccttcccagtctgtctgggcctcttgccccttctagctgttcacaacttcctgaaccacttaaattcatctttatataatcttcacctacatgtgagccatttcccttatcttatgacctttaccagtttgtttgtttttggagaccggtctatactcttgactggagtgcagtggtaagaacatggctcactgcagcctaacctcctgggctcaagcaatcctgcctcagcctccctagtagctgggactataggcgtgcaccaccatgcctggccaagctatgtttgtttgtttgtttgtttgtttgtttgtttgtttttagagagacggggtctcactatgttgcccaggctggtctcgagctcctgggctcaagcattccttctgcctcagcgcccccaaagtgttggattacaggtgtgagtcactgcatccaactttttaccagttttttgatgcctccttcttccatttgactaacccacgtgtctcatattttttaagcctgttcttccatatttaattgagtctaggaagcccccttcttcacatgtatgttacatgtaccctgatttcatgactttaatattttgcttttaatgatatgtaggaaatccaggatgagtcagctgtgttatggttggatgaaattcaaggtggaatctggcagtccaacaaagacacccaagaagcacagaagtgtatgtatcacctgttttatttctgttttggtggaggctggggtgacaaggtgctccgtacagcttgaccaagataggtatgggggaacaatttgccagtagatatagttaggtgaagcagtatgtgaatttagacactctctaaactattctggtaacagttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagaccttttagcatagatgtacagtacttaggctcattttaaaggagataaaatccctatttttgaaaatatccttccccccccccttgtggacagctgtgttaataaggccaattttctgagaatgtgggaaagattaaaatatttaactgtttatctttcacagagtagcagtagctctgattaagcctataggcaattaaaagtagtttgtctgtaaaaagagggaaagaaataagatttcttaccccattttatggacttttaaaaattaaaaaactgggccgggtgcggtggcacacgcctgtaatcccagcactttgggaggctgaggcgggcagatcgcctgaggtcaggagttcaagactagcctggccaacatggtaaaaccctgtctctactaaaaatacaaaaattagctgagtgtggtggcgtgtgcctgtaatcccagctacccgggaggctggggccggagaatcgcctgaacccgggaggcagaggctgccgtgagccaagatcatgccactgcattccagcctgggcaacagagcaagactctgtctgaaaaaaaaaataataataataaattgaaaaactggagaggctgaatggttgcacattttttaagacagacaggccttaaactttggctttggagtgaacaaagttaatcatggttaattccataattggacttcataggtattttcttcttatagacataaatgagctaaattagtcattacaaagccataatttaatgggagcttagcatgcccctttactctcacagatccaaggagcagcttttggagtggtcttcatttagactgtgagactaactaataatcctgcagttctggacgtacagctggggagtgtggctctggatgtcttctatctttcctttattttctgccaggagataataacagcaagtgggtgaagcactgggtaaaaggtggatattattattaccacaatctggagacccaggaaggaggatgggatgaacctccaaattttgtgcaaaattctatgcagctttctcgggaggagatccaggtaggttacctttcttcacgtaagaagaagctgagagaaagtgttttcaagctataatattaattaagaggaacagggcatgtggtcagaagccctagactaaaattgaggttatgtaatgagctgttttgcggtaatttttttgtagtagttgggggagtgactgaggcctgaatttgtaaaacatctgaattatagaattaagtgatataaaccatatgctaagaaaagttagatgatctataaaagaaaaatgaaaagttgctaactccattaaatgcaactattttaatctctcccagtttatattttcagtctctcttctaactgttccacaaattatattagctacaacctgcactttcaaataaagttagcattttcatagagcttttaaagtactttttcatcttctgtgtctttgtgtctttgcttatactgttccattcaacagtttttgtttgtttgtttgtttgttttttgttttttttttgaaacagagtctcactgtgtcacctaggctggagtgcagtggtgcattctcggctcactgcaacctccacctccctgggttcaagcgattcttctgcctcagcctcccgaatacctgggattacaggcatgcaccacacctggctaattttgtaattttagtagagacgaggttttgccctgttggccaggctggtcttgaactcctggcctcaagtggtccacccgcctcagcctcccaaagtactgggattacaggcgtgagccagcacacccagcccattcaacagttatttgttgaatacctcaaatgtagcaggtactcttctaaggaatggggatatagtcatgaaccaaacaaagtctctgctgtcatgagatgtctctcccctgccatctatatctgtcaaaattctttccttccctttgtactgattgttggtatcataaaagaaaaaaattcaggctgggcatggtggctcacacctgtaatcccagcactttgagaggctaaggcaaaaagactgcttgagcccaggagttcaagacaagcctgggcaacatggtgaaacctcatctctgcaaaaaatacaaaaattagctgggcatagtggtgtgtgtctgtgattccagctacttgggaggatgaggcagaaggatcacttgagcccgggaggtcaaggctgtaacgagccatgatcacagcagtgcactccagcctgggcaacagagcaagaccctgtctcaaaaaaaggaatatttaatttaaaaattcagtcctccaagcacacccatctcaagtcacctcctctatgaatctttttaaaatttcctttccttacccccttcatcttcctttgaagctcccaaagaacttggtattcattcagaatttaatgtacttggattcgaattttagtgacatttgtgcttgtctatgccccctagtagtttttaaggtgagctgctaagtttgcagtactttctcaaaggggaagttacattgtcattgatggactgttgaggacttttaagttttaacttggtgctgcactcctgttacttaaaccagagttgtttaatgaatgttaaaggggaggaatatatactgggggaagatgctcagtaagctcctgtaggtcgttagacatattactaacagacattcaggattcctagagaaaaacgacagtaaaagattttcaaaaggtcatttacttccctttggcaatatttcccaaatcgtgtgtggaacaagtcaaaaatacacctgtggaaaaactgaaatagtccctttatttaggagttaacatcagatgggtgatttctaccttgtggttaaagttctctttatatggtgggttacagtctcttacccttccagtgtttcatcttcattgctaatgatttcacaggtgatgaaatttaaattcattgaactctgttctgggcattgagaagacagaaatatgtatcagagagtctctaccttccattgtttcacagtgttgtgaaaacagcagacacaaaaccgagtactgtaatgtaaggcagagagaagtggtgctctaatcacagcacaataagggaagtcttaagggaatttttcattttgtcctggagtaacatagcgtagataatattttagcagctgaggaaaaaaagaaaaggctgttctagacagaaagggaaagttaaggatgagcttgctgaaattataaaaaggaagtaggagagaaaatagaaaaggaaaaagcacagagtactgaaaggacatggaccactgaaggagaggcgaatggtgtattacctggcacgtggtaggagtggcaggacaagaggcccaggttgaagcttgagggcctaatgtgctgtgctaaggaattcagggtacaacttctagcagagtgatttttaactcttgttagttcagggacacctttgagaatcttattaacctccacagaaacactcatgtttgaatagtgttttgcatatatggacctaagaatttaaacagggaagggatgctacctcattttcagcatgtgacctgacctcttacctctcctgccaacaatagtggcgatcacatatagatcctcccactctactcaccactctgtactttgaacttacttggattttcactgattccttcttcattttctctctggaggaaacagctatcctttctaaagctcattattgatcttactgcttgatttcatcctctcccagttccttgcagaccttgtactttttgtgctcttcctccagtgcttgtcaggatttaatgtctgtctgaatcacctgggatcttgttaaaatgaaggctctgattctagtgcgaggtctgagaaaatctgtttctgacaagctttcaggtgatgttgatgctgctggcccaaggactgtattttaagtagcagcctacatacttaagcatctttatttcccacatctttgaaaaaataataatacaaaatttttttaaagcccatggaatttccctgatctggcctcacctacattcatactcttgctaagggccttgaaagttagtctactcgtcactaattcactctctgttaccatccacttcttggctcacagcagtgtggtttcctgtccagcttttacttagtaaaactcttattttagaattcatcaataaccttttaattgccaaattcaattctgagcactcatcatatttgacttgtcaaaagtctcttcctcaaaccctcaattcctttggcttctgccatccaactctcttctaattttcctgcttctaaatgttccttcttaatctctcttgctaccttcctttctcgacctctgcttgaattatacaaagagtccattggctgccttctcctacacattcttcctgagtgatctctttcaagcctgtggctctagcccttacccttgtgcttgtgactcctaaatctgtacctccagacgttagcccttttccccaccaccaggtttttgcccttcattttgcagtccagaagtccagcagacacctcaaacacagtttaacaggaaaaaaccagaggctgcaatagtgtataaggttgtatttttatctcacatgaaatgattctgcagttcagcagtccagggaaaatgtggcttcatggtatcatctgtcccaggatccttcatctttgtgctctgtcattcttagcatgtggcttccattctcaaggtcaccttgtcacctataatgacagtttggagctttgaccatcaagttagcagtccaagcaggaagtaggaagaaggggaaggagagcaaaaaaggtgtactgtcagctgtctgtttctctcaaggagctttctcaaaggtcttgccatactactactgctcacagcgcatgacctcgctctacctcatgaagtcttttttttttttttgaagcggagtttcgctcttgttgcccaggctggaatgcaatggcgcgatcttggctcaccacagcttccgcctcccaggttcaagcgattctcctgcctcagcctccccagtagctgggattacaggcatgcgccaccacacctggctaatttttgtatttttagtagagatggggtttctccatgttggtcaggctggtctcgaactcctgacctcaggtgatccacccacctcagcctcccaaagtgctgggattacaggcgtgagccaccacgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttgttcaagcccaggccatctgtcacttggatcacaatagcagcattgtaattcacccacttggttgaagtctcttctcactctaatctgtcagctgctttcctaacagtattgtttttctaaaaataatctccaccctgggcaatataatgaggactcacctctacaaaaaatattttttaaaaaattaaaattagccaggtatggtggtacacttgtagccccagctactcaggaggtgaggtgggaggattgcttgagcccaggagtttgaggctgcagcgagctgagattgtaccactgcactccagcctggatgacagaatgaaaccttgtctctaaagtaaataataaacatctgattgttttattcctttgcttgacaaaatttcctggctgtccagtatctttagtaacagtccaaaccctctaggctacttttcaagaccatttgcaatctgcctggagaagcaattttcagtcctcacctctggtctctccccctgagatgtcctgcattgtgacattctaggggtccctcggtacgtggcacacagccctgttgggtacctgtcactctgttcttgtctacagtgaccccagatcagccagcacagtgcccagcctagtcagtgttggataggtagataagtgagatgacatatgaagtaaaagaagatcaagtttttgtttatgaagtgttttctaggtgggaggacgtgtgtgagaacaacctagtcctaaaaaacagacctgagggctttattcctgttatgtagctaatgatctagtatagacttaggaagcaggaggtgttagcttgtgtgctgtggatgatacttcgtgaaaacctgcatccattcttgcctgtgaatgtctttgaatgtgaccactgctttttcagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtcaccattgactgtctgagtgtgttttttgagtgctggactcttagtcttctctttcctttgacaggtacctcctctttactaccatttaactgtagtgtgcctacaggtgtttaatgctggcacagtggcagttcttgggtacctcttcctctcttcttctaagactgtacctttctgtaagatttgaaccttgagggaaacaactgtggtctggcttcaatgataaggtagcacaatgtcctggaaagaattctgagttaggaatgatggctgcactactgccagacagtggtgaatctccaagtctttgtccccatctgtaaaaggggaatgccccattgtatcttatcttcctcacctggtttgttgtaagaagccagtaaatgaatctgtatggctgcactgtaaaaggtgtgcagggctgtgctgacgttggggaagtagaatgtagccatcgtgttcttccagtggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatgtaagcacccttggatcatacaggccattaggggcaattttgccatatttttggtagacagatgaacagagaaatttcttcttttttgttccttagataaatgacattatcaaaatccaggcttttattcgggcaaacaaagctcgggatgactacaagactctcagtgagtaactggctccgcatgaagagttgaggcagtggctgggagccaccaagttcagggtattctccacagacctcttttgttatcctgaaggcaaggcttgggggagagggtgtgacctgtgacataagcccctttgctaacatgtggctaggtgtcttgttggcttgttgcattaacctttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctaagtatctgggattacaggcacgtgacactatacctggctaatgttttttgatttttggctttttttttttttttttttttgctgacggagtttccctctcgtcgctcaggctggagtgcagtggcgtgatctcggctcactgcaacctctgcctcgcaggttcagcgattctcctgcctcagcctcccaagtagctgggattacaggcgcatgccactacaccctggtaatttttgtatttttactggagatggcgtttcgccatgttgaccaggctggtcttgaagtcctgacctcgggtgatccacccgcctcagcctcccaaagtgctgggattacaggcgtgagccacgacacccggcttttttgcatttttagtagagacgggggtttcaccatgttggccaggctggtctggaactcctggcctcaagtgattgatccactcaccttggcttcccaaagtgctgggattacaaacatgagccaccatgcccggccatcataagcttttaaaaaagttatgtaagacaggtcaggcatgatggctcacacctataatcccagcactttgggaggccgagaagggcggatcacttgaagccaggagtttgagaccagccaggccaacatggtgaaaccctgtctctactaaaaattaaaaaaaattagctggacatggtagtacatgcctgtaatttcagctactcaggaggctgaggtggaagaatcgcttgaacctgggaggcagaggttgcagtgagccaagattgcatgactgcactccggactgggtgacagagtgaaactctatctccaaaaaaaaaaaaaaaaaaaaaattatttaagacataaaacaacttaattgacaaaattttgatagagaaaagaagataaatgtcttcccctaatttcacctaccccagtcattttgtatcttacattcttacttcatattaaaggataagactctttccctatgataagtagtcataatttttttttaattttattttttgaaacagagtttccctctgtaccccaggctggagtgcagtggcatgatcatgactcactgcaacctcgacctcctaggctcaagtgattctcccacttcagcctctcaagtagctaggacgacaggtgcatgccaccacgtctggcaaattatatttttataagagatagggtatctttgtattgcccaggctggtctcaaaactcctgggctcaggtgatcctcctgcctcagcctcccaaagtgctgggattacaggtgtgagccgctgcacccagccataaatattatttttaacagtagcatattagatttttagaagatatactatgatttacctctttttcccctagtatttgacatttaggttgttttccaagcgtttattataaataacattgcaattaatgtttcaatatatatgtagcttttattgtatttaagacttatttttataatagactgctggaagttggtttgccaattcagtggacattcttatggctcagattctttgttggaacataggaatggatttgactggtgtactgaaaacaggataaagtgtagtggtttttaaatattcagtgggaatctgccagtgcagtacaccttcatgtgagtttgcacatgctgcaaaacctttcctcaatgcccagaggttcatctttgaaagctttctgatctatttattggtttttgtttataggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaagtaagtggctcctggaatcagtgttataaaaatttagtgaatttatttttccacaagaaagccttaccatcgatctctctggaagtatttttgacttccactgaggggtgagtgaggggcactgtaacatgttaatttattaatcttttttctcatatgtattgtagtccttcaattttaaataattgaatatatcttgccagcctttatattacctacaaatgacttatcccttggttttatttcagaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtatgaacagatttcctcagggcacaggccccttcccactatcagaggggctcccagtttgagattcatgccttcctgatcttttcttgatctcaattaatttatgaaaaatacttactctaaagaagcatctaatttttaaataactgatataaaatcttgctgcttctagggaagggataaattaactttaggaacattctgtattaaggtataatttcaaaaagtaatctgaacagaaagaattcacatttttatctagtagcggacccaatcatgaccacgattgagcgtgcagctgcaggaacattctgtgagtgctggggaatgtttcgagagaaactgtttcagggagataggatctttaagcaggaaggatcttttaagttgatgggttttgtgacaagtttaaatttttatctgatgttttataggtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaaggtatgttaaccataatgacacttttctttcatgttgttatagtctttccctcttttttcccctctctttatttataaactaatattagttcaaatagtttttcttttcttttctttttttagacagagtttcactcttgtcgtccaggctggagtacagtggcataatctcagctcactgcagcctccacctcccaggtctaagcaattctcatgccccagcctcccgagtagctgggattacagttgcacgctaccacacctgtctgatttttgtatttttagtaagactgggtttcaccatgttggccagactggtctcgaactcctgacctcaggcaatccatctgcctcggcctcccaaagtgctgtgattacagctgtgagccaccacacccagcctcaaatagtttttctttagaaaactgtgctttctaagttgttgacctagtaataaattcacttatttagcaaatatttattgagtattaactatgtgccaggcattgtgttagagatgtgtacagtaatgcaataatgagtgaaacagacatgcttcctgccctctcttcatagttcattgggtggaagagacaccaaccaggtacataaaaataaaagcataattaaacattgaagaaagttttatgaagttttatgtacggttctttaatggagactttataagagggagctaacataaggtggttagggaaagcctatcccggaagataaaatttcatttagctgaggccctaaagctaagatgaacccagccttactaagagctaggtgcagagtgtttatgtctgaacactctaagctggagggtgtaggacttaaatggaccctggcataactagggatacagttgaatgagaaggttcatatagattgggtgagatcactgtgtttcattaaaggaaaaagaaaacggtgtggagtgagcttccctgaaatatcgtgagttgggctaattaaattaacgtattacaggagatagctgagctagggccatagcgtaaccaccaacattcatttatctaaagcaaaagtgtgccaatcaaatattggtaatgctgggaaaagggagttcagaatgccaaaacgtttctggttttatttgtcttgggtgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctgggtggagaacggaacattctgctgactccttgaaagggcttatctcaccagccatggtagctcacgactgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggttgaggctgcagtgtgccttgatggcgccactgcactccatcctggttgacaaaaaaagaaagaaggggcgtttccttattaggaatcatttggcatctgattggttctcagtaccatgtaggtctgttatcaggactcagatcattgcaaaagtctttttaatttttttgcctgcatacctgaggcccacatccaggaatgtggtcagccaagtgcaatacttgtctgggaagttttgcctgcaacccagggcattccttgccgatagccccatgtacactggctccgggcttctcagttatttcctctgatggtccatgagtcagtcattttcagatccaaagcccgctggacatttcaggattggttttcttgtgggtacctataagaaactggtgtcttattttgcctttcataaaatggaaattgagccaggcatggtggcatgcaccagtagtcccagttgctcaggaggccaagacaggaagatcgcttgagcccaggagtttgagcactgcctgggcaatgtagaccccatatcttaaaaaaaaaaaaaaaaaaaaaggaaattgatttgaactctttttaagataccagtgactgtgagggatggtggtgtggtggggatctgtcctgcaggtaagcatcacaggtcccttagctttcttcttttacttcagccaccatacacgtagcaaactggaatcttgtcacctcttgggaatgttctttcctaaaatctcaaagttaatgttctgttctatcaccaacgttttttagcatattgattcccttgctggttactacttttaaaactcatataaataataaaatatacaatattctttattgttaagttccatgtatttatttatttctcatagaatgtttctgttgatttttgcagaatttttgtgttcatagtctaccaattttaatttagccatgctatgacaaatgaagaggggtatccctatctacttgtatttttctttttgttgttgtggttgagacagagtctcgttctgttggtcaggctggagtgcaatggtgtaatctcagctcactgcaacctctgcctccctggttcaagcgattctgctgcctcagcctcccgaatagctgggattacaggcatgcgccacacgcctggctaatttttgtatttatagtaaagatggggtttctccatgttggccaggctggtctcaaactcctgacctcaggtgatccacccgcctcggcctcccaaagtgctaggatgacaggcgtgagccaccacacccggcctctacttgtattttctaaggctgccataacaaatcacctcaaattgggtggcttaaaacaaccgaaagtcatggtctcacaattgtggaggccagaaatttgaaaccattatcatgaagtcgaggtgctggaagagccacgctccctgcagaggctctagtggaaactctgtttcttgactcttagagcttgtggtgactgttgacatccctcaacttgtggctgtgtggttccagcctctgcctttgtggtcacattgccttctcttccccttctgtgtgtaccaaagctctctctgcctcttttttttttttttttttttttttttaagacaaggtcttgctcaagcagtcctcccacctcagccttcctagtagctgggaatgctagcatgtgctgctgtgcctggcatagcactcctatccttgaagacctccttctggtttctaacaaagtccagatttgtcagtatcatatacggggtctgtcatggcctgctccctgtctgcttttccactgtcatttctcctgtctccccttccttcctagaagactcttcctctccttttttcctgagttcaagcatcccttcgttttggaagctttccttgctttttccattctgagttgaagccctttccctatggtcctgtggcacttttggtgaactgatttacagcacaataggtttataatcatctgtttgtgtgtcgctcccaccagactgtaaaagactgaagagaaggtgtcatgtcttgtataacttttattcccaagtgcctgttattgtgcctggcacacaattcaggcacctgattcacagttaaaaacctgcgttcagattctagacttatcacttaccagccccgtgaggatgagcttaagctatctaatatttctgggtcttatagtttatgaaagataagacacttgcttcaggctgttcctggctgttagtctaacatagttgggtataatttctgtcttcccagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccgtgagtgccatcagttgtcatgacccccagtagaacccagcactaagtgcctttctgctccttggcccttctcactaagttttgtccatcccgcagttatgggatgcgcttcattgccaaagtgctgaaggactcgttgcatgagaagttccctgatgctggtgaggatgagctgctgaaggtaagaatctcatagccggcagactcctgccctttgaggacaaagcaataaaaccagggctgaccatagatcattactaactgcctaagtgtaggttctggcagtagcttaccattgattgtgagcttttgaaagcaattgtaattggtaaatggtacctctcttaggatgaaacacttcctatagtttggcacacaaacatcaaacaagtagaaagatggatttttcctgttttcagatgagtttctttgagtcctatcttttcgctgtagtattgttccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaattttatttcttctgaatgaaactctaggggaaatgctgtgactgcccctgaattcttctgtggaagagatgtgtgttaagtgaatttaatttcagaggcatgaacttggcctttgaagtctgcagcatgagaatgttgggaggtggggttactctatgctgattgggtcatgttaaggaatttagctatgtttgttagctttttataaggaaagcccatctacatgaaagtacaaagtgcatgtgggtgacagcagccttatttgctaccatgatatgtgaacaaaagatgccctgaaatacttaataacagactttaagtgtgtcatttttaccttctgaatctgctctttcattaactactggcagtagttttcagttctgttctcattgttttcctgtattgaacaaagggatatttcatttagttccaggccatgagagagagtgtgtatatgtgcatgcatgcgtgtgtatatgtattttttatttattttttcctcataggactgcattttctgcttttctttgctagcaaagtcatttatagcttccttggtggtatgtcttttaatacccatctttctgtttcgtctgttccagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcaggtaaggggaaaggcacaagtgcttaagagagtctgtggatgtatttttattgttgaggggaaaaataagattaaaaaccacctctcactttccccggactgccatatgtagaagacgtgtttgatgtgcccaggattccagaagatgatccatttactttgaagagaattttcatatgaaatagatagtagttaacacttatgaaatagatagtagttaacataaaaataatgatgattatgcatttagtacatgttaccttgtaatcagagaagaattggagaatgcttttaatttttgtaaattaacatctagttttgaattcagtgcttcagagcactgtcttagagatagaattggttctcctaatggtgtctggaaacttttaagtcatggtgcaatggttcttatgggtaaaactaaaactacaaactaggtggagaaagaagttattcgaaccactatcccaaggttgtcaagcacagcaaacacacagcactttctcttgaagtaactgttgactggcttctgtttgcactcattgtgtgagaggtttgtgaaatgtcctcttgccaacttcatgtgtatgtccctttttggggggctgcctcctgtgcttatttcagacggtttttccaaactgcttgtgatgtcccagagcttcaggataaatttaatgtggatgagtactctgatttagtaaccctcaccaaaccagtaatctacatttccattggtgaaatcatcaacacccacactgtaagtatttttctttaattacttaatttcattgtccttaattattatccctggctgctgcttatcatctctggtagccaggtgtctaaccttcctgtaatctaactgacaatgcatctccttgatgtctctttttttgcttgttattcttttttgtttatttatttattttttgagacagagtctcactgtgttgcccaggctggagtgcagtggcgcgatctcggctcactgcaagctccacctcctgggttcacaccattctcctgcctcagcctcccgagtagctgggactacaggcacccgccaccgtgcctggctaaattttttgaatttttggtagagacggggtttcactgtgttagccagcatggtgtcgatatcctgacctcatgatctgcccacctcggcccccaaaagtgctgggattacaggcgtgagccaccacgcctggccttttgcttgttattcttaacagtatctactgctaagtttctaaaaggtcttcccaggccacctgcatcagaatcctatgggctgatagttaaaaatgaagtttcctggacaccgccccaggcctactgaatcaaaatcccactaaatttatctattgccttaataaaatagtgcttttactcttctttctttttaccctagctctctgcgttatttttctaacatgatctagaatactagctttctctgtgtagccttggagtggatttttcccttggaagctggagctccatgtttcttcagatttttcaaatcattttttcccctctggggacatggacatgtaaaacaggaacaagggcatatgttaaaatgtaaatgaaatttcaggttactgtcatttctgagggcatcactggggataatggcaccttgaagactttgttgagtgcccctacaataattataacattgatttggtatacttttctctgaattaaatcatgtcatacactggaaacattaagtaaaagcgtgcacgtgacttatttgaactggcagtagggtacattgatgactttgggtattgaactttgagtttcagtgttttgtgggttttttgtgtttgtttgttttgttttgtttttttgagatggagtcttgctctgtcactcaggctggagtgcaatggcgcaatcttggctcactgcaacctccacctactgggttcaagcaattcttctgcatcagcctccctagtagctgggattacaggcacacaccagcacgcccagctaatttttgtatttttagtagagacagggtttcatcatgttgtccaggctggtcttgaacgcctgacctcaggtgatccacccgccttggcttcccaaaatgctagaattacagacgtgagccactgcacccagccagtgttctttctcaaacagggcacatttgaatcctttatggccatgaggttaagagaataccagtatttcctcttcttatatcataacataagtcattcaacagagcctggtgtggtgccttatatatcatattgtttatttgggttagtttgctgaggatttgcttgttgtttctttgaatataggaactttgttggaacctctttgtgcagatcattgttagacattctagggagggacgggctgaagagttgaatgtataaatggagttgatcattggtgtttgcagctcctgttggatcaccaggatgccattgctccggagcacaatgatccaatccacgaactgctggacgacctcggcgaggtgcccaccatcgagtccctgataggtagagttctaacttttgcctggaagatcaaaagggaatgtgacagaaaagtgttgtaattgtcacctcctctattttttgcactataccaaactctggatatacattgagaaataaaatagatgtgatcctgatagtttcataagagagaaaacaacaacaacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagtacagtggtgcagtcatagctcactgcagcctcaaattcctaggctcaagtgatcctcctgagttgttttttttttttttaatagagatggagtctcactatgttgcccaggctggtctcgaactcctggcctcaagccatcctcctcctttagccttccaaagtgctgggattgcaggactgagccactgcacccagccagaaagaatgttttcagagagaattgtgatattgtagtgttgaaatgatttctcaaacatttatggagttattatggatcccttgcctttatcatttggcataacattttatttctcagtaaaagttgttctcgtcacactgtatgtgttaggtgattcaagtattatcttagacttgcatcatcttatatttgtattatttccccccaatatctcctctctttattacgctgactctttccaccctcccaaaacttcaggggaaagctctggcaatttaaatgacccaaataaggaggcactggctaagacggaagtgtctctcaccctgaccaacaagttcgacgtgcctggagatgagaatgcagaaatggatgctcgaaccatcttactgaagtgagtatcaaaagaaggaagaatgaaatgaatgtaatctgaaggtttcttggcctttggagaggaacctgctgggtcctacctgaaatgaccatcctgacctctcgtacttgtcataatcccagtcaccaatcacctcgcatattgtacttggtacaggacttatctgccttattttgctaatatgctacagtgaaatgtaaatcttggaaatcctaaccctcgtacctacttatggaatggctgggtaaataagccttgtgccttgagtactgtgtactggcagctgccgcttgggacttctgtgaggtactgtttgtgctgctgctgctgctgctgcttcggtccacttgagaggaactagaacactggtaatatttaaatgcctcccccatctcgtttcagtacaaaacgtttaattgtggatgtcatccggttccagccaggagagaccttgactgaaatcctagaaacaccagccaccagtgaacaggtaaaatttagggtctaacatactcctttgtttggtagataagctctcccgataggcgcatgtcagagaaaggaggggagacacaaataacagttggtagcctaggggtgagcatgaatgtaactgggggacagtggtagttatggctcgtctgagaaagtttttgcttcctgagtccaggtgatgtcctttggacaggaagctcactggcacttgcatgcagaatcattgtgcccatcccgtatatccatcccttggtatccacaggcgattctttccagcacccattctccccacccccggccaataccaaaatccatagatgttgaagtcccttatataaaatggtgtagtatttggccgggcatggtggctcatgcctgtaatcccagcactttgggaggctgaggtgggtagttcacgaggtcaggagattgtgaccatcctggctaacacgtgaaaccccgtctctactaaaaatacaaaaaattagccaggctaggtggtagatgcctgtagtcccagctacttgggaggctgaggcaggagaatggcatgtacccaggaggcggagcctgcattgagccaagatcgcaccactgcactccagcctgggcgacagagcgagactccgtctcaaaaaataataataaataaataaataaataaataaataaataaaatgttgtagtatttgcatatacttacgttctcccatatactttaaatcatctctagactacttataatacctactacaatataaatgctgtgtaaatagttgttactgtatttttaaaatttgtattattttgtattgttgtatttttttttcaaacagtttcagggttggttgaaaccatgaatgtgtagggttcactgcaatttattgaatattatatattttgaattctgttacatgccttggtagatagaagaaaagtacagaatgtggctcctaaactcagtgaacccatggtcttgttggggaaatgtgacatatatacctgaaacagtgatgaactgtttcaaaattaactatgttactgactgaaaaataagagaagtttcaggaaagaggccagtgaagcagtgcattaggaagcttcctaaaagaagtggaaccggagccagatgtataaaggtggaaaggatttgggtgtgcatgtaagacaagagagggcattcgaggcaggagagcgatgtgaacaaaggtacaaaggagggaagagcatgatgcgactagactacatgtctagaatggagctgtgggtggaggtgagtagtgagaaataaaacatgagaccaaattatttagaactcacaaactagatgggaatttgtcactgcagagataaggaataaagagcctctgtaaggttgaagaccatttaataaaagttaattaattcagcagtgctattagagcagatgtagttgagtcatataggtgtgtgataaggtccagtggggtgggcagatggttgggtcctggcattttgtagggttggatgagtcatgtcatatctaagacccttgtttcttttttttttttttttttaatttgagacagagtctcactctcactcaggctggactgcagtggcgtgatcttggctcactgcaacctccgcctcctgggttcaagcgattctcctgcctcagcctcccgagtagctggactacaggtgtgaaccaccacacctggctaatttttgtatttttagtagagacaggatttcacgatgttggccaggctggtctcaaactcttgacctcaaatgacccacccactgtggcctctcaaagtgctgggattacaggtgtgagccactgcacccggccatagacctctgttctcatttgtcaagtaaggaaagtaggtcaagtcattcattctcaaattttaagcatggtaatctgtttcattaaatgacaacttagctaaaagcccagtatatagagcaggtactctgctactctggagctactctgatagccagcaatagggcatctgaaatccagccctataggactctgtgatgcctctggcaaactcttgaggctgcacagagaactatttggaaaccattgttttcaatgaagtctcagctgtcagttgctatgactgattactgattagatatgtgtgaaaggcaagtaaggacatgtaaaccaatacttgaaacatgttgaacctagaaagaaatttgaaataaggaaggaggagccagtctttattgagaacctagtatgtgtttggtgctctcacctctgttctttaatttaatccttacaatattcccatgagtcgagtcttttcatccttattttgcagatgaggaaaccaagacccttacaggttaactggctaagatcatcagcttgcagtgacagaaccggaggtggatccagttctgtctgcctccaaagcttatgctgtttacattatgtgatgcagagtagtcttgacattagaaaaaaggggactattgggaaagggaattgctccagttagggggaattacaagtttgaactatgagccatcccgaatgtaaacatcccagtacaaacagctcagaatatggcaccagagccatggtcacaaagatttaggatctgtcaacacagaggcagtcaatgaagtattgagagtaaacagagagaaatggtcacagatcacatagaagtaccaaaccatgcatagagcaagaagacagtgcagagaagatgagcaaggtgacagaaaaggctttggattttggacaggggaatggtaattggtgataagagcagtaaagaagaaagtgctgaaagaacgaaacagtgagtgtagatcatatgttggacagggacagacaatggacggtgactatgaaggatggcgactatgaaggatggcagtatcaagggaaggtgtttccctgttagattgtggtgtctgcagaatgtttgaaagcagaggcaaggctcgagcatgattccaccttgtgacaaagtgacacaaagaattagcaaggatttactaagcactggtcttgttgtattagtatagttataacatttatacagctatgtttttaataaaattaaatggcttccatgtctcaaaatgtggtagagaaaaatgactttgtagccagtagagtccagtctcggtgattgtacctggagtccaggaaagaagccctaagcacctaagcagttgtgtgatttgtttgtttgcttgttttttgtttttttgagacggagtctcgctctgtcgcccagactggagtgcagtggcgcgatcttggctcactgcaagctccacctcctgggttcacgccattctcctgcctcagcctcctgagtagctgggactacaggcactcgccccatgctcggctaattttgtttttgtacttttagtagagacggtttcaccgtgttagtcaggatggtcttgaactcctgacctcatgatccgcctaccttggcctcccaaagtgctgggattacaggcatgagccaccgcgcctagcccagttgtgtgattttgtagatatcatctcttctaggtggaaagagatgtgcctctgcttcatgcaatttttcatctatcatttggcagggggcagaatttgtttccttctgtttcaaggttggagtttaagaactgtataagttcaggtgcaaatgtgctatataaattcaagtttaggattagtgtggtaaacttgctaagaacttctttttcccatccgtaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccagcatgagggccttgcccgacctgaggtggcttattccatggcctaaattactagggagaggaccttaactggagcctcctatgaccttaaagaatttgtcttcagccttaaagaattcttccagatctttttcatgattactgtgaaatataaattcacatcaagctgattaaatcgttgatttgtatgaatcatctcaagcgaggggctttggtgaggactaagagtttaggtgttctgtgctgttgcactaagataatattatgcacacctgagaactggtagttgatgtattatagttctctttttctccctttcccaacaaaatatttaagaggtccaaaccagctttgcaagtaaattctaaaaatgtgtaagtctaaatgtaacacatttccctgctagaagatacaaatgggggaagaaaatttgagatctgaatttctctgttaatttgtgaaaacaaattactgcctgttgaatgtatggttaggtcaggcaccgtggctcacatctggaatctcagcactttctgagaccaaggcaggaggatcgcttgagaccccatctctacaaaaaaaagttttttaattagccagatgtggtggcatgtgcctgtaagtcctggctactctggaggctgaggtgggaggatcattttagcctgggaggctgaggctacaggaagccgtcaaccactgcacactcgagcctgggcaacagagtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtgggggatttcatggatgcttatcgctaagtattccttttgcaaaatatcttcttggggcctgtcaaggtggctcacacctatcatcccagcactttgggaggccgaggcgggtgtgtcacttgatgtcaggagttcaagaccagcctggtcaacatggtgataccccatctctactaaaaatatacaaattagctgggtgtggtggcacgcacctatagtcccagctacttgggaggctgaggcaggagaattacctgaacctgggagatggaggttgcagtgagccacgattgcatcactacactccagcctgggcgacagaacaagactctggaaaaaaaaaaaaatcttcttggccttagaaattaaaatcatgaaaggagatcatctgctggtcccagaatcacttaaggaatattatacaaatttgggtccccttgctcctctctatacttcctggggacaagatcacaggctctgattttttttcctgggtgctgaggaaagtctgatccagccttcttggcactggccacaaactatcagcatgcccatgttacagggagggaattgaaaacccagagaggtgggtgataagagcaggttttacttgcagggtagtttattatttattcctaactttttattttaagagttttcaaatctcagatcgaatgaatagaacaataagcacccatgtgcccttcacctagattcacccatttttaatattttgccatatctgcttcccatttccctggctcttgcatgtcctctgtttctctctttccatggaagactctctggggtcaggcatgggtgatggaagggatgaaaaacaggcccacctaaccctgcttgcagatctgactcctgtgagcttttgatgtgttttcattgttccttgtgcacttcctgactttctgacacaagatgtttcatgttcaacctgtagtttcccctccccagggccagaatgaactgtttctccaagcatgcctggtttctttgaatgaagaatggtatttagaaaccaagatctagaactaggtgtgttcactgccagatttgtcatggcctccaggccttctaagcagacagacctagattctcatttttttttaatgctgcatattattccattatgcagatagatataacagttgacttcagcagttctccattgatggacatttaagttgtttccagttgtttgttattattttttaaattctgcagcaaataacctcttgtacatatgtcattttgcaaatgtgggcatatttctgaagttagcacttcttgccttgattatcctaatagcctcctaacctgtttctttttccttattttcattcatctgtaattgctgtgctggcttaaacgcttttaaaaagtatttgatgacattttaattttttccctacacagctgaggggcgtagagtaactccttcactcctgggattcagtaccattccctcagctggcatacgaagctctcctagttacttgttaggtacttaagttcccagaaggacatgggaggattaagacactgttaaattcatgggagtgttctcaaatataatttaaactaaaaatagaagcaatttagtaatatttcccctgttttgcagagatattgcttaggctaattctaacatttgtttgccattttagagttggtatgttacttatgcttatgtctggaagtttggtttctgacatgtttccttcagttaccaatgatgaagattcagagtagatggttacttatagaaagtgacatgatgtgatttttacagagtctccaaaaagcctagggaaatgaaaggaaagaaaagcaaaaagatttctctgaaatatacagcagcaagactacatgaaaaaggagttcttctggaaattgaggacctgcaagtgaatcagtgagtctttgctttttgttttataagttgatttttatttctacatttatcacatctttgcctttttgtcttcatttctcttttctggatggttacttttagtattttttatgtatttatatatttttatgtgtagaattaggcctcatactcagagttaatttgtcataaaagagtttttcttttccttgtttgtagaacatttgtctcaggtcatgttcacttatttgggtctgatcttaatttttcctcattaaagcaggaagccattccttggatttcttctgtttctgaaccaagaataaattaagagtaacaataagaggagtttgctttattccacttatagctaggaaccaggcacttatcttcatttgcttttctgggaagtatcagcttgctttgcacgtggttcatggacctgacatgtcatcctcccacaggtcctgggcccagcgtcattagcaagcatttattgagcatctgctcagtcagccctgtgacctcaggctactgatctttctcttcttttgtctgtttagggggggaaaaaaaacaacttttaaaaaaagaaccttttacatttttctaattctaaaataatatgtattcgttattaaactttgaaaatacagtaaagcataaaaaagaaaacacctgtaattccacaagccagagataaccactgaaatcgttttaatgtatttttttctattcacataaagattatacacgactcacccacttatgtatttaactactttatatataaatacatatatatatatttttttcttcttcttctttttcttcttcttttttttttttcacggagtctctctgtcacccaagagtacagtggcgcgatctcagctcactgcagccttggcctcccaggttcaagcaattctcccacctcagcctcccaattaggtgggactacaggcatgcaccaccacacccagctaagtttttgtatttttagtagagatggggtttcaccatgttggccaggctaatctcaaactcctgacctcatgtgattcacccacctcagcctcctttgggattacaggcctttattattatgttattattattattattattattatttattattataggtcattatcttccactactgttcaagtgcctacctctatttgcctttctgtcttctttttaatttgctcctatgggcttagaaactaaatagccaactaaatctggtaaaattatttatcacttaagataaatatgtttaaggaataacccgtgaggcgttccagttgaataagatgcatgtgtgtttcagtgcatgggtttttgtgacttctttaactctcagtgacctttttgcatctttcatggttctcagccctgttcgtaataggtaaggcagctccatagttgagttctggaaatctggggtgctatactttgatcatccagagaacagcataatccctttttttttttttttttttttttttttttgagacggagtctcgccctatcaccagactggactgcagtggtgatagggtatggtactcagctcactacaacctctgcctcccgggttcaatcaattctcctgcctcagccttctgagtagctgggactgcaggtgcatgccactatgcccagctaatttttgtatttttaatagagatagggtttcaccatgttggccaggatggcctcgatctgacctcgtgatccgcccgcctcggtctcccaaagtgctgggattacagatgtgagccactgtgcccggctgcataataccttttccttttggccccccaaaatttcctggcacgtaacatattgtgaatgagtgataacttaaatacgttcaataataacaatttatctttggtaatactgagtgtgcttatatacacagcacctactctttctagaaaacctcctcccttggtgctttttatacggacccccttttgtttatttacttctcccagtcctcaaacatgcatgtattcaaacacatacaccctctccttccccagtgtcctccgttttctccttttatcattaggtttcctttttggccatgtggaagtgaagagaattcctatgatgtcatcccttcacacgccacttgtggaactcctcagtggttcctctttgataggatgtaagtgctgcaggcagagagaggttgccattcctctctccaagtcccagagcagatggtacttgggcttggcaatctgtgctgcttcagctgcagaagtacttttgacctgtattttctgcagcccttttcactcttgaagacttggttcatctcctttccccatttcacagaatatttttatatgagaatataaaaaccatacccttacgatgttatctttcaacaggtttaaaaatgttatatttgaaatcagtccaacagaagaagttggagacttcgaagtgaaagccaaattcatgggagttcaaatggagacttttatgttacattatcaggtgggtatgcaccagcaggaaccaaaaactttctggatgagattcttgtccaagtaggagaaatagataaagaggagactcatctgaggaaagctgtctacattcagcagtgagctaggctccacactgcggggaaagaagctgagggtttcagcatgtctggtttggtgtgtgcgctctggagagcttttgcagatgtcactcttcagaaaacatttagctgaagcttccacttagtgctgccactaaatcgagctgacaccttggacttgaacaaaatgcagaagtacacatgctgacactgcagaattctaagcccactcagtagcttgaaatctttttgtcattttgatttgatataggtacttaaaagttagatacattctgacaaggtgtgtgtaaagtttatgtttgtaaactgaattctatcttaaatccaaaaagaactcgggagtaattcatttttgtagcataaagatccctaagttttattttgaaatatctgatttttacacgttaaaaaataacagggcatcgagaggattcctaggtgacatccagactcctttagctttgtgtgtgtggcaccggttagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgctaaagccataaactccttaaggacaggtagcatttcttagtcatcttcgtttccttctcaatgaccagtagaccattaaaacatgttagctaaacaaatgtgaaatgattttgtgatgcacacagctaactaaagtacttccaccaaaaaaaaaaaaagaataggaacctcttattccctcagtttcaccaaattatttttttaatttaaaattttttatttacgtggagttatcagaacatatttttatttttaaattttttaaccaaatcatgttaggccaaccagtctgcctgtggtaatttattaatttatgtacaaattcattaaatgtggggtaactgccaggtgtggggtattctgttaggcacaggtcccagcagccctcatggagctgctaggatttttccaacagataattgaacttgtggggtcctttctttttttggaggggggggcagagtctcgccctgtctcccagactggagtgtagtggcgtgttctccattcactgcaacctccacctcgtgggttcaagtgattctcctgcctcagcctcctgagtggctgggattacaggcgcacaccatcacgcccggctaattttttttttttttgagacagtttcgctcttattgcccaagctgcagtgcaatggcacaatctcggctcactgcaacctccgcctcctgggttcaagtgattctcctgcctcagcctcctgagtagctgagaatataggcgtgcaccaccacgccccaacgcccagctaatttttgtatttttagtagaaacagggtttcgccatgttggccaggctggtctctaactcgtgacttcgtgatccgcctgcctcggcctcccaaagtgctgggatgacaggcgtgagccaccacacccggccttgtggggtcctttcaagacttttgacccttgctttctcatcaccactcttataaagttcagaagtgagaccactcagatttcttaaacttgttcaggacaatggtgaaagtagcaggaaaagcgggagcattgcagtcagatctggatttatcgcctccatctctgtcctgttgtgcaagtcatttaacatctctgagtctcagtagctcatctttaaagttagaataatcgcacctcataaaaatttttgtgaggactttaaaagatactatgtaatgtgcttacacaatgccaagcacatggcagacacctaataaaacatcaagttctctcttttccccttgccttcgggatagaaagtgttctcatatggaatagaaattaagaatctatcagatagtattaaggtgacattactagccttatctcatttccccgtgcttagtatatttcatcataggtttaaatgcttcaccttttccagatttattaaaactagtgacccataacatggatgaaatgggaaaatgtcattgtgacttctgaaataaaaagcttagatgtgtgtggcaattgaacatgtttctttttctttccatgtatgatgaattttgatatgaacaacatgacttcctaactccaaatcaaccagaagcctcccttggccaatgtgccctattgctccagctctcaggctggttgtgcagtgggtagttgcctagcgtggaacttttctttcgccccagttcacatctggcacacaaggcaggcctcagtccatctggatccctccctacattgtgtcctttttccttgttccacagacttgattaactgtcaaaatgttttgttttgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacacaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttcagggagataattctgcctttaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgttgctgcacatagttgcctttgtatctctgtatgaaataaaaggtcatttgttc

SEQ ID NO: 35670 - DNA, 56017 bp, Homo sapiens
gcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtaagttgtaataaatttacggcattatctaattgcatttgttaagctgatttgcgtgatctgataaagctgtcaaatatttttgcctaaataatacaaagccatttatttaccaaaaaaagttttgtgtgatttacagaaaagatacttcatagagaattttaccatttgtattcatgttttcttgtttcctgcgaaattaaatagcaagtactaataaatgatggtgattttagtgaagaccaagaatagaaatgtggaactgttgatcgcctcagtagcattcagatcttagtgaagcctgaatcctgaaatgtgttttgtagaagtactttattacatatatgaaataaactataaagaaggtagtttttaaaaaaaatttcaaatcaaataatttgtatgttttccatgtttaaattatctaaagttattcaatctcctgagcctaacagcaatgtagaaacggaactttttgcttttccaaaaggtaggaaaatttctccttttatactatattcttgtttgattatttttaagttattgcgattattttccctttcttggttcccttttacagctttataactaattattttttgcctcctactatcatttgttaagatgctcacacatagacctaaaatttctctaattcttgataatgtcttatttacaaaagcaaaaatgggagaagagaattaaagagctaaagagattatggtaactcatattataatgtactaccatttctggctctcttttctaaaataaagcaataatgtaggttgtgcttattcatccttcccaggtattaaaggtcactctgcaagagaaaaaaagaaaagaaaggaaaagaaaagaaaaaaaaacatgcttttaactgcagatcaatactgttgaaacagtacaccaagaggtactgcagaaagagtatctcttttgcactgcctttaatctgcaaagaggttaaatatgtcaccttggcattgtatctgagctctcctctggcccagggcctaagcacattgaatagaaatgttcactcagtccaagtcagcagaaatcttttttttttttattctcccctttctcgtagacaccagcttttttcagttcacagcttactcagtcaaacctgatggttgtgactattgttaactatgattttttttttattcaaaacaccctctttggaaagatttaagttaatatttctgttcatttaataagatctagcaaagcagagcagtttatttcatctacttatcgtccaatcaactagtgccactttccacattttggagaagaatattcacatgttatttatgaaccttgcctttttctttcagagaatttttcacacagccattgagcaattagagtgctggcatttccttcctaggtcttttgagatttaatccccagtagctcctcatggcacagattcacatatcaactaagtaaaaataatagtgatgacagaaataaaatgaatagtgatgcatctggacaacttgaaaacattatttatttcatttcctcttgactgttctttttactcagttgacttaaacactgctattttacttaagtttagcaccatatccagaactggttgggaacatttttctaccgagaagggcataaacaacttgttagaagatctgaagtgcacatagtcctcacttatccctctagaatgatcttcagtggagaaggagacccccataaataaatccagtagaacttcccagtaggcctggcttcctgagagatgtccaaccaggccagggtctgtttcttacggggctcacagggcatcttctgccaaaggctgagttagcgatgatagcattacctagggctagcctggcttttgtcttagtcatcaaaagatggatagaactttgaaaaacagagtgcatggtcttgatgattgttccaaaggtggggaggcaatctaataaagtgaataaggccatgacctgtggtttatatctgaccatatggaccctgtttatataagaccgtggtttatatccaagctttaccacaaaatagctctgtgactttgggcaaacaacttcatctctttgtgcctcagtctcttcattcatggaaatgggattataaaatcagtagctacctcagagatttgttgtaagaattaagtgaagaaaagagccatgtttggtacattaaagcaatcaatcaatcgtagataatatgaaagtactggactaactatatgtccctattgaaactccgtagaacgggaactgactctagatattttctcagggtttcttccttgtacttatacgttttgctctataataaaatatgaatgccaggtgtatgcctctgaggcagcacagcagagtggacagagcatgggcttcagagtccaatgcatctgggctagaatcctgactctgcttcttacaatcagtgtaagctttggcagttacttcccacctgcatgactcagtttactcatctgtttagcaaaatggggataataatacacacaaatgaggtcgttgtaggaatgaaatgtgatgtttattaaatgccaagtatagcacctggcagagaagtaaacacataggaaagttgactggttgctcataaggaatctcgtatatcagtgaggcctctgttacatacttgcaatgatttctctggtagtaacaatggagatcaagaaggaaatattctttgaattgccttttttatccaaagaaatgtaaaagtaaatcggacactactattttcccctggtggggggcctcaacacgaggtatttattactatgagacttcactgctgcatcagttagtagcttcttaatggccaagtcaaaggaaaccaaagaaagtgttctatgccagcttgccattacacagagtgagaagaaatgctgctttgctgtcaattctgttttattggcccacttggacaagagggaaagcccccaacatttcttctttcttatctcttctaaaggcaagaatagggcttttgacttgctccaggggatattttttcctctctaactgaaattcaagtgaaagagtcttttttttgtttttttgtctttgtttggtgtttttgtaaacctctcccctatgttcctagcattgaaatgtaagctgctttttctggctgcatgtagcaggagcaggctgtcgtcatagcaatgaaagggtgtagagagactcctgcttcatgacctgctctgggaaataactcttagtctgctttaaaatccttctttagaaatgaagtctccagtcctggcttgtttccttcctattacacaaccaacttatgtacacccattgcagtagctaaatgtttcctttaaagatttagtgaataggtattttaaaaatcaacaagagagctgctaaaacagtggctagtttactgtggcatacaggggaaaaacaactgggaaggcaaagaaagagaaatagaaatggcctcacatgatacacatactgcagcaaaccctgcaataaatccatttttcaagttcccactgcttcctcccatcttcacgatgtgctatggtgtagtggttatagaggggaattctggggcagactgcctggacttgaatcctggcactcataccttctagttgttttaatctaatccattctgtgcctctgtcttctcatctgtgaaatagatataataacagtcataaaattgtcatgggaattgaatgagattgagcatgtaaggcatttattacagtatctaacccatggtaaaggttggctgctaagctcaggagcctcagtttcccccacttgtgaaatgtggataacagctaattcataagatcattgtattttttttttttttgagacagagtcttgctctattgcccaggctagagtgcagtgacatgacctcagctcactgcaacctccaccacctgagttcaagtgattcttgtgcctcagcctcctgagtagctgggactacaggcatgtactaccatgcctggctgatttttgttgttttagtagagatggggttttgtcatgttggccaggctggtctcaaactccaggcctcaagtgatctgcttgcctcaggctcccaaggtgctgggattacaggtgtgagccaccatgccaagatgatcattgtatgattaactaaaataatgaatgtacatgctcaataagtagtagttattacaattctttttcatggttttgttattgaaacagcaaggttccagtctaggtcctgctgctcacttcgtagaaagccaatcactgagacaacaagtattgccaatgaagaaggctttaatcaggtgctgcagctgaggagatgggagcacagtctcaaatccatctcactaactgacttaaactaggggtttacatagcaagggaaaaatgtaacaatgtgtaagaaaataagaactaggtaggggtaaggaaacaatcatggtgaataagcggtcaggcatctgctgcagtgatctggtgagtttccattcttttatacttttttagaagcctgaaggtcctgtcctgaggaaggaacttagataaaacaaatataagtttcacactttaagaccaggagggtcaacttctatgtttttcaaaaagatctgtctgtgggactattgggtaagtttcagtttgatctaactctgacatgaatggcctttttgaacttagaattcccagtgagtcaaatataatgaatagaggcctcagaattatcattgcataaatgtgaaccatttgatttctacagggggaaaaaaaagaattgtgactttttacatttataaagactcatctcatcttgattaacaccagggtaaaaagtattaaaacatcttatctttcattaactttttattacgtttctgtttcagttcctccagtgttttctaggtcatgcaattatgaaaataagttagcatttttatcttacatctcaaacaactaatgtattcagtgttctatcccatgcaaaattccagaaatgcagcaaggagcaaaactagagaggggctgagctcttgtggtgcttactatgtagttatgaaaatggtcattaatcaaaccatcacaataatgaaaactgcataggaccaaacataaggtgcccccaaatacaatgccatcttcatctttctagtgagaacatcctcaaccaaagtgtttggccaaacagcatgtacaaatgggtaatatattgtaatgtacacttgggatatttaatctatggttcacatacatatttaatatgttactttaatttaaatattttatacttattaacatgactttttcctttctcacatttcatgaaacaattttgttaaaactcttcatacgcatctttaacaccaatgtgtatgttcactggatccacgctgtaattatctaatacagagcacatcatcaatccttctgcaagttgctaaacatctgctgatgctgcaaatttaatccccaggcattagtcctcactcgtggtcatgttctccacactttcattactgactagattgtttttccagtgctttttaaagggcgtatttaaaaaccacttgaaactgtaagtgtggctttctaaaactatgtgattccaacttgcaataatgaagtcatacctcaggaataatgactaaacctgctttaaatatctttatctattttttcatccattttgtcaaggtgaccttcctaagaataaaaataagcattgcttgagattttttttttttttgagacagagtctcattctgtcacccaggctggagtgcagtggtgtgaccttgggtccctgcaacctctacctcctgggctggagcaattcttctgcctcagcctcctgagtggctaggattacaggtgtgcaccaccacgcctggctaattttttgtacttttagtagagacagggttttgccatgttggctaggctggtcttgaactcctgacctcaggtgatcacccacctcggcctcccagagtgctgggattacaggcatgagccactgtgcccagctcttgagatgatttctaattgtttttttgaatagtactttgctgctcaaaatgaagaaactttggaagcacttgaatataagtcaaatccctcttttttacggcaggatttggtggcgtgagaaaaaacacattttatttgaacacatgccatatataatgatacactgaaataagtgttatgaaggcaaaacacctttgttccaagagagtatataaggatcctgacctccactcaggatcaataatggctttccttgatctgaagtctgaatagaggttaactctgtgtgtgtgcgtgtgtgtgtgtgtgtgtgtgtgtgtgtgtgtgtgtgtgtgtttggtggtggtggctgggaggagcgggtgctggagagagaattctgacagcgtgaacacttgtgcaaagaccctggagcaagagggatcgtggcctatttgaggcactgagaggcagccagctcccgagagcaagggcagagcagtggaagatgtaaatctccataatactcccttccctgagcactaaatgtatgtgccctttgcttgattcaggtttaatgtatacttttaacgtctggatggatttctggttagtctcaaagccccaacaggcatgaccatgtctatccctagctcagactcttatggtggtaggttcaattaggaaggatgatgggcagttgaaggtcagatgcccagaaaagtcttaagtcattgactctgagtatatcatatacactcacagggctgggacaccttgatgtcagatggtgactcagcagagaactcaaaatagaagaacgtctttttcacccttcagatgactttagggccaaaccatagagctctccccagagactcattaatactttaaaagctctaaagcatcagtgttaacactggatcaggtaacagcacgtatatgttagccaaaatatgactaagagatttgctctctgataacaaggcctttgactattatgtaaaaacaaggtgaacaggaacgttctgagtctgtttataaagtacctataataattgttttgtttactacatttcccagaaaggaaatttttccatagttgtaataattgctaaaaatagcagtctacaggcttcctctgatataaacaaattcaacagaagatacctggccttatttggatgcatggatgtacatactccaggaaatgataggccaagagtaataagaaaaagaaagtaacaagacaaacctctcctttttctagtacacatggtatgtctttcttagttcattaaactttagacaaagtgataaacagatcaagttgtcatcatctgccttgaaacccaaaaatattgaaacaagttccctaggcccagaagggaaggaagaggacttgtaaattttgctgaggctgccacagaaggagctaaccactggagggttcagactggagggttcagaaaccaggggaatgctaggcaacacaaggaaaattcaattagaaagacttgaagcaataactaccagcactaaaatttccagggagtcactgatgtggccaatatgaaagaggaatcctgttcctcctttcagaggtatggatgactgcgtttacagtctggttcagtgttcagacagcttattaatgcttaagagaaaaggaaagagaaggaagatagaaagaagaagtacagcaaggcaagaagtgcccaggggagcaggtgtgctaagttgatttaagtggcatggcaatatacagaacttcaaaaataaaatttatcttttaaaatttaaatgtaaattaatgttctaaaaaactataggaactgaaaataaatcaaatacaaatatctacttcgacctaatcttactgtaatttaagtttctaggaaatatcatagaaactgaagtggaaccaattacagaaaaagaatgcaaaataaaccatagtaccgaaaataaaaacatattctggtcgtttgtgtaggttccctaataaatctagacggagaatgatgtttttgtgttttagtgtatgccaaactttagacaccctcctcttttctaggagatacaaatttcaggagcgatatttagctattacacacatagcttttcatcagagatgggggtagctgacacacacatggcccattctgcccatacctttcaggtcaatctctgatggcttggctgggctgtttccagctagcagaaaggatattcaggccccttttccttgcttttccagggacagagcttgtagagtgctgagaaatccaattacaacttcctttcatggtgaaatccaattacaacctctcccatggtgaaagccaatctttttgatacaaaaggaaactaaacaaaagggcttcaggcaggggatatgcttgtgctctgccttctcactttgacaattatgcaggaaggttgcaatgaccttggcttgccttgcttaggaacaaaagtcataatcttctaccccctactcccacaaaaaggaaaaacgttttcatatctgattccaggagtttggggagtttcctcaaggatccattagtcaggcaaagcaaattttgagccaacacttgctccctcccacacacttttttttccggcaagatgacttttcttattgaacttggaatgccatgttaaatgataaataaattagtgaattatttaggccaatatcctcccataatctgttcccaacaacttttttttttttttttttttgagacagtgtctggctctgtcacccaggctagagtacagtgtgcagtggtgcaatctcggctcactgcaacctccgcctacccagctcaagtgattctcctgcctcagcctcctgagtagctgggactacaggcacctgtcaccacgcctggctagtttttgtatttttagtagagatgaggtttcaccatgttggctgggctggtcttgaacttctggcctcaagtgatccacccacctcggcctcccaaagtgctgggattacaggtgtgagccaccgtgcctggcctgtttctgctacctttgtgatatccaatgctgtgtgtcaccctttcagccaacctgtttgcttgaggttagtgagactgtagtactgcttggagaggggtcatcctaaattcctaaaacctggttgagataaacggaaacagttctcaaaacagtaatttatgaaaatagatattttatgagtacttgacacaagtctataattgctgagatatttaaaaataaaattactaaccacattctattcaaatctctgtcacttctgtataatcactgtactccactgaatgtgtgtaaaatatgtatttgcagcttatagggaaaaaaatttgcaaattttcagaagaatcatgcagtcaactaataggttcttagttgaagattagtggagtggggagtggtaaatggttatctttttcaaaacttaggacaaactttacactaggttcaaataaaagtgctatggctacagagttaatgaacccaccattcaaagtggccctaaatagctctgaaagcaaagcatttttacattatttgattcaacttgagttatctaattgcctatataatatgatagggacccaggccggacacaatggctcatgcctgtaatcccagcactttgggaggctgagtcaggtggatcacttgaggtcaggagttcaagaccagcctgaccaacatggtgaaaacccgtctctactaaaaaatataaaaattagccgggcgtggttgtgtgcacctgtagtctcagctactcaggaggttgaggcagaagaattgcttgaacccgggaggcggaggttgcagtgagtagagatcagccactgtactccagcctgggcaacagagcaagactccatctcagaaaaaaaaaaaaagatagggacttgataggaaggtaccctgagatatacaaaaatcagaagaattgacctttatgataggtaaataaaacatgtaaatggtttcatgacgtgtttggtcagatgttcatgctgtcttagctcattgaaatcatttttaactttcaagccattagttcagtggatcctcccaaccttttactggggaccaaacaattttgagctaattctctctaaatcaagggagtattctattagaattcagaagaaacaaagcacaaattcttaaccctaagtgtcttctttttctctctttttcttccctgttgcccaactccagctaatgggttttaaggactttataatgagaagcaggttaatgtcttactagaaaaacttttcaataatttcctaaaatatggggagaagaaaatagtggaagatgttgttataaaatagaaaaatgcttggttgaaaccttggtactcgtattgatcttgtactcattagctttttggataggcataggcggggaagagaagtatcagcatcatctcactgataaaaacagctgatgtcttcttacagtctgaaaatgaagccattgatttcaaaagcaaatgttttattatactttgaaaaacactctggattggatcattcaaggttatgatagcctgagataactgcagcctcaaactcccgggctcaagcaatcctcctgcctcagcctcctcagtagctgggactacaggcacgagccattaagcctggcttgaggggaaaagtcttttcccatggtgggaggagaagaattaacagctgtggaccagctgtgggcaagctgtgtcttttccttgcttgaaggcatcttcttaacattttctctctgaaggcataaataagcttccaggttttcaccctattttcaaagaacttttcaaactctagccttaaaatccattagggtttattacatctgcttctttcagaaaaggtagataataagtaactttgcaccactgaggtaagcaagcaattgtttcccatattaaatgtgttggccctcaccaaggtacatgagaagcttggaccacgatctgaatcctaaagggacttctgctgggactgaatgcttgcattagcggttcacacaagaactaaatgctcatcaaagtacaccattattccccagaaggtcccaacaccatgagaatgaggctacttggaactgttctttggtattatttgttgtttttcttaatcctagaagagaactaccccccaataaataattcttggtccattcacagagctgaaagcacttgaaattcctctcccaactagcagaatttaacaactgacttactctgttagcaaaagagaggcaatttccactgaatccaaaggagttttatattatactggtagagtttaactaataagggaaattcaaataagagcagtcagaggataaagccaagaactaggcattcaggggaaagaaattacaggggtagtagagaaacaaataaattaaggggtagggagaagagttaaaggcagaaaaagcagaggattaatctatctgataattacaggggctaggctttaaaaggtgtattgtcttactattaacaacatgaagccaatcattcagatattattaagttactgcaacgtcacaaacgccaggactttaggtgagccatcctaagagcagattcagggtttgtgaagccaagagtttatacatatgtttggaaccttcttttttaaaaatataaaagtcaaaatcaagtctagaactttgtatggaggctgcacaagtgaggggccttgaaactcaagcttcctagttttatggcacgtctatcctggccatattcaaatgtctataccccaaatacaacaaaaagttcagaaaaataaataaatgtaaatatgagaaaatcctgtgttctctttctctgagaaagagaaaatagtagcacagataccatagtaggacttgagcaaagaaaaataaatatggccaaaataatgtctcccactataacacaggacagggtgtggtggaccctttctgaaggattggcaaatgtctgagaaaaagaacaggcaactgtctccctggatggatccatcccatctggagctctggaatgagacacagtgagattagtgagtggtatgataagacgagaaactctgaaaggcatgattaagagatggtgaaaggtggctattgcacaagcttgggtaagataagcctgggggatcctctaaatataattaaagtaatccctcaattacacattatagaaaaggaggaatggactagtttcgcctgagcaagaaagaaacagacctttaagaatgtgtctgaaaagctgtgcctccgggtgccctttggcttccatgctcctcactgctgaccaggcacagtggcaaagagggatggtcaggaagcactcactgaatggtagttctgtgaaatggaggtgagggtcacagatgggagtgcatggatggtacacaggtgaagtgcttagcatagaacctggcatatagtaaaatctcaggaatgtatatgccattgaatgagctactattaaatggtctaagacaaaaatgtactttttcaataaaataatactttgatgaccataagtgattctactactgagtacatttgagtgctattccacacaaaaatatttaatgtttacagccaattatatatggcttcttacaaactcagtgactcaaagcaactgtttcataatgtctcgagatctggtgggtcagaaatttgggcaggcctctcagaggtactcagctaggagatgagctgatctggagtggcacaggatctctccactcacgtgtcctgcgcatttgcaaggacagatgcaaagctgggattggtagaactgttgaagtgtcttctgtgacatgacagactcagaaaatggctcaaggctcccaaaatgagttttccaggagattaggtaaaagttccaaggtttcttatgacctagcctcagaagtcccagaacatcatttctatctcaatcaattggccaagtaagtcactaaacccagtccagattcaagggaaggagaattagactccacctctcaacaggagaaatagcaaagaatttatagcaatctctaccataatatttatacctattaaataagaaatgtaagaaattgtctcaaggcagttactcatgtgagttagaatagagttgacatttgtgggtgtttggctcttaatgggagacctatttctgccatgacaaatgattcctctggagatttgttttaatggtacatgggtcagccaatagaaaaactctaggcatttgaaattcaaatgctggatgttctctataaaatgctgtctagctatcatcttttaaaattccagctgaggttctcctgaaagtttggtaatgagacaccctgttcctaacagaaggaaagggctctccttccagttacctatcatccctcatctttaacctctctaaatccataaaaagaaacagtgggatgaagaaaagaaagaaataacctaaggactctagtaaagggatgaattaaagtgtctgaattattcattattggggttattaagccattttctgccttatgcatgtttcaaagatatgataacatctttcatttcatttttacagttggtgaaattaccaaataactataggatcacatttgaatctcaaaacaactccagaagatagataagaaaatgtaatattacctttcctgttttgtagatgaagaaaccagtgacttgatcaaagtctcttagctggtaaaaggcagttcaagtctggaacttagatcttccagttccgtaccaactgtcctttaaactatgcagctgcctttgaataagctcacgcatttgagcaaaataatattgatttagtttcacatcaatactgcatatttaagtctttgagaataataattctgtgaattccaaaatttgtctcatttttgcatttttcatctggagttttattttctatttctgcaaaaataatctgtattttgtagtcagtgcacaccaaactcgaatgtctcaaaataaatgactttttactcatccaagaataaatggtattcatcatacttagcaaggacatcatggttttgatttttcaaagtactttgcaagcatcagctaattaagcctccctgagtcttcagtatgacagttgttttcaaaatatctctcatttcccaggaaagttctccattctgtcttatttatacaatcagcacatttgctcagttcttaaaataagaagctaaaggccatgaaattatttttgatcaatatgtggcaaatacaattagctcagtgagacaaaaatgcccagtgactagtctaaaggacaacgtggaacacaatggaagaacacaaggcgttttaaagtctagatactggattgtcccacaaggtccttcaaaaataaaacacaggcatcttctttataattgaaacttgaaggggtttcctgcttggatcattctaaatgacatgaccatactctgcgtttaaattttgttttcaattacaggatggaaaaaaactcttaaaaaatagttccatctttggactcagtaaaaatcagggaccattcagtaaatgttggctctcaaaaagcctgcacaagtggccatctgaggttatatgacaatccctagacttgttctatgccttaaaatatcttccatacagctacgccaggattctcagcattcgatagctctttttgggttaagaacaatgtgaacatacctcttacctgagaatagaaatacattaattcaggaataatcttttttcttttttttgagatggagtctcactctattgctggagtgcagtggctcaatcttggctcactgcaacctccacctcctgggttcaagaaattctcctgcctcagcctcccaagtagctgggattacaggctcatgccaccacgcccagctagtttttgtgttttcagtagagacggggtttcaccatgttggacaggctggtctcgaactcctgacctcaagtgatctgcctgcctcagcctcccaaagtggtgggattacaggcatgagccacaatgcccagccctaattcaggaatattcctatttcctcggtatggtttagatgcatgcaaaaaacaaagatttaaaagtatagaatataggataggtgagtttgtgtttaatgagtgaactaaaagtaaatatgttctggaactagctcctgggaagcttgaaatcccctaggggaggaagatacggaaaaggggaggagaaacactaaggttcttttcccttatatcacacttaatacaagacatatgtagttaatacaagatataaatgactctaatgatattactgatgacaggcagcaggcagaacaatgaaaataataatcatttgcatgtgtaaggtacttcagagtttgcaaagagcttcctcacctcaccttgcaaggagctacctttgacatcggaaggaactggtattcccatcctatatatgaagtttggagagagaaagtaatttgttcaaggtagtatttagtacttggcaaagccagggcccaaagccagaacttctggcttctagtctgtagcctgttcactagtctgtttggggagaatattggatactgagtccaaagctcagcgtttctaattcttgcccacctcttaagccttgtacatttggccaaataatttagactcttcaaatttctgtttctttacatttaaaaattctgtccctcctttcttcattgaatcaaatgagacagtatataagaaaacactttataaactgtgaaatgctaaataaatacaaggaatgtataactaaatccatcttaataagttaatattccttggaaccctgcctcaagacatccttacagttaaactttcctcccttttgtgttaaagaataaagagttcctccttctctttggagttaaacctttcacatgtgctttaatagtagaccagtaaatatgtatccaggatttaccaagatggtattgtctcacttaatcttcatactattttatagacaatgagctgaagcccccaaaagctacacaatttgcttatttacgcaaattaagtattacagcctatgacatcctgtttcagaacttatgcctttaattgttatgaaatattgtcttgctaatggttttggcaactggtctgttttgccttattttggttttcggttgctgtaaaacagtatgctctcacattaaatggcttaaaatcacatccctgtatttgctcataattctccaatctggattgggctccactgcatgattcttctgctgattttgtctggagttaattcatctggcttcagtgagctaggaacacatctggggctgaatcatccaggagggtctgttatcctgcaaggttccagccacatggtctctcatcattcaatagtctgggtcaagcttttgtacagcatggctgatagcttccaccaagaggaaaaactccaatgtgcaaaggtttaccaagtttctgctggcatcatgcttgctaatgtcacattggtcaaagcaaatcacaaggttaaggcccacatcatagggaaatgaagcccagaagttgtggtttactgggggtcatcattgtttaccattatctcctctcttaccctttatcttcaatttttccttatttacctgtcttttcccttcagcacagaagggaaatctggggccgggcatggtggctcatgcctgtaatcccagtacttccagggggctgaggcaggtggatcacctgaggtcaggagtttgagaccagcctgaccaacatggtgaaacccccatctctactaaaaatacaaaaaaattagctgggtttggtggcgcatgcctataatcccagctactcaggaggctgaggcacgagaattgcttgaaccctggaggtggaggttgcagtgagcctagatcacgccactgcactccagcctggaaaacagagtgagactctgtctcaaaaaaaaaaaaaaagagaaagaaagaggaaaggaaaggaaaggaatctgaatgatcacattcaaatacaaatataaatttcctgtaactgcatattccctttaagctaccacgttactctcctttgcacagccaatcatttttagagtggtctacactcactgccctcacttcatcactgcctgttcattctccaatcactgcaggctggcatccaccgacaccacagcaacaaaactgctctccctgagatcctcaataacctctgcacttccagaggcaatggataatttcctgaccttgtttgctttgaactctctgtgacatttaacacttcccttttctcatgtgactcttctttctctcactgtttgtatctttagctcttcccatcctctgatggtgcctaatgatcttcactccccagggttctggctccagctctctgctcaactggttgaataactgctcatgctacagcatgcaagctacatctgtaaccccaaactccatgcttacctccagacctatctacccaagtatctactagatatctctactcaaattcaacaagcccaaaactaatccaccgtctgtcttctaaaaccaaaccttcctcctataatccttcaccttggtaattaataccaccatttactaagttgttcatatgagaaatgtgactcaagacttttccttctcatattcctacaatatctaattcgtcattaagttttatctgttctttttttaattatttcttagaactatccagttgtgttttggtaaatgagcaacccattctctgagagagggagaggtgggtgacacttgatggttttcatggtgtgactgatcctcccaccacaactgattttgatgcaggatattttcttgaccccttcacggaactcgcggcaggggtgccttgtttactcagcccgccctgctcaatcccttgcaggagggagtgcgcaagcgaatgactgcaggaacctgagcgagcgaaggcaggaactggccactttggcaccagcaggagcaaactccatgtgggcccctcaccagcgtccaggtgtgggcaccagccacgccaagccccagagggcgtgtaaccatactcttagctccaccgtccgcagacagcagtgtgttatcagctcagtgagccctttgcctcatcacgtagggcaactgccttccgccagcaagggcaaagggccagtgcgaccgcctttttggatacctgcacgtagtgtgtccgagttcttgtccagtgcccaagaggaatgaggtcacacagatgaattgaaggatggcgaatgtggagaattttttttttcagtgacgaaagcggctctcagtggagaggtgagctggaaagggaatgggaagggaagatccctctcctctgaagtcaagccacctctctcctatgtccaggcgcttcttctcgacatcaggctgcttcttccctctgctggctgagttctggggtctttatgggcacaggatggggacggggcaggccgtaggtagttttggaaaaggcaatattcaattggtaaaaagacagtattcagaaataaccaatcgggagagaatggaagttctcactttgggctgtgggtttcaggcttttcggcttgaaggtgggattttgccagcgacccgcccctgtatgcctacagtttctctgcctcctgttgctatcaattttaagctaccaacatgacgccactgaacagaatcgggaagagacatgcggaacacatattatatagtatttccaccaacagatataatagatgtaaataacctcaaaagagtagataatagtaaaataattatgaagtgatgagtttctactattttctttgcttttaacataattaaattatacatgtatgtaatttaatttttaattgatgactttaacaaccaactcaaaaaagtcttgaaatgtaacaaacagctctcacaaaccagtacaggttggatctatccctcttttctccactcctaagaccacagcccaaatgtaaggctctgaccacctcaccttgatgttacaattgtctctcacaggtcatgctactggtctgtcctccacacagctgtcacacatacaaatctggttatatcatcacccctgtccacacatgtgtgcacacacacagacatacacacatgcgtgcacacacagacacttacaataattctttgggtccctatagctctatggctggaatttttaattccttgtttaatgcactatgacttttacaatatggctatctgcttacttttgagccttatctaccccagcccacttcccctattgacagcctagagacccaaatattaacatcctagagactcgatgcttctgcaacttcacccatgctgctgcctgccaccctctagagtacatctagctgtgtgagaacatccttcatacagctaactactgtttattagttttcaaacctcagatcaagaattaccttctctggaggtcatctctatacagtagttaagaacactgtagttaagaacacagacagacctgatatcaaacagaagtgttaaatatctgctgtgccacttcctagctgtgtaaccctgaacaagttacttaatctttatgcccgagtttccttactagtgaaatgattacaataatgtgcttacctgatagaactgttcagaaggtttaaagaatatgtgtgtgcaaagctcttagaatagtgcctagaacttaagtactttggatgtagtaaagttagctattatcaactacctaatttaaaaatgcctcctatctctctttccattgcattatgtacataatcatcacattacactatatgattttatataaatatattatatatttatagatacattattagtatatacatatatagatacgtgtatataatacatatatagatacatgtatataagtatatagattatatatgtacacatatagtatacatttagccctcaacctgtgggatctgacactatctccaggtgcacatacatagtatatacacatatgtatactatatatatatatatatacttatatacatgtatctatatatgtatatatttatctatatacgtatctacattacatacatatatgtatctatacacacacacacacacacacacacacacacacatatgtttcatccacggttcctgtctcataattcccatagacctttttataatgttataatgttggtgcattttaggcctcataagcggacctcagaataacaggatttctctctctctaatcttctatttttttacctgctactttttctccccaaggcaggactctaatcttcctctgcctttacctaccttgtgtgattgtaggtcataagacccccatttcagaaggggttctgccccatattctggaggaaggaatgttgcatggagaggccaagaagaggcccagcacagtgatccatgtctgtaatctcagcacttttggaggccaagatgggacaatcgtttgagcccaggagttcaagaccatcctgggcaacataggaagatcctgtctctacagaaaaaaaaaaaattaattacccaagtgtggtggcaatcacctgtaacctcaactacttgggaggttgaggtgggagcatgcttgggcccaggaggtcaaaatcacgccactgcactccagcctcacagtcagagtgagacccacctcaaaggaaaaaaaaaagaggccaaaaagaatctgaacagatgggccttaccgggtttccccactcagcctttgagtactaaagcataccctttttgtctaaacacatttctatgtggttgtcaatggtgcctatcctttcatgaagtctccataaaaggcccaaggggacgaggtttgaagaaattacaagataactgaacctatggaggttcctagagggtgtgttccggggagggcttggcagctctgtgccccttcccccatacctcaccctttgcatctcttcacttgtatctttttgtaatatcctttattataaaccagtaaatctaagtaggtgtttccctgagttctgtgatgcactctagcaaattaatcgaaccccaagagggagtcatggaagcccaacttgaaaccagtcagccagaagttctggaggcctgatcttgtgactggtatctgggaaagggaagatgtcttgtgagactgagccctcaacctatgggatctgacgctatctccaggtacacagtgtcagaattcatttggaggacactcagctggtgcctgctgcagagttgattgcttgcatgttgatgacaaaaaatctcccacatttggtcacagaagtcttctgtgttgattgtagcgtggtgtgagaccacaggaaaagcagttagagattttccacacccagaaactcttaagagagaaactatgtgtccttgtgcttaggcagtgtctagtaagtactcaatgaatgaatttaaaaaaaatggattagtgatgcaagttctggccaactggacattctttccttttgattcattcagctacatttagatttagggaaatgaagggaacttgtgagatcatgtgagatcatgcggacagattaaaagggaaatattttctcaaatttaattagttatgcatgttgctgcaacaaacaaaaagaaatgagccttatgatgcaaaacacgtttgataattcttactccccttttaagttgtaccatttgtaagaaaatagggtagcattccatgtgcctaattccactgttatgtgtgatgaatgtcggaaatactcctggcattaaaaggagcctaaatgtgtggccagaatggactttaatgttccactggacaatttttctgacctcacagcaaaacttaaattacattattttctgagaatctaagttgtttattcaagaatcacaacttaacttatcaggaagatgagagaaaaaagaattaaaatttattgagcatctcctaggtatcaggcatttttaccagtaccatttcttctaactctcacaaaactgaattagatgttttattagtcaaggttctccagagaaacagaacaaataggagataggtaggtaggtaggtaggtagatagatagatagatagatagatagatagatagatagatagatgatagatagatagagatatagataatgaggacttagtttacattaatggagccagtcccaagatctgcagtcagcaaattggaaagccaagagagccaattgtatagttcccgttcaagtctgaagacctgagaaccaatgatgttgagttctagtccaagtctgaaggcctaagaattggagggctgatggtgttaagtcccaatccaacagcagaatatcaatgtcccaactcaaacagataggcagagagagagagggaattctcccttcccctgcctttttgttctattcaggtccccagtggattgaattatgcccactcacattgggtagagcaatctgctttattctgtctaccaattcaaatgttaatttcttcagaacacaccctcagagacacacccaggaataatgtctaagtagatatctgggcatcccatggtctagtcaagttgacatataaaattaaccatcacagatgttatccccatttttagatggggaatctgaggcttagagggctaagtaacttgccaaagatcatatagatggcaaatgttgctccagagttcaaatgcatgtctctctaatctgaaagcaccagtctgcttccgctaaaccaatggttctcaatcagggcgattttgccccccatggaacatttggcaatgtctggagacatttttgtttgtccctagctggtgggggatgggggctcgctactgacatctaatgggcagaggacaggaatgctgctaagcatcctacaaggcacaggacagccccccacaacaaagaatcatcaagccaaaatgttaacagtgccaagataaagaaacccttcactaaaccatactattttgtatttctatagttttcaaaaccagtagaatagtaataacatactgatctaaaatataaggctaggcacagtggctcatccctgtaatcccagtactttaggaggctgaggtaggaggaatgcttgaagccagaagtttgagaccagcctgggcaacatggaaagaccccatctctacaaaaaaaaaaaaaaacaattagctgagcataatagtttgcacctatatccccagctacttgagagtctgaggcaggaggatcacctgagcccaggaactggaggctgcagtgagctatgattgcaattacactccagcctgagcaacagagcaagaccctgtctcaaaaataaaaataaataaataaaataaaatataagtgactatagttccataactctaataaatatttgtggaataaatgaataaataagtaaacattgaatttaaaatgtagaggaaagaaactgcgtttttcaatgattctttacaattagcattcactaggaggatagaatgttttaaattatcatcgctaatagagtccacatatttactttaagcatgaattaccatatataaaatattttattttaatacaataaaaatcatggaatatattttagtgggtttagtagtttaaggggaaaagatagcagcaatttaggattcatacaattaatggaattattttcaattttagaatcctaaaatattagggttagaggatcatctaggtctcactcttcattgttcatcacttgagaaaactgtatctaagaaagggcaagtgactttcccaaggtctcctggcagtcagggacactgctagagccagaatccagctctcctgacagtttaatgcttttcttgttttaaggtgtttttcaatgtattagagttttggggcagcggggggaggttgctccatgtttttacttaaatacatttttctttcatggaaaattgaattcctatgctttttgccttgtttaggccataagatgttttattgaaagaaactttcaatatcaagtaatccaaccaaccttctaagataagccttttccttcaacacaaagaagtgcattttgccaagtacgtaccatcttactccttaaaatgtttggaactttttgtttaaaaactcaaactcaaagtgaaatctcaatttgtcacaatggtggtttttttgtttgttttgggatttttttagtttttgtcccccttccttacacctttgtgtaagaggtaaaatggagaatttgcaaaataactagaaaaaagctggagtgggagccaggaaatctagcttcaatcccagctccccttctacagagctcagtgatctccagcatgtcacactgtaggctttctaggcctgttcttcatctgccacatcctggggttgttgtaaagatcaaataaggtaatatcccatttgtaaatttatttggtaaacccaaagcactatggcaatagaaatgtcaagtatattttatatgccattacccgttctaaataaagtaaacacccattccattgttaatattctaaatttctccttgttatatgtagtcattttcagaaggatcacttagaagaattatacttgagtctccaagtacatgtccttttcattaaaactgggaattgattagtccagactagtaaggttataaatgatttaagtttctccccacacccctgattcaaccctcccacccccaccccaccacacacacacacacacacacacacacacacacacacacacacacacaataccaaatcactttctatgtgcagctttactctctattcttccaactgactgttccctggtccaggtggcccaccctggaccacctggatttgaatagtgagataggtaaaaatgtgttcttgttcccaatatgatgaggaagtctatgctatagccctgttttcttcaataaaaacttcatttgctgctagtttgagaggccgaggcaggtggaccagttgaggccaggagttcgagaccagcctgggcaacatggcgaaacccctgtctctactaaaaatacaaaaattagccaggcatggtggcacatgtctgttattccagctacttgggaggctgaggcatgagaatcacttgagcctaggaggcagaggttatagtgaaccaagattgcgccattgcactccagcctgggcaacagagcaagactctgtattaaaaaaaaaaaaaggaaaaaaaaaaacttcatttgctgagttagaaccaaagacccacaaagacccacaggaattcctatgtgtcacactaaaaatgatgatgataatgacagaggaaaatatgaagaaaatatgaaatggaagtcatctgttgtgaaatggagatgaaacatatacatatgttgccactccctgctaaaattccagaataatgataggaaaagaatagtaataatatagactcacagtgactgagataaaagaagaggagacaaagaagacaagtgtcaacacatctttagaagatggaagactgacttagaacagggaaagcttaaacctaagagtctgcagagaaggatgccatagacaaagaaggaagccattcacactgaagaacccatgcaagtttccagaattggaggcaccaggtgatttggaaggcagggtgaggatagaggctgaaatctggagtattggttgaaagcctatcagattaactcttagattcaagatccttcctcctgcctgcacagccaggggacttccatgtttcaacacaaacaggaaaaagcttattctctggctctgcactcagaataaacacaatgtcaggtgggaggtggagccatacagaaacctagggactaagtgaaaaatcagtgtgtgcactgagagaactccagtctcttcactgatttcacagaatgctagcaaccaggtttatatttgcttctcaaggtaagaggtatgaatttctcctctagagaaaagaaaatctccctgtaatatctgtcaatgacatttggggtgccccatcaagactgtcaggttactgctccttggaagccctccaatgctccatggaactattctttggaagccctccaagccctgtccataaagttctaattggctttctagtgactcactgcaaagtattaatggacagccaaatacatcagacattagagaaaagctttcaacaggaaaaacaaagatcaaaacaaactaactggggaaaaaaggaacaagaaggaaacagaaactgcagggtgcagaggaaattttcaaaatatttgattaatatcctcaaggagacaagaacatatgtcacactaataaagaacaggacaatattaaaaagaagccttcgggaaataaaaaattaacagtatataagcatattctcactcatatggaagcgaaaaagttgatctcatagaagtaagaagtagaacagaggatacttgaggctgggaagggtgaggagaagaaaggaatagggagctatttgttaaaggacgtaaaactatagctaataggaagaataagttctagtgctctataccactgtaggatattatatatttcaaatagctagaaagaagacactgttcccaatacaaagaaataataactgtttgaggtgatggatatgcaaattatccttatctgatcactatacattatatgtagtgaagcatcactatgtaccccatgaatatgtataattgttatttgtcaatttaaaaataaaattaaaaaagaaaatgaagtataaaggtataattttttttaatcaataaaacaggccaggcacagtggctcatccctgtaatcctagcactttagggggctgaggcaggcagatcactttgagctcaggagtttgataccagcctgggtatcatggcgaaaccctatctccaggaaaaaaaaaaaaatcaataggagagatgtaaggtaaaagtgagaaagtttcccagaatgatagacacactgttgaagagaagagcaaaaatgattagcaaatcggagaatcaaccccagaattctgatatttaactaatataaattctagaaagaaaagacaaaaaatagaagggcaaaaatcattaaggaactaacacataaaatgctccccagaactgaaatatataaatttccaaattcaaagggcctaatgagttcctaaactaaatgtaaaagtatccaaactaaggcagagatggtaatatttcagaagactagggccaaatgtaaaaacataaaagcatccataaagaagaaaaaaatactatgttcataaaaacattggggaaaaactcacatcagagttcttactagcaacactggaaattataagaaaatagaccaatgttttaaaaaaaattctgagaaaaaaatactccaatctagaattctatatctattcaaactatgtatcaagtaaagggtaaaatacagatatttttctaatatgcaataccttaaaaattctgtctcctgtgtgtggtttctcaagaaacttatggagtatgtgcttcatcaaaatgagggagaaaactaagaaagaaaaatatatgggacttaggaagcaagaaatcaaacagaagaaaaaagacaaaggggattaccagggcgtggtgaccccaggtatggaccccaggagaaaagctgcccagcagccggagatacaccagtccaaaggaagcaagaactccgaggctctgggagtgccacttccaaggggcgaaatggacacgagggatttccttacggggttgttgatgtagctctgttgttgttattgttgttaccatattaagaggaaattttaaattttgttggaaaattcaggaagaataagtgatgggtgcacaaaaaagtacgtaaaaagctttaaaaggaaggcaatttttaaatcaaaaccaaagcaaaatatcgttcaagaaaataaatgtcagtgtggttcaacacatgaaatgactacttggttcagctgtgaagaatatttacattgtcatgaatgttaaataaaaatttaaacaagaattatgataaaattattttaggaagagaaaggaggaagagaagtgtgtgcgtgcgcgcgtatgtgcgtgcgcgcgtacgtgtgtgtgaagtgatagttgttgcaatattaaatccctagagtaatatttaatatattttaaaatatccatttaagcacattgtttagaaatattggaataagtagcagaagaaactgctcagtttctttataaacctcaaagtcttacttaaaactctgtgaatgtgtttatgtttgcaaaaaataatttaaaggagtcatctagtatttctgggcgatccataaaacctctattaaatactaaaagctgcagccctaatcccagttacaggtcagactaccagacttagggatatcctgcaaaaaaatgtaggctgcccactactttcaagaaccacaataatataactggtgtgtgggaaaagccttagacccagagttcatctggagacaacttacttaacctctctgagcctcacttgtctcgtttctaaacttaaagagttcgttcggaactaactaaactcaaatgaaaggcaaataccaaaagtgagacagatcaagcacaaacgccagcatcccttacagaggacagtctcaactcagatgcagccaactgctgtcatgaagacctgttgttgctaagaggtcagatggttcaagagaaactggaaatttggattttgacatgaaacctctggaatttaaaatactagtttaaaatgcacagtgcctaccaaaccaaacctatctgcaggccacccctaactcacagattgccagtaaagacctctaaatcagatgaacattaataccctctaggtctattactctgtggcagtgcagtgctgcatgactaaaaatcttcactgaatgaatgtgtttctttaccactaaacaggcagcgtgtttttactcaaccttgacatatgacttttttttttcattatgaatactcatgaatcttaagacctgagatctgcacagagtctttactcgaagaagtactgtcataaacagagataggttctgccgaacatggccggaccgaaaaatcagggagcaattttcacaggtacacaatcgagtaagaactgccatcaatctgtcttttcagacatattaatccacaaagatagaaatcacttttatatgccaaggacaatatcaagctcagtatttgctaagactatctttcagtttttcatgaggaaacttttccctgccactgataattatcttcttggttcacagatctggaaagcatgaagactgggctttttttcctatgtctcttgggaactgcagctgcaatcccggtaaatttcctttcttctgttattacatctctttctcctgacatttaatgcagaaatcctccatttaaaagaaaatgttcttatataatggtttgaaattctctttttattttaattatattctttattgcccaagtaacaaacaaataactggaaaactcaagataaggtacttaaaaaaaaattttagaactatcaggttctacaggacacaataaatatgcagcagaaagtttgggctatcagtttattagccatagaatcagcccaaatacacaagagacaggaagaaataaattctcccagggaagctcatcacattgttattataaacccaagattttaggccaggtgcggtggctcacgcctgtaatcccagcacttcgggaggctgagatgggcggatcacctgaggtcaggagctcaagaccagcctggccaacatggcaaaaccccgtctctactaaaaaatacaaaaattagccgggcatggtggcgggcacctgtaatcccagctactcgggaggctgaggcaaggagaatcaattgaacccaggaggcagagattgcagtgagctgagatcactccactgcactccagcctgggcaacagagtgagactccgtctgaaaaaaaaaaaatacttagggtgcatatccacggtctccagcagcattttcttcaagatcaaatagatgctggctgagaaattttgagagtctataatgaaaacagaaaccaatggtttaggcaggaaacgatatggtaatcataaatcagctcctaattcacccttgggaggctgtccaagcaagtatgctgaaagtaggcagggctagaatattctcttcttcatggtcagatatattggccccatttgcacagcaataaagcagctgtacacaaatcagatcatttgaaaccgtgtcagtggcctcaaaacaaactgaaagttaaaaaacaaatgaaaccatagcatgaatgaccactggagatgttctgcaaatgattcatgtaatccttcattaaaccaaaggattcgtgccatattttttttctttttcaccaaatggaggaatcagcctcctttaaagagacaaaacaatttctcaatcgtccctttcctcccttcttctctaggtctaaaattctgtccttgctttttggataagttgttagctagcttctggttgacaaatgtgtcagcaaaaacaaactccatggcacccagaccaagctgttcttggaagacagagtttatacccaccatcaggaatcatgcttaagtagtatggagctactctagctgaaattatacattacaccctgaaatcacaaaagcgggacaagttaatgttcaacactgaaaggagttcccacaaaaccgttgttttctcctgaaaatgtgctttgtccttgtggctgttgctgttatgtaaataaacattaaaaagtgtctttgggccacgcacagtggctcctacctataatcccagcactttgggaggtcaaggccagaggatcgcttgagcccaagagttcaagaccggcctgggtaacatagtgaggccacgtctctacaaaaaaataaataaaaaattagccagctgccatggcatgtgcctgtagtcccagctacttgggaggcacaggagggaggatcccttaagccagggtagttgaggctgcagtgagccaagatcgcacacagcactccagcctgggtgacagagcaagactgcctcaaaaaacaaaaaaagtgtttgaaccaaatgtttgaatgacacacttgcatttagacacattccagatgtttcctttctgggacaatttgatatcatgtaaacctagccaaactgctagaaagctaagtatcttctcatagaaatgacctattaaaaatttgtataattttccctgcctgcctgaattctccagatgaaaatggattctgtgtagttgggagattccaaatagatttccagagttaaataaatagaaatatgcccatagtgataaaacataatttcaattgcagaatatttctgaaagtaaaagagctgccattttttgtgtgcatttcttcctgcttgggcagtaggcggatggagggggagagagagtgaccagttctccactaataagcctaaaatctcccccatccattgccttctatgatgccccctgctggcagcttaccaaagtggccaccattctttctccttttcccccttctttaaggcttctttataaactttttcaaattcattacccatcttaggtgaaaaggagataagaagcaaaggagcaaaccaaacctaatatgaatcctgtactttggccagaagccgtggctcacatctgtaatcccagcactttgggaggccaaggtgggcagatcacttgaggccaggagtttgagaccagcctggccaacatggtgaaatcctgtctctactagaaaaataaataaatacaaaaattagcagggcatggtggcaggcacctgcaatcccagctactcaggaggctgaggcatgagaattgcttgaacccagcaggtggaggttacagtgagccaagatcaccactgtatttcagcctgggcaacagagtgagactctgtctcaaaaaaaagtttaaaaataaaaaataaatcctgtactccatgactattacacagtcagcactacaggacctgctaatggaataaaaataagttaatccaaatagaatctcagtttcatacttacacctggataggccatctgagtgtccagagtatctctctaataaagatccatggtgaatatctgcctcagatactgggcagtttatattattgacacagtgtgacattagtactagaaatagtaattttcagttgggcaactccttaaaatttataacatattttttatacataatcttattttgatatttctgctcacttgatatttcttgccaccttgagagatggcagggtagaaattaatgaccttggccggtcatggtggctcacacctgtaatcccagcactttgggaggccaagacaggaagattgcttgagttcagaagttcgaggccagactgggcaacatggtgaaactccatctctacaaaaaatacaaaaattacccaggcatggtggtgcctatagtcccagttactggggaggctgaagtggaagggtggcttgagcctgggaggcagaggttgcagtgagccgagacttcatcactgaactccaccctgggcaagaggctggagttaattaattaaaaattaatataatgaattaattttattaatgttttttaattaataaaaaatattaacgacctgtcaaaccacagatagaaagtaaatagcagaggcaagacttgaatggaggcctcttacctccaagttcagttgttcaacttccccatcatgcatcactgcccagctctttatccaagtctccaatcttgctagaaataggaccatccctctaatagaaattaatactccagacatgcccttttctacttaggcttagtgccctgtctcacacagtctgaattaattctaattttttttgtttttgagatggagtttcactcttgttgaccaggctggagtgcaatggcacaatctcagctcactgcaacctccgcctccagggttcaagtgattctcctgcctcagcctcccgagtagctgcgattacaggcacccaccaccacacccagctaattttttgtatttttagtagagacggggtttcaccatgttgtccaggctagtcttgaactcctgcccttgacctcaggtgatccacccacctcggcatcccaaagacctgggattacaggcgtgagccaccatgcccagccccattaagatttcctgaccaacgttaaggccaatggcgttaagaaatcaaataaatattgataaaaagtttataaatttttctgctaattatcggtgggtacttaaattaggcaaatgtacaatactatatcctatggttaattttatttgacttcaactttctgctaaacaacactttccaaaattgtaaagtacaaatgctttgcaaaagtttaaaaaacacagaaaataatttcaaaactcaaagttaccattatttaaatgcattttgttttattttcacccagtctctgcataaataactttttcttaaacacaattgagattctgcttccacttaacattctgttctaggcatctgcttatatcctcaaaaactctagagaatatttttaaattgttggtataaatgaagtatattgctactaataatgatgacaacaagagtaactagcaaatttgtaaattagcatccagacatgaataacaaaaaccagtttttaattttttcagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggtaaaagtaacatcatttatattaatacaattttttaattctccaaaggtcttagtttcaaagcatggtaaaagagattatgttatttatgtctcagtttaatttttttaaaacatgatgatcacctcaactgcctccaatcactagaagaatgatgaggattaatgagttttactacttgggctgagctgctgtatacttgtttcattttataaaatccaaattcagtttaaacctgtggctacagagtgtgaggaatattataaacatgtttacatgatagtgtgtgaagaaaaagaataatgaatattaaatgttaccttaggcataaatatggttacattatcatttgtttgaagaatgaacttttttttcttttaaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggtaaaattattttaaatggtccttgtccaataaagccagcattatcaataaacagtcatgacctttctctgtgctctcacagtgtcctgtatggatgtctactagtacattactaaaatatattacagttatttctttttaggtctatctctatcattaggctgagaatgcctgttttatttgagttcccgtagatgcagatcttggatttgagtgttgtttatttaagaagcacagggaacaaagaggagtgcagaagtaacacaagaaggaaaggaagctaataaaaggaacatcattcaagccatgtaaagacattttctcagaagtattccatttggcgactgaaggagctagggtacttcttttggctgaggattgctagaggggtattaatttcccagcatttccagcctgtcccttgagtgagccaggtcaatttccatgatttttcaggcacggaaatgcagatattggccattgaaagtccctggaactagctggaatgataaattatgacagatctgaaggataggagatactggcaactgctgctctaatgccttgaaagcagatgccatattgttttcgagttgaatcaccagtgtccaacaaaatgtctctgacataacaaaagagccaacaatgtttgttgaattagttataaagattaaggtcctactttattaagcaaacacataccaaaatgataatctggaaactacagcaggatcggggcagggaggaagcatatttggagctttcattcaaaatcctggcagccacaaagtcctgtgccagcaggacttggcacagattttggtacacaaggtcaatggtaacctcagttactgagaactctgctgccactctaacgtaggagttttcttataccttaaaagcctggtatgaaagctttaccaacaaattcagagagatttccaatgtaactctggcttaactacaaaatcacaagataatactacatttctagtgttttctcaaatccaaagaggagactccaagtcttattgagtaatccccagagataacgcactaaatctcactgataaagatagaaatgggtcctgttctccaagggttactgtctacctccacagttgtgactgatttccctttcttttttcttttttttttttttttgagacggagtctcactccttcacccaggttggagtgcagtggcgcaatctcggctcactgcaacctctgcctcccaggttcaagcaattctcctgtctcagccactcaagtaggtgggactataggcgcctgccaccatgcccagctaatttttgtatttttagtagagacagggtttcaccttgttggtcaggctggtctcgaattcctgacctcaggtgatccacccacctcagcctcccaaagtgctgggattacaggctccatttcttcttttttttctgttttgttttgtttttagagatggagtcttgctctgtctcctaggctggagtgtagtgatgcaatcacagcttactgcaacctcaacctcctgggctctagcagtcctcccaccttagcttcctgagtaaccgggaccacaggcatgcaccatcatgcccagctaatttttttttttttgggggggggggtgggtagagatggagtttccctatgttgcccaggttggtcttaaactcctgggctcaagtgatcctcccaccttggcctcccaaagtgctgggattacacatgtgagccaccacacccagcctggtttccctttctgagatttgaaatgatttgagcatgaaaaatactcgtgaaagtatgcacagtggaaatataaattaagtaatggctctcctcttagtagattttaacttttgctcttgttattctaaaggccaagaaagcagagaactcatcaaatgaggaggaaacgtcaagtgaaggcaacatgagggtgcatgctgtgggtgagtatgcatgaagcaagctgtttgtgactatatcaaggaagaaatggaatctgccactttgggcttgtccctccatcctttgtgaatgctgcacagaattttttctctccccagtcctccccaaggaaatgctcccataaattgttgacattttcttgtgcatacttgatatacaacaatgggtaaatgtgtttgcaaactggaagccctgttgagatattagtgaaagggctagagttcttccttaaatccttttgcttctgaaaagacttaattctatcttatttattctcaaatctgtaacttgctgatgaatttatatcccatacttgataaaggaccttattcctccccctatcacaaacattttgaatttcagccttatttcacttctgaccagcttgcacaacgttgcactaaggacttcagactatgaccatctcaggcatagaagagctgtctgttctttgcacatctccaatccaaactgctgcaagaggaaatctagattatcatgtaaaataatcagtaaaattatcatgtaaaatagaaggttccatctgacattaacacatcaattaaagaggattccaatgtcttcccacttccaaatttgcaaatttcaaggacttcaaaatttccccttcattagtgaaaatgaaactagttgagtgaatttgtatttacatactcaatttaactttgtccatgcttcctgcccaatcttttctgttagattcttgcatgagcttccagtgtaaaagaggccacatctgtaaggcagaccaacagggaaaacctcactgtgtctgccaggatccagtgacttgtcctccaacaaaaccccttgatcaagtaagtattctgcaaaatagtctttaagtggctccaaaaggttagtgactgaaataaaaatatttgccattgaaatttttgcttaaaaaaggtagatacctaggttatcatttggttatttgggatatttggaacatctgcagttttcattctactgagcttatctagagctaaattgtcatcaccgttggtacagtttagttgatttttttgatgccaaatggaacaattacgattttaatagtctcacctacctgaccacatctttggcacagcgctgttatcagcatatgagctttaaggagcagagtgtcttccagtgagcatttggctctatcagctttttcttctacttatcttccataggtttgtggcactgacaatcagacctatgctagttcctgtcatctattcgctactaaatgcagactggaggggaccaaaaaggggcatcaactccagctggattattttggagcctgcaaatgtaagattatgtccctcctgtcaaccatcatctctgagagggcttggggtgaatctggacatgcctgaattatctatatgcaaacagggaaaagctgatgtagttctgaacacaaaaattatcaactggagaaacttaaaaaataagaactctcaggccttaaccgtaggagattctgatttaactgaactaggttggaatcctgacattgttttttttatttgtttttgaagtaacctagacaattctaatgtgcagccagggctcagaaccactatgataatgctatccacttaatcacagagttgaatcactggaattttgctacattatttgccctcttcccaatttaagttaagcctttgccaagaagtctctgacaacacatttttccagaagtgttttaaggctgtcttccttccccaggatattctcaattgtgtttggctccccttaccactaagtgattctccacattagcagtgctcactaatgtttccgggtctcctccccttccagacacaggagaggatgaaacatgtcagcctcctggacgttaggtatgaccatatatcttgctttgtccagggaaatgtgaaaaaagtcatctatgtgagttctgggcagaagcattcaagagctggggtatggttctccatcctctgctcctttgccaccacaaactctctttgagatagtggcctcaaaaaatggcaacgtcattggtggctggcaagatggccaaataaggaccactctggtttgcagctcccagtgagatcaacgcagaaagagggtgatttctgcatttccagctgaggtacccagctcattgggactggttagacagtgggtgcagctcacagagggggagccaaagtagggtggggtgttgcctcacccagtaactgcaagggatcgggaaactctctcccctagcgaagggaagctgtgagggactgtgctgcgaaagacagtgcattctggcccagatactacgcttttcccacagtcttcgcaatccacagaccaggagattccttcgggtgcctacaccaccaggaccctgggtttcaagcacaaaactgggccaccatttgggcagacaccgagctagctacaggagtttttttccatatcccagtggcacctggaatgccagcaagacagaactgttcacttccctggaaatgtggctgaagccagtgagccaaatggtctagctcagtggatcccacccccacagagcccagcaagctaagatccactggcttgaaattcttgctgccagcacagcagtctgaagttgacctgggatgcttgagtttggtgggggggaggggcatccaccattactgaggcttgagttggcggttttcccttcacagtgtaaacaaagctgctaggaagttcggactgggtggagcccacggcagcaccagaaagccactgtagctagactgcctctctagattcttcctctctgggaaaggcatctctgaaagtaaggcagcagccccagtcaggggtttatagataaagctcccatctccttgggacagagcacctgggggaaggggcggctgtgggcagagcagacttaaatgttcctgcctgccagctctgaagagagcagcagatctcccagcacagcactcaagctctgctaaggaacagactgcctcctcaagtgggtccctgacccccatgcctcctgactgggagaaacctcccagcaggggtcgacagacatctcatacaggagagctctggctggcatctagcaggtacccctctgggacgaagcttccagaggaaggaacaggcagcaatgtttgctgttctgaagcctctgctggtgacacccaggcaaacaaggtctagaatggaccttgagtgaactccagcagacctgcagcagaggggcctcttagaaggaaaactaatgaacagaaaggaatagcatcaacatcaacaaaaaagatatccacacaaaaaccccatccaaaggccactaacatcaaagaccaaaggcagaaaatccatgaagatgaggaaaaaccaacacaaaaagcctgaaaattccaaaaatgggaatgcctcttctcctccaaaggatcacaactccttgccagcaagggaacaaaagtggatggagaatgagtttgaggaagtgacagaagtaggcttcagaacatgggtaataacaaactcttctgagttaaaggaacatgttataacccaatacaaggaagctaagaaccttgaaaaaaggttagaggaattgctaaccagaataaccagtttagagaagaacataaatgacctgatggagctgaaaaacacagcacgagaacttcgtgaagcatacacaagtatcaatatccaaatcgattaagtggaagaaaggatatcagagattgaagatcaacttaatgaaataaagcatgaagacaagattagagaaaaaagaatgaaaaggaataaacaaagcctccaagaaatgtgagactctgtgaaaagaccaaacctacatctgattggtgtacctggaagtaatgaggagaatggaaccaagttggaaaacactcttcaggatattatccaggagaacttcctcaacctagcaagacagaccaacactgaaattcagcaaatacggagaacaccacaaagataatcctcacgaagagcaactccaagacacataattgtcagattcaccaaggttgaaatgaaggaaaaaatgttaagggcagccagacagaaaggtcggaatacccacaaagggaagcccatcagactaacagtgggactctctgcagaaaccctacaagcaagaaaagagtgggggccaatattcaacatgcttaaagaaaagaattttcaaactagaatttcataaccagtcaaactaagcttcataagtgaaggagaaataaaatattttacagataagcaaatgctgagagattttttcaccaccaggcctgctttacaagagcttctgaaggaagcactaaatgtggaaaggaaaaaccagtaccagtcactgcaaaaacataccaaattgtaaagaccatcgacactatgaagaaactgcatcaactaataggcaaaataaccagctagcatcataatgacaggatcaaattcacacataacaatattaattttaaatgtaaacgggctaaatgccccaattaaaagacacagactggcaaattggataaaaagtcaagacccatcagcatactgtattcaggagacccagctcacatgcaaaaacatacataggctcaaaataaagggatggaggactatttaccaagaattggaaagcaaaaaaaaaaaaaaaaaaaaaaaaaaaaaaaaaaaaaaaaagcaggaattgcaatactagcctcagataaaacaggctttaaaccaacaaagatcaaaaaacacaaagaagggcatcacataatggtaaagagataaatgcaacaagaagagctaactatcctaaacatatatgcacccaatataggagcacccagatatataaagcaagttcttagagacctacaaagagacttagactcccacacaataatagtgggagactttaaaaccccactgtcaaaattagacagatcaacaagacagaaattaacaagtatattcaggacttgaactcagctctggaccaagcagacctaatagacatctacagaactctccaccccaaattgacagaatatacattcttctcagcaccacattgtacttattctaaaattcaccaaataattgaaagtaaaaactcctcagcagatgtgaaagaatggaaatcataacagtctctcagaccacactgcaatcaaattagaactcaggattaagaaactcactcaaaactgcacaaatacatggaaactgaacaacctgctcctgaatgactactgggtaaataacgaaattaaggcagaaataaggaagttctttgaaaccaatgagaatgaagacaaaatgggccagaatctctgggacacagctaaaacactgtttagagggaaatatataccaccaaatgcccataagagaaagcaggaaagatctaaaattgacaccctagcaccacaattaaaagaactagagaagcaagagcaaacacattcaaaagctagcagaagacaagaaataactaagatcagagcataactgaaggagatagagacacgaaaaacccttcaaaaaatcaatgaacctaggagctggtttttttaaaagattaacaaaatagatagacagctagccagactaatagagaaggaaagagagaagaatcaaatagatacaataaaaaatgataaaggggatatcaccactgatcccacagaaatacaaactaccatcagagaatactataaacacctctatacaaataaactagaaaatctagaagaaatagataaattcctggacacatataccctcccaagactaaatcaggaagaagttgaatccctgaatagaccaataacaagttctgaaattgaggcagtaattaatagcctaccaaccaaaaaaagctggggaccagacagattcacagctgaattctaccagaggtacaaagaggagctggtactattccttcagaaagtattccaaacaatagaaaaagagggactcctccctagctcattttatgaggccagcatcatcctgataccaaaacctgaaggatatacaaaaaaaaaaaaaaattcaggccaatatcactgatgaacatggatgcgaaaatcctcaataaaatactggcaaaccaaatccaggagcacatcaaaaagcttatctaccacaatcaagtcaccttcatccctgggatgcaaggatggttcaacatacgcaaatcaatgcgtgtaagccatcacataaacagaactaatgacaaaaaccacatgattatctcaatagatgcagaaaaggtcttcaacaaaattcagtatcccttcatgctaaaaactctcaataaactaggtattgatggaacatatctcaaaataataacagctatttatgacaaacccatagcaaatatcatactgaatgggcagaagctggaaacattccctttgaaaaccagcacaagacaaggatgccctctctcaccactcctattcaacatagtattggaagttctggccagggcagtcaggcaagagaaagaaataaagcgtattcaaataggaagacaggaagtcaaattgtccctgtttgcagatgacatgattgcatatttagaaaaccccatcatctcagtccaaaatctccttaagctgataagcaacttcagcaaagtctcaggatacaaaatcaatgtacgaaaatcacaagcattcctatataccaataacagacaagcagagagccaaatcataagtgaatgcccatttgcaattgctacaaagagaataaaatacctaggaatacaacttacaatggatgtgaaggacctcttcaaggagaactacaaaccattgctgaaggaaataagagaggacacaaacaaatgctcatggataggaagaatcaatatcgtgaaaatggttgtactgcccaaagtaatttatagattcaatcctatccccatcaagctaccactgactttcttcacagaattagaaaaaaactactttaaagttgggaaccaaaaaagagcccatatatccaagacaatcctaagcaaaaacaacaaagctggaggcatcacgctaactaacttcaaactatactacaaggctacagtaactaaaacagcattgtactggtatcaaaacagatatatagaccaatggaacagagcagatggctcagaaataatgccacacatatacagccatctgatatttgacaaacctgacaaaaataagcaatggggaaaggattccttatttaataaatggtgctgggaaaactggctagccatatgcagaaaactgaaactggatcccttccttacacttcatacaaaaattaactcaagatggattaaagacttaaacataagacctaaaaccataaaaaccctagaagaaaacttaggcaataccattcaggacataggcatgggcaaaggcttcatgactaaaacaccaaaagcaatggcaacaaaagccaaaattgattaatgggatctaattaaactaaagagcttctgcacagcaaaagaaactatcatcagagtaaacaggcaacctacagaatgggagaaaatttttgcaatctgtcaatctaactaagggcttatacccagaatctacaaggaacagatacaaatttacaagaaaaaaacaaccccatcaaaaagtgggtgaaggatatgaacagacacttctcaaaaagaagacatttatgcagccaaaaaacatatgaaaaaaagctcataatcactcgtcattagagaaatgcaaatcaaaaccacaatgagataccatctctcaccagttagaatggcgatcattaaaaagtcaggaaacaacagatactggagaggatgtgaagaaataggaacgctttcatattgttggtgggagtaaattagttcaatcattgtggaagacagtgtggcaattcctcaaggatctagaactacaaataccatttgatacagcaatcccattactgggtatatacccaaagggttacaaatcattctactataaagatgcattcacacatatgtttattacagcactgttcacaatagtaaagacttggaaccaaccaaaatgcccatcagtgatagactggataaagaaaatatgacacatatacaccatggaatactatgcagccataaaaaaggataagttcatgtcctttgcagagacatggatgaagctggaaaccatcattctcagcaaactaacacaggaacagaaaaccaaacactgcatgttctcactcataagtgggagttgaacagtgaaaacacatggacacagggaggggaacatcatataccagggcctgtcaggggctgggggactaggagagggatagcattaggagaaatacctaatgtagatgatgggttgatgggtgcagcaaaccactatggcatgtgtatacctatgtaacaaacctgcacattctgcacatgtatctcagaacttaaagtataattaaaaaaaaaaaaaaacggcagtgatcctgagctctggggagactgcaatgagcagagccctcctgccaacttgtattggacttgtagcaggattgcaaaattgacttctgtttctttaagccactgagatttagcattatttcttactgtagtatcagctaatagctacctttttctctattcaatagcacttgtgccctccacctacaaatttcaactctgattctacagcagtgattctggggcctagctgcacatccaaatagatcttggagctttaaaaacatcctgatgcccagacttcacgccagaccaatcacatcagaatttacttgattggaagctggcatttggtatgttttttaaaaccccaggcaattttgttgtgctgctgccagggctgaggaccactgtcataataatggggacctgagaaagctctgtcagttgccagaagtcgttaagcttcctattatgaggacttgccataggacacaaataagcccaaagattacagtacattttctgcttgtaacagctattcctacttgtacggactttgaagtgattcagtttcctctacggatgagagactggctcaagaatatcctcatgcagctttatgaagccaactctgaacacgctggttatctaaatgagaagcagagaaataaagtaagttatccacaggttagcttcttcaatgtctgtctacagggcatgaggaagaaagacgtggtgggggggctacctacctctgcatactggcaaaagcccactatgcttccccatgcccggttagcccatgtggcttaacagaataatagatgtcaccattcacgccacaaggtttcagacaccaccaaaccgccccattcttcccaatggtcagtggcctgaattagggctcttcaattcctacctagagcaagctctggttgagcaaagttaatataaatttagcattgatctagtcagtccaaacatcttatttaaatctaagcatttgttttgttctcataggccagacatagatgtatgatataaagtaaatccattactcaaaatatcagtaatatattaagattaaaaagcacagaacattgattccaaaagcttccagagaaaattcattcaccagatagttattgagtgtatcctgggtgccagaaattgacctaaatactggagatacagcaacgaaaagaaaatctctgccttcatgagtttacattctgggtgaagagacagactctaaacaaataagtatatatgtgtgtgtgtatgtaatgtttgtatatgcatatatttgtacatacatatatatgcatatatgcaattatatatagtaaaatgagcatttatgtaaatataaccaaatcagcaaatatatgtataagtatgtcagttgggattaaacatggtgtgaagacaaataaaacaagaaggagggtgtgcattaactgtgtcagatgctgtttataggttatgagttgaagactgagaattggccagggatttagcatgtcaaagtcatagctgaccttgataggaactgttcctggggtgggagcatgtttcaggagggaagctccagtggacagagttcaacagagactaggaggaatggatgcagcaagtatagacaatcctttcaaggagttttgctatgaagagataaagagaaatggggtggcagctggagtggaaagtgagtacaagagtcccacctagcagtgggagatggtagaggatgtttgcacgcttctggaaataacccagtcaagaaggaaatgttagtggggagcagagaatgcgcacaactgccagagggcgttcttcgatacatgtcccacccagaggagagggattggacttaggttaggagcacaggaaggtcgcagggagcaaagttgtggttctgggagcaggtggaggtcctgtttgcttccaattactcagtgaaataagaggcaacatcacaagctgagagtttcacaggcactgctcaagaataatttctagcccccgtcttgaataccttgtcacagagagccttgagggtattagctatgaaacagggaaatttcaatggggctggccaagcaataacacaccagggtgaaagcaagactgagtgggcactggatggatgacctagaagactaagagtggactctgtcatcgggggaaggagcagcacttttcactaactaatcaccttagtcaattcagcccttttcattaaaacctcatagtttaaaaaaaaaaaaaaaaagcagcgaacattacttggttaaaagaaagaggcaaaacatacttaaaatatttaaaagtttaaaaaagaatttaaatttcttctaaaaaccagaggtttcttacatcaggtgctattctgtgtagacatgagaaaggcctgtagtattgattggaaggaatttcatttagttgcacatgatgtcctgagcttgttttcccctatcgtgttactgtcactcttcaagtaaagtttatagcaagtgacaagtccattacatttgtctgattctctgacagtcttctgccttcctaatcccaggtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggataggtaagaactctttacctttccatttctagatttatctctctgataaaatatctacatatctatgcaaaaggaaaatctaaacagatttaggacatttcccagttccattttagaatactgaaatgcctggttaggagtctaaacacaaagctgctgtgtatgatgtactctagaacttaaggtataataataataataaaaaagtctgaaacttgatagagcttatgttgataaagtttatgttttataattttatcttttaattccatttctcaatgaactttttgaagtccccttatcacaattatcaaagctatgtaatattcattaaaaaaaaaaagctgctgtgaagatagcagaatatggctacaccacagctcccaagtttacatgttaaggtccagcttcccacagatactcctccaactttctcattcttgatcgtaaattcccaagattggcccaatgtgggtcaagtgactacatctaaaacaatcaggtatggccagtagatgagaaccaggttgtaccaacatgactgctgggtacacccctatagatttagggtgggggaaggacagttcctgtgaagacagaaaacttgtgaatcaacatcccaaaagctgtcaaccttacccacaaatactttatttcgttggcagtttttatctgtattctatttatatcacatatacagcaaccttatgggagaaaaatgtccttggtgagcctgagagttaaatcttcatgcacaagctactcaattaataggatgccatgtatttcattgcagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaaggtaaattcatcaccagccaaagaagagggatgtcttcttcctcagacaagccctaagccctgcatgcttcatagagaggtcctgccacatgttcgaattggaagctagaaaaaaaaaggtggcagcttcccagataggactcccttggtgcacatgctgtcattgcgaagtcacttcttactacctttatggcactgttttcaaagggtagcaagggtgaacatgcattgaggtctcaacagtcagctaagcctagaaagacgtgtgaatccagaattgggccaaatctcagcaggctttgtgtccttccttatttcatatcctaccttaacctgggccttgggccaaacttttcaaaattacacataaagaataaaaaagcaagcccatttctgacaatgggagatgtcagaacatctcagaatccattaccaacacactaaagactggattttacatcacaattagtgctgggataatcctttaacccaaaactcacccatggcttcaccctcaatgaatgggagctgtgggagggtagatcagagtattctttctttactcctgcagtggaggaaattaaatttagatgcttgttttgctgggttatgtcttaatatgtttccttttctttccttaagttaggcttgaattttatgagcaagtatgttttcaataattaagatatgaaaggctgggcacggtggctcatgcctgtaatcccagcactttgggaagccgaggtgggtggatcacgtgaggtcaggagttagagactagcctggccaacatggtgaaaccccgcctctaccaaaaatacaaaaattaggcgggcttggtggcacacgcctgtaatcccagctactcgggaggctgaggcaggagaattgcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaatcagatcaatttaaccattccacaaggtatatatattttaaaaggtcatgttttacatgataaatacataccatttttatttgtcaattaaaataaataaataagaaaaataccactcacagaacataaattaacagtgaacatcaaatctctgaaacagagatttcattcatgtttacaatatacccttgggataaacatgcagctaagccgttaaagaaagtcagttcatcaaatgtcagaagttcccaaaaagaaataacttgtgcatacttcatttttaaaatatcccccatgcatatgtagaatgccttgaaattagagaggaagaggtgaaagtatgaggatttacttattaataaataggtaagcagagagggtcagtccttttccttgcaatatcattctgtgaaataaacattctgtgaaaggatgtatatttttgtaagtacctagttctgtgtattagttgtctatgctgcatagtgaatcaccccacaacttaacaggttaaattctttctcacggtttccaagggtcaggaatctcacagtaactaacctggatggctctggattaggatctctcattaggttgtggtcaaggggtcatgcagtgcggcagttatctgatggcttgactgcagctaagggtctacttctaagcccactcccatggctctttgcaggagccttcagtatcccatcgtgtaggcctctggtctacagggctgcccacagcatggtatctggattcctccagagcgagtgaccaggcagaaagagagaaaaagccaagactgaggccccaatgtcttttataacctaacctcagaagttatatatcatgatttctgcctcattctattggtcacactgaccaatcctgctacagcaggaggaggagaaggagaccacagggggttggatgtcaattgtctttctaacatctatgatacaagcagagtacttataaaaattcaaatatatccttctgtcctgccctgcccaccattatctagaggggaaaactcagctgggataggatgtatttatggatgcctgtttatatgacatgtgattttaaaggactgataaaaaggcaaatttaaacagaggccattttacttaagaaaaccagttgcatctcattcttccttttgcaaagcttctggcagctcttcagtgtgtaagctcacccaggctccgctgggcggttgtctgggaggagcaggaagggcttaaaatccagtcatttacaaagctgctaatgatcttgtttgtgcactgtggtttggccatcattgccttattttgaagaaaggaaaaaattatcacataataaaccaataaagcagatattaaatattcagtcagaacacgtaaacaacttactgctttggaatgtagctaaagaaaaacaaatttatttgtaagtatacccttctttccttcaaggctgagaaatctacaggagaagataaagtttagccaatgttttcctgaattttaactgcctgtgatagacgtgctcatatattcctcacatagctgttattaactagctgtgtgaattagggcatgttgcttagcctcagtgagtctcattttccttatctgtaaaaatggggttcaggtaacaggtgcaggaatcctcatttattttgtgcccatgcataccatgcattgacacatacccatgctaatcgtcagaaaaccctccaagtgagactaacagggtaaacaactcagatgacgcaagttcccctaagccatttaaagacattatcctaagagtactggggggccaccaaagtgtttcaaacaagccagtgatttccctgggtttgtatttaagatggattctcctggttacattgtggtggggccaaagaattgttgagagaatactgtggtaaacccaggcaagagctgatgagaacttgaactaggggagtgaccaaaggggaaaaaaagagagaagtaaacatattcaagatatattttaagatataagcatactcaaatatatagcatgtggaaataagacaatatttgataggaaatatgtgggagccgagagcagacaggtgagagactgaaaagagaagtgcaatgcctaggtccctggctcagagcaggcagggtaaatagaggtaaatagaggcatcttccactgagaaaacacaagaacagaagtggatttggagtaaatgacaaattccattttagatacgttgaattgtaaagtattaggttgcctcctaagtgttagtttcatgcaaaagtaattatggtttggccattatctctaccactccatcaaaactaccattatccctaccatgcccaccactgatgggcacctacattgattttatatctttgctattgtgaatagtgctgcaacgagcatatgagtgcatgtgtctttttagtaaaatgatttttttataaatatacccagtatgggattgctgggttgaatagtagatctgttttaagttctttgagaaatcttcaaactgctttccacagtggctcaactaatttacattaccagtgtctaagcattctttttctctgcagcttcaccagcatgttgtttttagactttttaattacagccattctgactggtgtgaaatggcatcttattgtgagatggttttgatttaaattttcctgatgattagtaacgtggaactttatatatatttgttggccgcttatatatcaagacagggttttggaactgaaatgcatatttgaggattataagcatacagagaataattgacaccagggaagggaattaattctcccaaggaaaacgcattgagttacatgaaaaggggtctaggattgaacactgcactgagaaacaacaacatctagatgatggataggggaggaagaaagaattcagtaaggagaatgaagtttctcctgaaatgaaggaagaaaaccaggatagtgccatgcaaaggaggtgtttcaaagaggaggaagagattaacagtgccaaatgcgactgagatgtcaaagaagttgaaagaaataaggatatcctgggtagccttggttagagtagttctggtggaatggtagacatggaagtcacattctatgggttgagaagaaaagggagattagaaagggtaaggagtggatgtttgagtgcaggaaagacctagaaaagctacagagcattttctaaaaaaggggagcattttttagaataaaagagatttgagcactcctttcatttactcattcatttgctcaagaaatctttacaggccaggcgcggtggctcacgcctgtaatcccagcactttgggaggctgaggcaggcggatcacgagttcaagagatcgagaccatcttggctaacacggtgaaaccccgtctctactaaaaatacaaaaaattagccgggcgtggtggcgggcgcctgtagtcccagccactcgggaggctgaggcaggagaatggcgtgaacccgggaggcggagcttgcagtgagccgagactgcgccacttcagtctggcctgggtgaaagagcgagactccgtctcaaaaaaaaaaaaaaaaagagagagagagaaatctttacagatggtctacataaatgcaggcactgttctagaggctaaatatgaaacatatttaaatgctaatggaagggtctagtaaaaaaggaaaggtggaagaaggatgtaagaaaaaaagaggaaagtaaaaggagaatcttgtgaaggtcagaagagatcttgagcataggtagaggaattagccttaacgtcaagaaaaaggacaatctcttatctgagcaacagaaagaagacaaaggctatgggtgcaaatataagtaaacgtataactaatgaagctattatctccattttacatatgaagccagtactcaaaaaaaaaaaatcaaagtccataatctttcccattctctgggctagataaagattattagcaggaaaattacctagtgcccacacagagtagtataatagtttgttagggtgggccatgttggtaaggagtgatcttatatttgctagaggatgctgtcttcttccacaggtatggcgacaatttctttcacaagctactcaattaaaaactggaataacctagcactacacttctatttatttccattatttttcagctcaccttctagattagtatactgggcacttcttggctggacctcccgttaacctgctcttcctctatcagtggttctcaaccctgcagccaaattacctgcagagttttctaaacgtctacatgccattagtccacccctagggattctgattctagagtccagaggtgaggcctaaaaatacatatttgtaaaagttcatgagtgatgttgctgtcctaccaaagttgaggatcaccattatactgccttattagatggtttctctaatcccccaactctaatattgtttgtgctactactctggctactttctaaaagtgtcattttgcttcttgtttttttatagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 35671 - DNA, 3447 bp, Homo sapiens
accgccgagaccgcgtccgccccgcgagcacagagcctcgcctttgccgatccgccgcccgtccacacccgccgccaggtaagcccggccagccgaccggggcaggcggctcacggcccggccgcaggcggccgcggccccttcgcccgtgcagagccgccgtctgggccgcagcggggggcgcatggggggggaaccggaccgccgtggggggcgcgggagaagcccctgggcctccggagatgggggacaccccacgccagttcggaggcgcgaggccgcgctcgggaggcgcgctccgggggtgccgctctcggggcgggggcaaccggcggggtctttgtctgagccgggctcttgccaatggggatcgcagggtgggcgcggcggagcccccgccaggcccggtgggggctggggcgccattgcgcgtgcgcgctggtcctttgggcgctaactgcgtgcgcgctgggaattggcgctaattgcgcgtgcgcgctgggactcaaggcgctaactgcgcgtgcgttctggggcccggggtgccgcggcctgggctggggcgaaggcgggctcggccggaaggggtggggtcgccgcggctcccgggcgcttgcgcgcacttcctgcccgagccgctggccgcccgagggtgtggccgctgcgtgcgcgcgcgccgacccggcgctgtttgaaccgggcggaggcggggctggcgcccggttgggagggggttggggcctggcttcctgccgcgcgccgcggggacgcctccgaccagtgtttgccttttatggtaataacgcggccggcccggcttcctttgtccccaatctgggcgcgcgccggcgccccctggcggcctaaggactcggcgcgccggaagtggccagggcgggggcgacctcggctcacagcgcgcccggctattctcgcagctcaccatggatgatgatatcgccgcgctcgtcgtcgacaacggctccggcatgtgcaaggccggcttcgcgggcgacgatgccccccgggccgtcttcccctccatcgtggggcgccccaggcaccaggtaggggagctggctgggtggggcagccccgggagcgggcgggaggcaagggcgctttctctgcacaggagcctcccggtttccggggtgggggctgcgcccgtgctcagggcttcttgtcctttccttcccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccaggtgagtggcccgctacctcttctggtggccgcctccctccttcctggcctcccggagctgcgccctttctcactggttctctcttctgccgttttccgtaggactctcttctctgacctgagtctcctttggaactctgcaggttctatttgctttttcccagatgagctctttttctggtgtttgtctctctgactaggtgtctaagacagtgttgtgggtgtaggtactaacactggctcgtgtgacaaggccatgaggctggtgtaaagcggccttggagtgtgtattaagtaggtgcacagtaggtctgaacagactccccatcccaagaccccagcacacttagccgtgttctttgcactttctgcatgtcccccgtctggcctggctgtccccagtggcttccccagtgtgacatggtgtatctctgccttacagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggtgagtggagactgtctcccggctctgcctgacatgagggttacccctcggggctgtgctgtggaagctaagtcctgccctcatttccctctcaggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaaggtgggtgtctttcctgcctgagctgacctgggcaggtcggctgtggggtcctgtggtgtgtggggagctgtcacatccagggtcctcactgcctgtccccttccctcctcagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctta

SEQ ID NO: 35672 - DNA, 23378 bp, Homo sapiens
agagcacatccggtgttagaagcgctggtaggccttggagaggcgggttaggaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacagggtgtggagggaagctagggaactagtgctgcgcgtgcgcaacagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcaggtgaggtggctttgctttgcttggtcttgaggttttgtgggcgtctttctaagtctgctcagcaagggcgtcgttgggcagtttttatcttgggcctacttgctggacctgtggtaacaagtaggctttggtatctttgtatatttactgagtgtagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaaggtaaataaatggcaaatggacttttctagttacttattgatatttatttacagtttatcttttgtatgtgtggtttaagaattgaattctggaaagataccggaattgcataaacacatttcttatgacctgcgtatacacacttttttctgtaattattgtatttacactctttggtgttttcttattctttgtgtctaatatttttgttctggcctaaagaatatgttgacatttagattctctgccgccactttcctccagtagggacagaatagttgaacccttgagaaatacaatctgtacttttgatccatagtttgcttcttccgttatttatctggttgtggaaacatggtttagtaccttcctcctctttttttttttttttttttttgaggcagagtctcactgtcgcccaggctagagtgcagtggcgcagtcatggctcacttgaaccttgacctctcctggcttaggtgatccaccccagcctcctgagtagctaggaccacaggtggacgtcaccagctccagctaatttttgtattttttgtggagatggggtatcaccatgttgcccaggcttaccaactccagaactcaagcgatttatttatttattattattattatgttttttttttgagacagtctcactcccttacccaagctggagtgcagtggtgcaatctcggctcactgcaacctccgcctccctggtgcattcaattctcatgcctcagcctcctaagcagctgagatgacaggcgcgcaccaccatgcccagctaatttttgtatttttagtagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaaggtaaaattaatctagatacttagcattttcaagttattttccctgattatagatatagttcgcgctctttatacaaatgctgaaaatgcagaaaaatgtcataggaatcaatgtatgttttgggagggtttttttgttttaaagatttgttttcacctatggctgaaacttttgaaagcttatataaatgaaagcttatttttctactgtaggatggaatagtaaaaagagcactagactatagtggtcagaagaccccaaatctggttctggctctgctatttaactttctaatgttggtcaaatcaatactaatgtttgttttagtactttacgttgatttcacacagattttcttattggcattcagtagagcaggtattgatcatcatcgttatcttacagatgaggaagctgaaataaccttaggtaaaatgatttttcctaggttatatagtagaaagtggcagcacttgtgacaccaaatcctgtcctcttgccactattacattgcctttttgaacttaaaaaagatgtataaaatgggcctaatctttccctttccttgtgggttgatgtgtgaggattgaaggtgatacatatataaaagcaccttaaaagttataaattttatataaatatagtcaggagtattagtatagaaggtactactgctggcctgacgagtttcattttatttcgtaaactgcccaagggtattaattttctctagagaaaccattgaatattctgatgctctaacttctgattttttttcctttactactttgacctggttgtagaatctggtagaaatgtcttctaccactctgttttgttcccccagagtttctaaccaaactgcatgcagcccttcgtagtttttatacacattttgttttccaaagatggtgttcgagaccaaggagagaaaggctgtctccttgacttaaaggttacctaagtgaccccttgaggtaggttccactctgagccagctggggaatgttgatttgaggttacagcactcttgatctgataatagggtctaaatttgctctagagactttgtagtgcttaaatcttggggatagctgagctgaaccagatgcaagctctgccctcagggtgagaagtttctgcacaattaactggaatccaaaacacgtgaaaaaggagcttcaccagtgagggtgaagtgggtatgctgtttgtcttaatttatgtgtgctccccatttgggctaaatatggtgttattagggagggattactggtttatactggaagaagattatgtatttaggattttggggccttcttaggattcagtatctgtcaaacgttatagagagggagatgaagtagtgtcaacgtttggtacaaaaaataatttactgaaggcagtaggcatttcatctccagttactggtttggttttgaggcagccccctggaggagatggattcagtattagctaatccagggatttgggtccaagttaagggagaggcggggacatctagggtgtccacctgggaagatcaaagcttggtcctagttgaatgaaacaattccttggatggttccgaaactgaactgacctacctcctgggagtggcagggaaagcatcaagcttttgcgcatttacttcatcaaatcctttaccatatcagattatcacttagtggctattaggctgtctcaaaatgtccatggccctgtgggacaagagagatagtataaatgtgctagaagaaaggtatgccatttaaacaaaagtacagacgggccccaatttatgatgattggacttaatgattttttactttataatgatgcaaaagtgctacctgtttgctagaaactgtacttcaggccaggcatggtggctcatgcctgtaatcccagcactttgggaggccgaggtgggcagatcacttgaggtcaggagtttgagaccagcctggccaacatggcaaaaccctgtatctacttaaaatacaaaaattagctgggcatggtggcacacacctgtaatcccagctacttgggaggctgaggcatgataatcacttgaacccaggaggcagaggttgcagtgagctgagatcgtgccactgcactccagcctgggcaacagagcgagactctgtctcaaaaaaaaaaacccagcacatttagaatttccatcttttcccagactagggatatctggtatgatattttcacatgagatatttaacactttattataaagtaggctttgcgttagatagttttgcccaacttcagactaatgtaagcgttctgggcacatttaaggtaaggtaggctaggcttaagctataatgtttggtaggttatatgtagtaagtgcataaattacgatactttcagtttacaatgggattattgggatgtaacttcattgtaaatcgagcatctatacttttaccagtaatgagatttttcaagtgcctttatgtttcagtttataattttcttttctctctttttttttttttcttttttgagacagagtctcactctgtcgcccaggctggagtgcagtggtgcaatctcggctcactgcaacctccgcctcctgggttcaagccattctcctgcctcagcctcccaagtagctgggattataggcgcccaccaccacgcctggctaattttttgtatttttagtagagatggggtttcattgtgttggctgggctggtctcgaactcctgacctcaagtgatccgcctgcctcagcctcccaaagtgctgggattacaggctaaaactagacttttaaaagagaataatctactgaagatattgtagtaatgagtacaccagtaataacaatgttagtacaccagtaataacaatggttaccatgtattgaactcattctatgtacaaagagctattttaagaactttatttgtattatctcacctaatctgcaaccttaggaaataaggattgttatgtactagtattttacacatggtaggtgaaactgaagtacagtgaggttaagtgccagcagcttgctgcatgtcccactgctaaggaaataactaggattcagaagtagcaggcagtcttaaccactatgcaggggacatggttatacagtgtatgaacattactcagtagtaaaaactaatgaatggaaagctttcttggccaaaaacacagaagaagaagaagaagaagaaaaaaaactactgacaaattactaacagttcttccccctcctttttttgtttttgtttttttgagacagagtctggctctgtcacccaggctggagtgcagtagcgcaatctcggctcactgcaaactctgcctcctgggttcaaacgattttccttccctagcctcctgagtagctgggattacaggcgcccaccaccacatctggctgatttttgtatttttttactagagactgggtgtcaccatgttggccaggttggtctcgatctcgtgacctcaggtgatccacccacttaggcatcccaaagtgctgggattacaggcatgagccaccgtgcccagccctttcccctcttttaaactatatgggatttttcttctaagtatcaatttggtcccttctagatatgtgggaacaaggttcaggatggttgaatttatacaacaggaagaaagaaccatgtaattgacaaactaatttttttgttttaattttataaaacggttttgctgtgttgcccaggctggggtgcagtgacacatttttgctctgttaccaggctggagtgaagcaacatgatgatggctcactgcagcctgaaattcctgggctcaagcaattctccttcctcagcctcccaagtagttgggacaacaggcgcacaccaccacacccagctaattttttaattgtttgcagagatgaggttttgctgtgttgcccaggttggtctggaactcctgggctcaagcgaccctcccaccttggcttcccaaagtgctgggctcacaggtgtgagacattgtgcatggcctttttccttttttgttttttggaagtgaacataaccttgagactttattgtcttcataataaaacataaactgatatttaattaaatgtgcgaacagtgtttctttgacttgctgttttaatgttgctgtacacactgaggcaaagtctgtcttggctccagcattgcatagaacgcatactaaatccacgatagttttgttttgcatagcttttggctacttcagcatgtttcatgttcactgtagctcctaggtgtgtgggaataggactgaagagaatggttgtgttttttttaatttttaaattttttttacacgtagtctcgcactgtcacccatggtggagggcaatggcgtgatctcagttcactgcaacctccgcttccctggctcaagcgattctcctgcctcagcctcctgagtagctgggactataggtgcccgccatcacgcccagctaatttttgtatttttagtagagacagggtttcaccatgttggccaggctggtctccaactcctgacctcatgatctgcttgcctttgcctcccaaagtgctgggattacaggcgtgagccaccgcacccagcctgttttttttttgttttgttttgttttgtttttaatttaaggctggacccttgataatagtctttcattttaggacaagggtaagggagatacctagaacaaaacaaggcatttaacatgacctagatgtccactgctaagaatgcctgtctcctcctaccagcccctgctgtccctgtcttcccaagcaaaagcagaccacaggaatatctaactcaaacaattgtgtttacttgagttttttcttgggagagctatgtattaagctcttagctttttgtttttgcatggctctggcagaggaggctggtcagggataccacagaatgatgacacttcagcaaaactttagcagtatgtgcatgacatgttgacagcttctgacaggttttcctctcctgggatgaaggcataacaggaggctctgaatgaaattagaggaatttggttatgattaacacctgaacatttacttttcagttacaaacgcagtataggcagattttccacaactccaggaggcactatccacattgtattctatgtaaataacccctcctctttattttagaattgaattagtaagtaataggcttagaggtgtgaaaggactgctgtattgaattttttagcagcttgtaatgtactttttttctttattgtggtaaactataacattttaatgtgtttttttaaaacaaagattttcatttaactgtgggctcctctggaatgttagcgagttacttggttaatggtactgaatataatacttcaagctcttaagagctgattgctcctagaatggaaaatacttgatatgagagctgctatttttgagttaagtgcaacttaatcttgtttggctgagtttgcatatcggccattgaaatgtaggtatcttttctgagcttcgctagttgaagctaagattgaaacttggtaagtttattttatctggcaaaacttgtcagaacagtttgatctcattacttatctgtatattcttgtctatttggaacagctctagagcaaactatcatatttctttgattctaagacctatgtattccctctcacattttaacatttctgaaattgtcatctgtacattgtgtcatatacattaaatgtatacagatgctcctcaagacggggctgcatctggaaaaccccatcataagttgaaaataccgtaagttgaaaatgtaagtccttttctttttgtaagtcatttttgtttttttttgaaacggagtctcgctgtgttgcccaagctggagtacagtggtgtgatctcggcttactgcaacctccacctcctggattcaagtgattctcctgcctcagcctcccaagtagctgggactacaggggcgtgcctctatgcccagataatttttgtattttttgtagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctggtaagtcagggaccatctgctttaccaggtttcttttttttctccataaagctaataaaattgctgtgcccttttgcgtctataatatttggtagttacatgttttgttttaaattttgaaatactgatattgaaaaacagaagttttagttattttttaatgatttcaaaccacaagcttctattaaatcaaagtgaaattgccgtttgacatctcatccccctgccccaacccacacagcctttgatggttttggtttttccatcaacagttgttaagagagaaccagaaagaggcagtcagtaccccctgggaaacgtcagagaagtatctgagaaaggggagtttctgccattctcccctcgaacagattccgccaagcagggtctggttacatgagcattgcctctttcttagaatcccctgggcgtttgaggatccaccccgctccatcccttacctttctttaattcttgtaattggaagcaagaggttctttagcattgctgttgtgaatactgagaaacttggctctgaaagttgcttcagtattattgtaagtgctgtctagggatgtcattaggggtgttaatgggaaaccttaaacaaagacactttccaggtgctgaattctgccatgctgtaagtgtgctctctagaggacatagtcatattcatcttggttatggaaggctgtggttggccttgtaacaacctgcaataattgcaccatctagatcaagagggcccagatccgtgtgactcagaggagagagcaacaaccttagtaggttctgcagcttctcactgtatctgtccttaagaacagaattaacaaaagttctgaggtgagtagtgatgttaatgagagaaggaaagaagaaaccagagaaagcaagccagccattgtgattgtttcatttgtgggagagagcctcaggaagcagatgatgtttatatctttccactggcccaggattccttaggaaatttgtttggggactgtaacttttattattacctagatgaattgttctgagtgttgggctgggtgctgattagagtgcttcattcagtaggtggcgtttcacacaactttatgtttgaatcccttcctccctgcccctccttttctggtagatttaaaatggatgggcattatggccctgataggagtttggaggatttatatttagaagagatgaaagttcttgactggatctttagtactgtagattgaacacgtttacttaggattgcatgtgaaataggggagggagcaaaacttaagaacttgactttatggtgttgatatgatctaacctggatatagttcagtttaaaaatgccctttttgacattgggacagttggcaaaaatctgaataaggtctgcagattagaaatagtattgcattagtattaatatcctgattttgatcattgctttcaggatatacacactgaagtgtttaggagcactgtgtctgtatggttagggaaaaaatatttttacatctgtctatatattgctatatagaaagaagatgaagcaaatgtgaaatattagcatttaggaaatctgggtgaaggttgtacaggaattctttgtactgttctaacctttctgtaggaaaggttctgaaactgtcaaaaaaataccccccaaaaaatcctcctttctgcataaattccttttttatggaggtaggaacctctctttttttaaaattgtgagtccttttcagttcagttcttaaatgtgttaggttaagaaaatttgatacgcatatatttaaaatgcaagtcttaatgccagacccagctttatagtttttgtttgttttgttaagactagtcaaagttttgttttttatctttgaggtgctgctagtgagataatttttttttttttttttttttttgagatggactcttgccctgttgcccaggctggagtgcagtggcgtgtcttggctcactgcagcctctgcctcccaggttcaagcaattcttctgtcttaggctcctgagtagctgggattacaggtgtgtgccaacacacccagctaatttttgtatttttagtagagacagggtttcaccatgttggccaggctggtctcgaactcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcgtctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataagctaacaaattaacttggccagaatccagaggacctgatgaaaatgtccaaattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcaacgcagcagcacctgaagaaggtctatgcaagttttgccctttgtatgtttgtggcggctgcaggggcctatgtccatatggtcactcatttcattcaggtaagaacgattttctctcctggttgctgtggtacaaattacattaggaaaaaaccagctcagcaaggtggtccaagggaccctgttcctctctttaatctttatcagtagtttaggatttaaactcagacattaaatcaggacatgtaaagccattttaattttctggcaactgtgccccctctagataccgaaaaacagaatgccttaaccttggcactgaatggtgtgctgctgacgtacaagacccccacccactgagtaggcgcatggcatgcatgctgggattctttggcacagaagcttttttatcttttcctccattcttcctttacaaaactctgattgtgtgattaactatcaggagaggcaggattgagatctttttaaggaattgacctgttttattttccgataactgttgtctgcatggttgggtaaaaaccttcaacaatttgttttcctgtattgagagagaatctgggtttggtcagcaggagtagaaggtacagtttgaggaataaccagaaagtttgaagactccctaacatagtcttgtgcctttgtagagtattccttttagcataaatgtagaggtgggcctctgttggcatttgccactgttgagaactatccttatgttcaggcatctcctggcagggattgtgtgaaaaattactttagacactcaaaggatagggctttgatcgcttgagttttaggcaaggttagcccttaaataatttagtaaaatacagtcaatccttgttattcacagactctatatttgtgaattcacctactcattaaaatttgtaaccccaaaatcaatactcatggcacttttttttttttttttgagacagagtctcgctctgttactcatggcactttttgcagacagtcacagagtggtgaaaaagttgagtcaccctgctgttgcagtgttttcagctgaggttgaacaagacagtgctctgccttcttgtttcagttctcgtattgtaaacaaatgttcttttcatggtcatttagtgccacttcctttgtatttttgtgcttttaattggtgattttgctgggttttttgagtggaggtcttgtggtgtcgtcctgactggtctcaaactcctgggctcaattgatcctcgcacctcagcctcccaagtagctgggaatacaagcacatgccaccatgcttggcttaattttgctgttcagaatgcaaacagcatagtgctgaagtgctgtctagtattcctgagtgcagaaagaccgtaatgtgccttatgaagaaaatgtgtatattagataagcttcattccggcatgagttgtactgctgttgtaactgtgagttcaatgttaaggaatcaaaaataatgtcaaatgaggtgtccttaaacagaaacacatataaaagcaaggtatctattgatcatttgatgaaaatgttgtgaccttaggcttgcaggaacctacctaccttttatttccctcaggaacaagggtttactaattcattgtccactgtgattttataacataaacactgaataatgagaatcaacttcttcctttaaaggaaggaaggaacttcagtgtctacgtccatccttaatgatttctcttttttctaatgcctatagtttttcccacttggcgtttttaaaaaaagaaacacttttttcttactacaaagctaatatgtgttcattttagaaaattcagaaaacagactagcaatgagaaggaagtattttagaaacttccataatcccatcatccagaaataactactgttaacattttagtactttgcagtcttctgtatatgtatgtgtcttggtgttttggtgtttgggggttttgtttgttggtttttgtttttttgagacggagtttcactcttgttgcccaggctgaagtgcaatggcgtgatcttggcttactgcaacctctgcctccctgggttcaagcaattctcttgcctcagcctcctgagtagctgggattacaggcgtgtgccaccatgcctggctaattttgtatttttagtagagacggggtttctccatgttggtcaggctggtctcgaactcctgatctcaggtgatttgcccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatccgcccgtctcggcctcctaaaatgctaggattacaggcatgagccaccgtgcctggccctttttttcctttttttttgagacagtgtctccgtctgtcacccaggctagagagtgcagtggcgtgatcttggctcactgcaaactctgccttccgggttcaagcgattctcctgcctcagcctcccaaatagctgggattacaggcatgtgccaccatgcccggctaatttttgtatttttagtagagatggggttttaccatgttggccaggatggtgttgatctcttgacctagtgatccacccaccttagcctcccaaagtgttaggatgacaggcgtgagccatagtaccctgcctcctggcttttttttttttttttttttttaagatggagtctcaccctgtggccaggctggagtgcagtggcgagatctcagctcattgcaatctctgcctcccaggttcaagcgattccccttcctcagcctcccaagtagctgggactacagcggctaattttttgtattttagtagagacggggtttcaccatgttggccaggatggtcttgatctcctgacctcgtgatctgctcgcctcagcctcccaaaatgctgggattacaggcatgagccaccacacccagcgcttttttttgtttttttgtttttttttttgagactgagtttcactcttgttgcccaggctggagtgcagtggcacgatcttggctcactgcagcctccacctcccaggttcaagcgattctcctgcctcagcctcccgaatagctgggattataggcatcaaccaccacgccagctaatcttttgtatttttagtagagatgggccactatgttggccaggctggtctcgaactcctgacctcgtgatccgcccacctcggcctcccaaagtgctgggattacaggcatgagccactgcccctggccctaattttgtattttagtagagacggggtttcaccatgttggtcagactggtctcgaactcctgacctcaggtaatctacctgcctcagcctcccaaagtgctgggattacagacgtgagccactgtgcctggccttcctggcctgctttctaatctcatataggttcattttgtttccccatccattaggggaaactctgtgagtagccactgtgactctacttttgtgtccaaaaatagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttgaattagaacagcttgttctgagtgacagtctaatatacgtaggagaaattttagaaaggaagagatttagggattaaaatttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttgtaatctctgtaccctccctgaggtcatccatgattttcagctaagaggacaattttgcagctatttctataaaaaaaaaaaaaacaacgcagtcaggtatacattttattgaaaacaattacagcggaggggagagagatttaattctttagtccacgtttgttaagagcatgagtatgcctatatttcgggatcagcttttggatgaggatcctattcaagaattgatcgtaatactgtgttctgggttttctgttttctaggagttggcctgggccctgccctggagttttgtattgctgtcaaccccaggtaactcttttggtagtgtcttatgtgcttttatctttatgaatataccttctaaatgtagaccgtatacctgtagcccttaatctaatggtctttttttctaacagcatccttcccactgctttcatgggcacggcaatgatctttacctgcttcaccctcagtgcactctatgccaggcgccgtagctacctctttctgggaggtaagtgtgaactgggaaacagggaatgggggctcctttttagccagaattctcactagtactccttccttacccctaactcctttgcgactattgagttgagattaaccttcattctgggggaagttaaggaatggctttaatgggattgctttactttgccttggcttctctcaagacagctttttgctgtgtcttataggtatcttgatgtcagccctgagcttgttgcttttgtcttccctggggaatgttttctttggatccatttggcttttccaggtaagacttagcctggaactttccagcagccatttgcctcacacttctttctttccttttttttttttttttgcacttctttctgtactactttgggcagtgctctctaagccttcccattatccttcataggatggagccttctgccacaagtgaaaacaggctgcacaaggttgggcattgctaagagaaaatggtttgctcagacaccatttgtgtaaggccagtctggcagtggctgattgttaaaatgattgaaactcttccagtgaccagtgcagtattgtgcctagggaagtaaagtggtcttcaccctaggctgcagttctcgtgaatggtaatgttcatagggttcacatttgatgtactttcaagtgactatgagccagaaagtatggctggtttttttttctctgcaacttctgctgtatagtaacttcatctcttacatttgttaggcaaacctgtatgtgggactggtggtcatgtgtggcttcgtcctttttgatactcaactcattattgaaaaggccgaacatggagatcaagattatatctggtgagtgtgggaactagtctttaacaagcatgaaggttgaggcataccgttcagcagctgaacttaggttggcattggctgaacataggtggccaagctttgggagtgtatgtggtaggaaacccacggttttggaactgtgtaccataatcttcctcaattcctgaaagatttcagattttttaaaaatctgggctaataggccaggtgtggtggctcacacctataatcctagcactttgggaggctgaggccactggatcgcttgagctcagaagtttgagaccagcctgggcaacatggcgaaatcccatctctactaaaaatataaaaaaattagctgggcatggtggcacatgtatataatcccagctactcaggaggctaaggtataagaatcatttgaacctaggaggtggaggttgaagtgagccaagattgcaccactgcactccagcctggcaacagagcgagaccctgtctcaaaaaaaaaaaaaaaaaagtgtgggggccgggcacggtggctcacgcctgtaatcccagcactttgggaggtcggggcaggcggatcacgaggtcaggagatcgaaaccatcctggctaacacggtgaaaccctgtctctactaaaaatacaaaaaattagtcgggcgtggtggcgggcacctgtagtcccagctactcaggaggcggaggcaggagaatggtgtgaaccggggaggcggagcttgcagtgagcggagattgcaccactgcactccagcctggacgacagagcgagactccttctcaaaaaaaaaaaaaaaaaaagtgttggggggtggctatatatttacatatccatagtggctacctccaagcagaagtgagggaaagagatctttctccttttcctatttatacttctgtattttttaaacaatgagtagaagatacactctttttttagagacagggtctcgctctgttgcctaggcagtagtgtggtgccatgaacacagctcgctgcagcctgaatttactgtgctcaagcagtactcctgcctcagcctcttgagtagctgggacaacaggcacgtgcgaccatgccaggctaatttattttttgtagagatggggtcttaccatatgcccagattggtctcaagcagtcctcttgccttggtttcccaaagtgttgggattacaggcttaagccaccatgcccagccactttttttttttttttttttttttgagacagttttgctttgtcacccaggctggagtgcggtggcaacatctcagctcactgcaacctccgcctcctgggttcaagcgattcttgtgcctcagcctccctagtagctgggattacaggcactctccaccacgtccagctaatttctgtaattttagtagaacgaggttttgccacgttgccccgtgaggacatggtgtcgaactcttggcctcaagcaatctgccttcctcagcctcccaaagtggtgggattacagacatgggccaccatgcccagctcacttttttttttttgagacggagtttcgctcttgttgcccaggctggagtgcaacggtgtgatcttggctcaccgcagcctccgtctcccggcttcaggtgtttctcctgccttaacatcctgagtagctgggattacaggcatgcaccaccatgcccggctaattttgtatttttagtagagatggggtttctccatgttggtcaggctggtctcaaactcctgactcaggtgatgcccgcctcagccttccaaagtgctgggattacaggtgtgagccactgtgctcggcactttttttttaatgtagtgattctctcagtctcatgactaattagtggtagttaagggttcagacttggacctctgcagagttcagagcgcttgagacagggcttgctctgtcacccaagctgcagtaggagagtggcactgtcatggcttactgtagactcaagctccctgggctcaggtgttcctcccatctcagcctcctcagtagctgggattacaggcacatgccacaatgccctgctaatttttgtagagacgggattttgctatgttacccaggttggtctcgaactcctgggctcaagcagtccacctgcctcagcctcccaaaatgttgggattacaggcatgagccactgtgcctggcccagtctcttttctctatgctgcatgacttcgatgagtctaaaggatctcagacaccagagttttacttccttagttgggggtaaagtgtgggagaagctggctcgtgggggtaggggtggggtttatattctgcatctttgtgggcttgtggataaaaaagtctgaagtacagatcctaatctggttcttgcctttcaggcactgcattgatctcttcttagatttcattactgtcttcagaaaactcatgatgatcctggccatgaatgaaaaggttagttagcctacaacccaaagatgagacaataatggctcctgagcttggcatgtgtgtatacttcagatttgaaaacttgctcacacactgtgttaggtccagggtaactgtaaggcaggccactgagtaagaggtaagccagaagtcttcagttgttagaaaaaaagcagcaagtgaaaaaaaaatttttttaactaattcctgcgtttagtatgaaagggaaaaaagcttcagtggcagtaaacacaacctgctacatgaataatttaaaggctatatagttgtgactcagagaaaggtattgtggaggacgttgtaaatttcagaagtagactaattttatccatttgttaatttttttttccaaggaagcattctatatagggctaatgagtatctaacgtagttgagtcaagcagtgggggaaacaaatgaaatgagcttttctttatagaccttatggagcttagagatagcatagtggtagcgggagtagttgaccagataggattgctggctctgtctgggctatgccatggttggactgagcactaggcagatgtacaagtttcagaacaagcaactgaattttcattccttaatacattgggcttccatccaagattgaatgaagaattctgctggaccaaattatttctgaatgtcagtttatgccagagtcatgctcactttgcagggtggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 35673 - DNA, 19898 bp, Homo sapiens
atggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggtgaagcccttggggcgggaatgagtgaagagtgagggcgaggctgaacagggctaggggaaggcgtgccctttctcctgagcagagcatctctgtgggtttcctgcctctggtgaggccagtcctggcgtggcctcttagcacctgtctcttcccacaggggtcggttccagctctatgcccctctgggacttccagggcagcactatgctcacgagccagtacgtacgtctgacccctgacgagcgcagcaaagagggctctatctggaaccaccaggtgagtggttctcaagaggataggcgtactgtgcggttggctgctagtccctgcctcccgagcagctgagaccccagcttcgtttataggtttgcacctccgtccctggccttttcctcatctcggtcacacccaccaataataagaggcgatgggtattgggtacttactatgtgtcaggagctgcgcttgacactttacatcctcctcactttaaaagccatgcgagatgagtaatgttatctccattttacccactgagaagctaagactcaggtttgaaagggccttacccaaagttacatagccagaaagtagtggaactgtcaggctgtctgccttgaaccccctcagtaatgggaagaaccgagcgaactggatctttattgggtgttttgctgtgtattaggcactgaccttgccatgccttattgcatttaattttcaaacaagctgtttgaaatagatggctttcatgactatacaaagataacccagctagcaaatgtcataaacagtatttaaactctgatttgtctgatctctaagcccagcagttcactcgatgtacttgactcttttcacctggacagtggaggaaccccttagaaccctttttgcaatgcttggttgagggtcttgtcatcagtagtgtggagggactggacctgtgggcagttctagtgtctgtgacctttgcctcagagtatgtagtatgtagtatgtgagcagtggccaatgacagctgctacacagaatccacactgaggcagtcaaggtgaggaaaaaggggaaagaagaataatttggggctgggttacagcttggagcgggacctgctcctgccccagcttgcctaatctcagcccttcccatggcttaagctgttggccagtgttctagttttctccatcaccctgctctctgatccctgctggttgactttcttgtttagttctgggaacccacactgtccttgtgttgcctggtctgcccgtcccctctgctcctcctctccttcctgccccgagcctccacactgctgttagtggcatctgcggatactttcttcagctttcagtctgatcctcagagcgtggagtcccctgtgaaggggtaagcatgcattatgtctgcacaatctggccccttgtgcatctccagtcattctctgtgttaattttgttccagccccccctggctgccttcttgcctcaggacctttgcacctgttgttccctctgtctgggacactgcctcctggctcctcatgcctgcttggttccttctcatctgttaagtctcaattcaagtgccacccacgcagacatttcttcattaaccaccctatctcccccgagtcacattctgtcacattctgtcttagggctttcagatattttaaagaaatgataattcagccttatatttttcatggaaatgagttcagtatagcattattattattttttgaaagcaaggtgcaaacagtgctggaactgtagaaatcaggagtagccacaagtaatagacgcatctaagacagtggcttacattttggttgtagatagctgatggttggcatcatcagtggctcgaggatgtcacaggactgagaggcttctgcacttgccttcatcgaattttcagtctggagtacaattgttttgccttccttcctccacctttctatttggctctgctgatattcctgaaacatttggagtgcttcctgtaaactctggaaagaaatggcttggaaatcagaattttctgttcagtgtttcccaagaactgcctcttcctttaatgagctggagagatgcttcctaaacttttcccttttttatctccttcattcactccatccgggagaggcatgcactcaggcgaacattccctgaacacctgctgtcttctgagcagccataaaatagctcctgctgtggtgcagggggggtggtctagatgaaggagtggctcagagttgactagaactcttaagtgcctggtggctgcagcataggacctggggaggctgctcaggccctgtccttttgggggtcttgtgcggaggctgcggcagtggtctttaagctttctttgctgttgtagcaaccttttgaaaagttggcatcaaaaattgtttgtcattaggtttaagtatttgcaaaggatgacagcatattttaaatattgacattttaaactaaaactgttcagtattttaaacattcagtggaatctaaatattgcaatttgatatccactttttttttttttttttttgagacggagtcttgttctgtcacccaggctggagggcagtggcgcagtctcggctcactgcaacttccgccttcctggttcaagtgattctcctgcctcagccccctgagtagctggaattacaggtgtgcaccaccacgcccagctagtttttgtgtttttagtagaggttttttttttttttttttttttttttgagacagagtcatgctctatcacccaggctggaatgcagtggtgcgatctcagctcactgcaacctccacctcacgagttcaagcgattcttctgcctcagcctccccagtagctgggattacaggcgcgcactgccatgtccagctaattttttgtatttttagtagagatgaggttttgccatgtttgcgaggctggtctccgactcctggcctcaagtgatctgcccacctcggcctcccaaagtgctaggattacaggtgtgagccactgtgcctggccagtatgtcagttttttaattgaacttgtactttcatttccacacagaatattatcctaatgcaatatatttaatgcttgaaaatgttattcattagcctaccatattcttctgcaagtaaaattaatataataatttaaacttttcaattttgttgagactgaaacttttaatattttgtttgagattattataattatctgtacacacttgataaaagtaaatgcattacacagtttttgagtaattatacaaaagtaaacattttttgaaacatgagatctcagtaggatgtcaccccccacccccatctggatggataatactgtcagaataagacaagttcagtaccacttctactttttgtttttatgtacatgaattctgagaaactgtgttctcttaaatagtagttggagatggggttatttttaaaattttaaatttctattatagatgggatcttactatgttgcccagtcttatcttgaactcttggactcaagcaatcttcccacctcagcctctgagtatctgggacacaggtgctcaccaccactgtgcctggcacagcgggagttttggtagagcagcatcactgaatattttgatcttcttttggtttataaacccaacgtcatgcagtgatcttttatcaaaatttttgatgatgtttcggctgactgttgattacatctgcattccgtttcgttgcaagcagagatgtggaaactgctgaactgtaaaatagcctcttattgccaggtgattctgatgtagttggcctggtgtaggaccaaggcattaagctttctgagctccccaggtgggtttgctgtgggttaagaactgtggtcatatcgtgtttgtccccaaaagcagcttctgaatcatttccagcctgtgccttgcctgcttaagatcctccagaggccttctattgtctgtatcatagtatgtctctactaatctgcagttttaatctggggtcatgaagactttccaaggcctgcgtagtcctggaggagtctgtttccaggtcctccactgtctcatgtgctcattcctgaaaccagcctccccgtgaacatgctgggaatgggtgtgtgggttttcctttcccacctccctcactcagttgcccttctgctctgaggtcagcctcccaacagcctggtctttcttcagggtgttgtccccaggtgcagaaaactcctgggcaccaaagagaccatttgaaatctggtttctgggctgacttttgtacatgtgagatatttttttttaaagttttcaaatatatgagggctattttagttatcttttaaaattgtttattattgttagatagctgatggaattgcatcatggtcagattttttggacgcgttctgtttgtgcttatgaatgtggattctctacttgttgactacagtgtgccacgtaggttctttaggtcaaacttgctttctgagcttcccaggtgggtctgctgtgcagccagggttaagattgagttcggatcttctctagctttcctcatgtttttgtctgcttgcttttataagttactaagagagctttgttaaaaatttctgtgtatggctgggcaaggtgacacgtgcctgtaagtgtcagctactggggaggctgaggcaggaggattgcttgagtcaaggagttcaaaaccagcccaggcagcatagtaagaccccatctcaaaaaaaaaaaaagtgttaaaaaaatttctgtatatggatttgtctgcatctttgtagttctgtcagtttctgttttatatgttttgaggccaaattaggtacatacaaaaacttagatttattatatctgtaggtaaatggaatcttttatcattaagaagaacccctttttacattttgttatgggtatagctatagaagcttgctttttttaaaaaaaaaacaacaaccggtaatcaatttattaaaatagtcaactttaaatatctgcaatggtgacttccacctcaactcctggctcaatactgatggaagtaatctgcttaatctcagaaggactgtggaggtcagtgagccacttgtggattctcatctggaaacgatcccgtgtgttagaaccttcacaaggagtttttcttgtggtgattctcgaagccttgataggcgttccagctggtcttttcactttgagattcttttcctttgctcctctgatcaagtcagcacacaccttttctggggattctatgttgcagctcattaaagtgattcagattcagtgaattgtcacctctggctccgcaggttttcttcaggtatctttaaagccgtgggtgggccgggtgcggtggctcacgcctgtaatcccagcactttgggaggccgaggcaggcagatcacctgaggtcgggagttcgagaccatcctggccaacacggtgaaaccccgtctctattaaaaatacaaaaattagctgggtgtggtggcgggcgcttgtagtcccagttactctggaggctgaggcaggagaattgcttgaacctgggaggcagaagtagcagagagctgagattatgccactgcactccagcctgggcgacagagcgagactgtctcaaaaaataaataaataaataaataaataaataaataaataaataaataaatgcatgccatggctgctgcgagccttcctgaccaacttgttcctcagccagagcaaacagtggtgaggcaggagcaggagcgggcagaccacagctctgcagcgcctgtggccctgtcttcctgaaggagcagaagcttgcttttggttagtgtttgcatgatacatttttcctgtccttttactttttcccatttctttatgttttagcgttttctcttataaatggtatattactaggcttcaggggtgttgtttttatgttgtaaatgcatataacataaaatttaccactttaaccctttttacctttaaatccattaatttatgaaactattttcttcagtaggctacacattgacattgaaagagtggctttttttttttttttttttttttagacagggtcttaatctgtcacctaggctggaatgcaatggtgtaatcacggctcactgcagcctcggtctcctgggtgtgatcctcccacctcagcctcctgagtagctgggactacaggcgcacaccaccatgcctggctaattttttttttttttttttggtagaagtagggtttcaccatgttgactaggctggtcgtgaactctgggctcaagcagtccacccaccttgccctcccagagtgctgggattacaggcatgagccactgcgcccagcctgacaatggcatttaaaagatgtcatggctatgtaaaaaaatgtttccactgttgtacgtacacatctgcacatgcaagaaaatttctcaaatctttcttccttttcttttctcttctcttctttctcttcttttcttttcttttctttttttgagacagggtctcactctgttgcccaggctggagtgcagtggcgcgatctcggctcaccacaacctctgcctcccgggttcaagtgattttcctgcctcagcctccctagtagctgggactacaggcgcccgccaccgcacccggctaatttttgtatttttagtaggacgaggtttcaccatgttggccaggcttggtcttgagctcctgacctcaggtgatctgcctgcctcggcctcccaaagtgctgggattacaggtgtgagccactgcatctggtcaaatttctcaaatatttctattgtgataaaatgtatgtaacacaggctgggcgcggtggctcacgcctataatcccagcactttgggagaccgaggtaggtggatcacgaggtcaggagatcaagaccatcctggccaacatggtgaaaccccgtctctactaaaaatacaactaattagctggtcatggtggcgtgttcctgtaatcccagctactcaggaggctgaggcaggagaattgaaccagggaggcagaggttgcagtgagctgagatcacgccactgcactccaccctggcgacagagcaagactctgtctcaaaaaaaaaaaaaaaaaaaaaagtaacaaagcgtaccattttaaccagtttttaaaattaaaaaaaaatttttttttttttagagatggggggggtctcactttgtcacggaggctggagtgcagtggtgcaatcctagctcattgcagcctcgaactcctggagtccagtgatcctcctgcttagtgtcctgagtagctgggattacaaggcatgtgctattgtgcctggctaatttttttttttttaattttttgtagagctggggtctcactatgctgccccgggctggtctcgaactcctggcctcaagcaatcctcctgccttggcctcccaaagtgctgggattacaggcgtgagctactgcgcctggcccattttaaccatttttaagtgtacaggtcagtggcattaagtgcattcacattgctgtgtagccatcaccaccgtctgtctccagaactctttgctcatcccaactgaaactctctacccatttaacaatcactcccatccccacagtccctggtaaccaccattctacctcatctctgtaaatttgactattctaggcatctcacataaatgataaatggaggcatacaatatttgtcttctttgacttattttactgagcatatgttgaacgttcctccatactgtagtatatgtcagtactgcattcctttttgttgctgagtaatattcgtgtgtgtgtgtgtgtgtgtgtgtgtgtgtctagaccacattccgtgtattcatctattcgtaatggacacttgggttgtttccatctgttgccattgtgaatagtgctgcagtgaacattggtatacaagtatctgtttgaatcctactttcagttcttttgggtatatacccaggaagtagaatctctggatcatacggtcattctatttttacttttttgaggactaccaaacggttttctgtagcaactgcaccattttatattcccaccagcaatgcacaaggattccaatttctccacatccttgccaacatttgttattatttatttatttattgagatgaagtctcgccctgtcgccaggctggagtgcagtggcgcgatctcggctcgctggaacctctgcctcccgggttcaagtgattttcctgcctcagcctcccgaatagctgggactacaggtgcctgccaccatgcccagttaatttttttaatatttttagtagagacagggtttcaccgtgttagccaggacggtctccatctcttgacctcgtgatctgcccgccttggcctcccaaagtgctgggactacaggcatgagccaccgcgcccggcctagggttttttaatatattctagatattaatcccttatcagatatgtgatttgcaaatattttctcctattctgtgggttgtcttttcaccctcttgatcatgctctttgatgtacaaaaattttagttttagtgaagtacaatttatcttttttttttttttgtctgtgcttttggtgctatatccaagaaatctttactaaatccagtgtcatgaacattttttccctagattttcttctaagagttttaaagggtttttttgttggtttgtttattgttttttgaggcagggtctcattttattgcctaggccggagtgcagtggcgtgaacacggctcactgcagccttgacctctccagctcaagtgatcctcctgcctcagccccacaagtagctgggactacaggcatgcgcagtcaggcccagctaatttttgtatttttttgtagagacaggttttcaccgtgttgcctgggctagtcttgaacttctgcgctctggtgatccacctgcctcagcctcccaaagtgtttcagattacaggtgtgagccactgcaaccggccaggtttgagctcttaagtttagatctctgatctttatatacttattattatttttttttatagagatggagtcttgctgtgttgcccaggctggtcttgaactccttggctcaagcaaacctcccatgatggcctcccaaggtgctgggactacaggtatgagctactgcacctggcctctttacttttcaaattaaactttttattttgacataattataaattcacatgccgttgcaggaaataatacagagatcctaggtgcccttgggttttgtttttttatttagcatttagtccatttacatttaatgaaatatgatacatttgggtttaatctgctatcttactctatatattcaaattgcctattctctgttcatttttctctctagtcttcttttaggttaatttttattatcctatttttcctcttctattagcttgaaagttatatgctcttttctcagttttaagtggtcaccctagaatttaaagcaggcattcatgttgtaccaaagactaatgataatgtgtactttaccttcttcctggacagtgcaaggatcctaacacactttaactccatttattgttgtcatttgttttaattatttctgttttaaatcacacaacccattgttttgtgcagtcagatatttagattttcacccttatagtcactgtatttgttgttcttcgttccttctggaatctgactttacatctggatggggatcattttctttctccctgaagaatgaaagtgtgagtctgctaatgaattcttttggtttttgtttgtttgtctcaaaatatctttattttaccttcattcttgaaggatacatttgctgagtatagaatcccatgctggctgttaccttcctgtatctccaaacatatcagtcatctgccttcttgctcccgctgttcccgccgtgaagccgggtgtcaggctgattattgctcctgtgagagtcattgccttttttccctctggttcctttttctttaagattattattttttttatggccgggcgcggtggctcacgcctgtaatcccagcactttgggaggccgagacgggcggatcaccttaggtcgggagttcaagaccagcctgaccaacatggagaaaccccgtctctactaaaaatacaaaattagccaggcgtagtggcgcatgcctgtaatcccagctcctcaggaggctgaggcaggagaatcgcttgaacccaggaggcagaggttgcagtgagccaagatcacgccattgcactccagcctgggcaacaagagcgaaactctgtctcacaaaaaaaaaaaaaaaaagaaaaaaaaaggctgggcgtggtggctcacatctgtaatctcagcactttgggaggctgaggtgggcggatcacaaggtcaggagatcgtgaccatcctggctaacacggtgaaaccctgtctctactaaaaatacaaaaaaattagccgggtgtggtggcgggcgcctgtagtcccaactactggggaggctgaggcaggagaatggcgtgaacccgggaggcagagctcgcagtgagcagagattgtgccactgcactccagcctgggcgacagagtgagtctgattttttttgagaaagagtctcactctgttgcccaggctggaatgcagtggcacaatctcggctcactgcaacctccacctcccagattcaagcagttctcccgcctcagcctcccaagtagctggaattacaggcatgtaccaccacgcctggctaatttttgtatttttagtagagacggggtttcaccatgttggccaggctggcctcaacctcaagtgatccacctgcctcagcctcccaaagtgctgagattacaggcgtgagccactgcacccggccaagattctctgtttttaaggagaacaatagacactccagactagatgggggaggacgtgggttgaaaaactacctattgggtactgttctccctgcctgggtgcagtatacccatgtaacctgcacatgtagcccctgtatctaaaataaaagttgaaattgaaaagaaagaaaaaatgcttttgtggcacacgttctcaggattgcctggggctgtaccacggggaaaaaaattagaaaaaaatagtttcatgttaaaaaaaacttttttgttgttgttgctgtttcctctatccctcccttctttttttgtgcctaaatatggttttctttttagtcatctcctttggtttgtaggacttttcaagtttgtggcgtgtctttgaatcagttttagtaagtgcttagacgtctttaaatattcctttgccttcatttctcacatcttactcgggaatcccaattatatgagtcttagcctctctcactgtttcctctgtctcttacccacaattctatatcttccattcttttgtgctctcggggactcggcctaggttttgttatctgggttcctggtgcccagagtgggagcagtgagtctgtggcatcaatgaatgcatgaagcatattgctcaaattggggtacagtgttttttatttttctgtgatcacagaagtaatatgtttattatacattattcaaacatggtaaacagtcgccataatccccctcccagaattacccatcattaatactggttcatgttcctttactcctgtattcatttctcttcatgctcatctgcattggacgttaatggtctttttcacagttgccagtctgacaggtcaacatcctgtttgggtttgcctttgtgatgggtctttgtttaatcacttgcttacatacccatctgcagacttcctgaaagtggattcttgtcaccgtgtgtgttgacaccttagttttcacaagcgacttcctgatgcctaaggcaaggctttctcccttggcgtaggcggtgcccatccctgccccagctcacatggtggtgcccttgagtcccagagcacgaccctgaccagctctcatccccagcgctggtaccacacttaggctgggctggggaggtgaactggtgaagggctgggttttggagtcagccagacctgggcttgaggccagcagcactgacccggcctgattttcctcacttgggaaggttggttagcagggtggatgtggcagtggatgtgggtgaccagaaaggggctggtgcaatttatgtgaaaggcctgcaggccgcgggaagtactgaaggcagagcagagctctcggagtcagaaaaccctgcatgtgaatccagacagtccgctgagcagagctctcggagtcagaaagccctgcgcgtgagtccagacagtccactgagctgctctggacaagttgttacacctctgaatttgttttcctgtaaaatactttgctcaaataggagttgtaacgtctgcagaaggttccagggcaagagcagtggatggagaggaaatggctggtgggtttggctggtaatgagggtgaacagtgtggcagccacctaaacctactcaggagcagcctgaggtctgctggcggggtctgggcctcaggcagccttggaacactggcctcccccacctcacctggtgcccaacagtctcttcccttcacggccagaacatttaggggtctgtggtcagtggcacttgtggccctgtgccaaggagtgcccagtcttagctggggagagaagagaggtctgtggggcaggggccgtgctggggttgcctccagcttgctggaaggccctggggagctctgagcagcccattctgctctccctccagccgtgcttcctcaaagactgggaaatgcacgtccacttcaaagtccacggcacagggaagaagaacctccatggagacggcatcgccttgtggtacacccgggaccgcctcgtgccaggtgggctggtgttcgctcagctgggccctgtgggggtgggcacgggcatggctgctggccccctagggaggtggggtggggctgcctgtggctcgtggggaccagcgtctcctctcctgttaggaaagtgctgcctcccgtggataaagtcctgcgcctccggaaggagcctggctctggaaggaaggtcactgaggggagaggagcagctgggtcctgcagctcaaccctacaccctcattggcctggttttaccattttaaacagttattgttgtaaaaaagccaaaacatgaagactgtgtggctgtgactgcatgtggcccacagaccctgaggtgtttccttggtggctcttcacagaatgtttgctgcccctagtatagagggtagagcctcctgggtagggctgtcctgtggctcactgttttttgtaggccaggtacccccttgacacctgacatctgcctcagtcccctcacagttcagccttcaaacttgagtcctctgtgtcatatgcctagaccccccacttctgaggagaaagcctcagctttctcctttcacgatcccttctctctcggtgaatggccagtgggttgggctctcttgcccccacccatgttggcattgcttgccttttaggtacccatgggacggctcctgtttctcccattctgagagcatctgcttataattctagggcctgtgtttggaagcaaagataacttccacggcttagccatcttcctggacacctaccccaatgatgagaccactgaggtaggcccctgctctatcctgctgagcaggaaaggaaggactgggcagtcggctagaggagggggccctgggacttccatggtcccagcacaagaggagcctccagggattggggtggtgggtgcccctgctcgccccacaggctgggctgcttgtggagtaaccgatgtcttggtcccagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgagcaggctaggcggtgggggtggcagctggtggccctgtgctggtcccacagaggctcaggagggcaggctgctgtcctgcgaggtgcttagcgtgctgggccctgcaggtgatgaccgacctggaggacaagaacgagtggaagaactgcattgacatcacgggagtgcgcctgcccaccggctactacttcggggcctccgccggcaccggcgacctgtctggtgagtgggccgggccaggcgttggttcccagcccagctcaccctgagggactgggagctttccatgcagttgattgcctgccttcatgtggtttctgagctcacctggctgtgttcctcctcctcctttcttctgtaaatggcctgtccgggcctcagttcctgtggtttctgggctcacctggctgtgttcctcctcctcctttcttctgtaaatggcctgtccgggcctcagttcctgtggtttctgagctcacctggctgtgttcctcctcctcctttcttctgtaaatggcctgtccgggcctcaggccttgaacggtcccttggcaaccttccccatcaacaggaggcagcgggtcagttagatttgggcaatgtagattcccagatttatctccagcccagaccgctctggacctgctcagcccttgtgcccacagctgaggccacatcttgcccatcgggatgtcagtggcacctgtgcccctctatttgcttgctgtctttccggacccttctttctctcacatggcacctctggtccatcaacagtccctgtggctttattttcacagcacgtctcaccacttccctcccctccctgactacctggcggcttcaggccaccagtgtctctcacaggagtctcccaagtggtcccctccttcaccagcccccaacagtctctcgtgagcacagcagccgtgtaatcgccttcagtaatcgccttcagcccgtgtgaggcctcctgctgctctgcgcagagctctgcagggggcgccagggcctctgtgccagccctgccacctctggctccctgctcactgctccccctgcctactgtggcttccagctgctgcctggatgcgcctgtgccctcctgccccggctgtttcacccttgtctcctagggccttgctcagatgttacctcctcagtgcggccttccctgatgccctcgtggaatgtcgtgccccctcctgtgtccccagcccactccccagcatctttgctggctttatttttcttcataatatttaccatctttgagtctaccgagtaattaattttattgtctctggccctcctgctcaattgtaagctctataaatggctgtttggcccagggcaggtgctcagcgagcactggggtgcctctaacctgctcaggcctcactggtcaccaggccgtggtggcccttggctgtggttctcggtttctctttggggccctgagcaggtgccaggcccagggccagctcctgaccagaactggcacgtgacacgggggacctgacatgggcggtttatcctcaggatgacccattccagggcctgtagtctgcccactgcccaggagcctcctctctcagcatggaagtgcttgggtccgctcagaccccagaacatccattgtttgggggtttttcagtcacatacccagcagaggagagaggtctggtaagcacccttcctgccaaccagctttcatcatttccagctcgcgcctggctggtttccctcctgccccgggttgcctggaacttcatcacactgtttcagcccttgtctttggagggttcttgataggagcagagcagcaccagtgctgtggccggtggcagctctcacagctgttgggagagcccagcacagagtggaggaggcaccatgaggggagccgtgtctgaccactggtcaggggtcatcagtgccaggcaccttacgggtgatgtcacctgatgtatttttaggcagatggccatctcgttccctttttactcaaccattgggagtttgaaaactgaaaggatttttcctaagatacgagcaggaagcagcagagcccagatgggaactggggcctgactccagggccggtccttgtcctgcagggccgctcgccgtctccaagggctgtgcatgctcggctctcacactgtgtgcctggccgagctcttgctcattaggtccccccttggctccagagattcctgctcccttcaacaaggcctttcctcagattccagtcccaggctgaccaggacccacgtgtcggctttgagcctcagcctcctcatctctacaattgggtgatccatcagcgtcaagccagggctcttccctgtgcatgccattggacagagcctttccccagtctcctcaggcacagctgctgacctgcgttaggctcaggcccttagctggttgccgagttgttcccctgcagcctgtatgtgggtctctgtggcaagaatgtctggtggctcctgcccttgggacctcagccttctcagccagtcacacagcgactgttggtctttcccgggtctgtttttgagcacttattctgcaggcaggccatcttctgtgtggtgtagacccttctcatgtacttgccatggcaaccacacagatggagatcatcactcctctacatgtgcggaacatgagcctcaaagagggcggcagaccccaggatttagacccagatgattctgcttgtaaagcccttactgttttctctccactctgcctcctctcttttttattgctggtgactggagggagctgggaagaaaacaggccctagccggctgggcagtgctctccccaggggcctggcaggtttactggctgcagcagcagctttccttgtgggagggtcttgggccacgtgccctgcggctggcctgtaggctgtcacaggtttattcttggtcctgcagacaatcatgacatcatctccatgaagctgttccagctgatggtggagcacacgcccgacgaggagagcatcgactggaccaagatcgagcccagcgtcaacttcctcaagtcgcccaaaggtgcgtgtgcacagccccgccctgcctgggcctgggcggcctgacccagaatggggtgaagccagcctggcgggtcttgtggtccagtcgtggttgtggtggttgtggtctgggctcttggatcagcccggtcctggcaagcggcactggctggccctgtccgagctcctagagtattgggcttggatcgtgtcagctctggcaagtttttgagtaaatgaatgaggcggaagagaagtctgcagagagtcagtccctgaggacatcctagtcacgtgagtgctgtggcagcaagcagtggctgatcaacaaacgtgtgagtggtgggccagcatcctccctcactaggtgctggggcagtggccagcagagccagggggctgggtatgttggcccacctgtcccttctgtgagccacctggaagaagtcgtgctgctggtcaagggggtggattccttagctagaaggagagagagagcaagattggaaattgggtttctacaaaacccgaagcctgggttcttcccatggcactaattagctacccctttcctcacagagtgaacgttgtggttggaggaatgaggcatctgtgtgtggagaagtccaccctaagagccacagatgtgtgcctgggggtccagccagtgacagaagtgcacggcgcgggctctgtcgtagcccagccctgggtccccatgccgtgtgggccagtttggccgcgtgtttctgcttttcaggagaagccaagatccagtgttttatgtgacagttcactttttaaagattcagattattttgaaatgttttggggaccacacaaaccttgctgcaacctttggtcagaaggctgccagctgctgggtgtttgcagaggtggcacctgccttgcccacccagcatcccgtgcagctggcaaggcaggatgaactcgtttttagattcaatccatttgttccttcagatgtgaccaaagctgccctctgtgcctagccatgggctgggtgctggagacacgagatcaggcaggccctgcccctggggctcattctagggtctgcggcagacagggagacagagggagctgtgagagccctgaggctgagtggctttctggggaagcaccatccctagggacctccgcgttcggtcagtggccgctgctgtcggtgtgcagagcagaggctggggcgagagtggtcagcaggcctgctggtggcagcttgtgcaggaagggaggatggaggttggcttgtggctggcaagagggtggcatgcacgtcgctgaaaggcagggcctgggcccgaggcctgggtgtggggacgcctgaggagactgtacagtgtggagtcgggggggccgcagtcagggagggaggcagagtggcagaaacagggcccagccagaccccagctcctccacccacagcctggagagcttgggaaagtcagtgtcttctctccgcctgtacaagggagcgtaccagtgggccccatcccaggatgggcaggacctgtgggaaccttgtgtggaggagagaggctgtgggctggggtggagtgtgggactcaggtcctgggagaccctcctggggggctgccgagagcatccagctgtgggctgggagagcctgtgaccagggccgcgctgctccagaaagggccctcagaccacagcgtgggggtggggcttggatatgtagactcctgggcctccccttatccagagttggactcagaggagcccaggagtctggttttaactggcttcctgcagcagaaggcagcccaggcttgtcgctggggtcccgggtccctgtgggcttggtcctctctctgccccaccctgccctggggactgcagagctggctgggatgggcttcacctgacctctgcccctccccggtgaggggggtgagtacgaccggcctgcccaccgtggccggctgtcctgttccatccccactgccctcctgcagccccctgatccccggcccgtgctgccgtttcagctcccccgtttcttctcccccagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggac

SEQ ID NO: 35674 - DNA, 13689 bp, Homo sapiens
gccccgacgcgcaccgcgattcgccccaagggccctgcgcaggacgctgacgcgaagactcggaggcggaagaaaaaaggagctgtttctaggcttttctaggcgcccagccgaggtgaaagaactaccccttcgtcccctcccggaaatgacgcgatttgacccttgagccgtagggagcgcggcattttctggaaagttctggaaccgagcgaggcccgggaactagactaagccggccggagagggctgagcgcgctagcacaccctgcgcgggtagggaggggcggggctcgcgcgcagggtgtgcagattgcagggcccgggctgacgggaagtgggtgggagctgcctgcacacgcggtgccgcggggcgggagtagaggcggagggaggggacacgggctcattgcggtgtgcgccctgcactctgtccctcactcgccgccgacgacctgtctcgccgagcgcacgccttgccgccgccccgcaggtacgcggccttcccgcaccacctccccccggctcctgcgacccccgagtgggccttcctcctctgcggtccagctggagggtgcgggcggcgacaacctggagttccgcaccgcgccgcaccgcaggcccaggcctgcgggtccaggcctcgcgggtccatgcgggttccatcacgtgcgacgcggatcctggacctcggctgggcgcgggagggacaactcgtggggtttgaatttgggggattgtaaccacttaggcccgctggtgcaacctgcgcctggccgacttcagggaaccggggagggtggtgtacgtgagggaaccgcttttttcccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtgggtctgcccacaaggccgttttcgcggtgaaagattaactcgtttttggcggcagggataggtggccgtggggaaggagccgcatgtgctttgtgctggtgctataggtcaggcgccggccggggcggcctctttagcttgcgctagtggctgatgttccgaagctgcggcgccttccgtcattcaggcgtagtggctggcggaggtcagccaggctcagcatctcacgttgcttgctctgttgcacaggtgggcatgtttgttctgcagcgcaccacgggtggtagttctgatgatctttttgcttccatccccagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaaggtaccagtatttttattttattgtaattacggtattattaatagcattttactcacaaatagtcgcactgaactattcaacagtactttcatctccatttttgagagaactcagtttacatgtaagaattctgaagtattggttagcctttttttcttagacatgatcttaaagcttaaactgcttcagccagattttcgaaactattttgttcaatgtgtgatgtaatcaggtagtaacttacagctcaaggtggattcttaaactcgaggtagaatttcgctggcttaagttaaaatttggatcctttcccagtagttcatgccaagtgtagagagaagagtttaacttatcttccataattccttaggtatgtgcttgtagatgctaaatttttttttggtttattgtagtaaaatgtacacaacataaaattaccattaagtgtgcactttggggacatcaattacatttatgttgtgcagtcatcaccaccatccatctccaaaactttttatatggaaaaattgtaactttgtactcattagacagtagcttcccattctctcctccaccccaagatgctagttttacccatcggttttctgctgttctcttgttccaaagcatatttaaaataagtctcatttaataggggtaatgttttgaggaggcctttgaaggtggtgtgcagtcaagtggtgcttcatttcagtttgaagacagttcagatatcaagtgatccaacaactgcctaaaatacaacatttgcacacctcacaaatagaaagtagcagctttagttcaaatccaaaggatggccaataattgtgccatggttgaagttttatgttgcgtgaacctggaagagcacgctacttgccttgatggttaatattttagttaaacggattttaaaacaagtcacattactttaaaagataacaggcactaactaaagtataagtgataggaagattgttttattctttgtcttgtgttcttgttcattttataagatgacaagttttagtccctaggattttaatctcctaaattacctagttcaaaattatgctcttggcagagaatcaggtcattttgtctgtagacaaagaatgtcgataaacttgcccttgaggttcatgctgcaagactgataaaaatgacacaacttacgttgagactttgaagtagttgctttattatgaagactgctcatttttaaaaatgtaaatcatccttagggtatgtctgatcctgttacatttttttcttctagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtaggaatgtctgttgtcaccacagtgttctaaacttcagtgtgctttaaggcattgattccttggacctaaggaaagtgttaacttgaggaaattaatccttctctcattcctcctcttggcctggagaaatcttaaactgggttttcctttagcaagcttggctgtatggtgggtaggtactgttaggtaattttgatattttacttagttggtttcttttgtttttagagacagggtcttgctctgtagcccaggctggactgcactggaactcctgggctcaagcaatcctcctgcctcagcctccaagtagctgggactactacaggcactcaccaccattcctggctaatttttagtttagttttgtagaaagtaagactaaatacactggatcattcagaatgtcagaaagtaatgttttcctcagtttattttttcttaatagcacacaccatgttattggtttgtgttttgttagtgcttgtaactagagtgcaacttaattaacaatttgctcctcctcatgaggttcatggcagtatagacttaaattctagtcccatgtttgtcatttattagctgtgtgctaagacttggttttcctatcagcagaattgctatgtatatctagggtatgttagggttcaaaccaggaaccctcttgtaagtgaaggtggggggagctattggtaattttttgtcagaattggcatactaatttattactacattactaatgtatcattacctcatctatttcagtgtttatgggccaagtgaatatacttcactaaaagcagttttactgtaaatcactaacaagtattaattaaggttatgaagaggacttaccagcaccttgcattggattttttttgaagtaacagttctcaaacaagagagctagcactattcccaattgagcaaaatgggactattaagactgatgtaaaacaaaaatattttgttagttcataatacgtactaaattgaggggatttcagataattgacacctgcagaggcatagtcacaacagattcctatcatttaagaactgtacttcttgttgaaaataagggagtgttagccattttggtccttttttgcatcatctaatggacatgagaagtgtcgtggaccctattggaaacagcatgattgggttaggaatttgcataggatgagttcagtggtgagacttttgaaactacacacatctaccttgttttagtcctattttcaaaattttggcattgtgagattttatttactgtgtgaacctaaagttactgtttaagtacatgccacgcaactctgtgttattaagaagcactgtctcagaagctgtgtgtaaatttaatattaaggcactaaagaccaagcataggtacatgcctgtagtcccagctacatgggaagctgaggtgggaggattgcttgagcccaggagttcaagaccaccttgggcaacatagtgagaccttgtctacaaaaataaaagaagctgagcatggtggcttgagcctgtggtctcagctactcccttgagcccaggatgtcagggctgcagtgagccatgatctgtgctactgcactctagcctgggcagcagaacaagaccctgtctcaaaaaaaaaaaaaatttttttttttaagttaaggcattaaaatatttgtcacaaatctcaagatttctacttgacatagaagccatgagagaaataaacattgtaatgacatatatcgttgaactaggtgtgatgttagctgttgatgctgtaattgctgaacttaaaaagcagtctaaacctgtgaccacccctgaagaaattgcacaggtaaggacttaacatgttacacgttttttaaaaaaaatttaatggcatgtgtgattttttttttcccttgatcacaccaatgtcagaataacaatactacccaatcatcaatattagaatcattgtttcttactgctaaaacctttgaaaagaattatgaccataatggttgtcatttagttctacatgtggttgtcattttagttctacatggctgtaaaatggattcatatgattgtgaaaatgttcttagccattgtcaaaggtgcataagttttgtcagtttgtaatgaagtcagcatttttaaactttttgttacaagaatagttttatgtatcatattcttcaaaacaatgtagtcaaataatgaatcggaaaagagcaaagaaccagtacttcatgaaaactaccataacgtaaattccccttctctcccctggatggaagtatcaatttggaagttactaggaaaaggtaagggaactgactgaggacactaggcttaccttttaatttcgaagagtaactggattatttcaggttgctacgatttctgcaaacggagacaaagaaattggcaatatcatctctgatgcaatgaaaaaagttggaagaaagggtgtcatcacagtaaaggcaagtgtgtttgtatttttaaagataattttgagttatcttatgatcaaaagtttgagttatctgatgatcaaaactgaatttttcaaacagaaaaattctgttttaaaaactgctttttttattccttcatatgtagtctcagcacatgtatagaataaagtacttactgtgttttatgtgaattagcctttgctgcatgaaatgaatccatcctaacttaaatgattattcaaataagcacttttgggattttttgcagaagtgtaattggatgtcctgggctgtttcatactctaccctgcatctcttatggccagaggggtctgtttttattaatctggcctgtaattccatgttttgtgttcaatgaaatccatatacctaattctttgacttttcataggatggaaaaacactgaatgatgaattagaaattattgaaggcatgaagtttgatcgaggctatatttctccatactttattaatacatcaaaaggtaagaacaaatcaataactgaattattattatttttattattttagacagagtctcattctctgttgccccggctggagtgcagtggcatgatgtggtggcgcgttgctcactgcaacctccgccttccgggttcaagtgattctcttgcctcagtctcccaagtagctgggattacagtcacacgccaccatgccaggctgatttttgtatttttagtagagatggggtttcaccatgttggccaggctggtctcttaactcctgacctcaggtgatccacccaccttggcctcccaaagtgctgggattataggtatgaggctctgtgcctggccaatttttgaattttttaatagagacaaggtttagccatgttggccaggctggttttgaattcctggcctcaagtcatctgcctgctttggcctcctgaagtttttaaaatatactttctaatatgtgtcaaactataggtattagttggtgtcatcctctaaaaaataaatgtatatattccaaaagttaatgcatatgagaaatgaaggaggaaaaccaactcactggtgaattttaaagtgtattggaaccttggtttcgcttttcatttaaatgtattgcagtcattttttgtatatttttgaaatcttcattatttttacaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggtaataagcagtggtatttgttgatttatatttctcggtgaaagacagaattatttgtattgctgtttgcagtttccatcatgtgtacctccacatttgatccagttgggtttgtatctagaattgtaattgtgtaaatcaggtgtgctctaatgtatccttatggttgtgtttttgaaggaaccccaaagtctttactattttgatcagctttctcatagaatagactaatttagcacatgggtacctttctgtattttgcaagtgtttacagttgttttgaaggcacatgactgaatcttgtattttttttttttgagacagagtctcactccctggcccaggctggagtgcagtggcataatcttggctcactgcaatctccatctcctaggttcaaacagttctgcctcagcctcccaagcagctgggactacaggtgcgtgccaccacacctgactaatttttgtatttttagtagagacagggtttcaccatattggccaggctggtctcaaactcctgacctcgtgatccgcccgcctcagcctcccaaagtgctgggattacaggtgtgagccactgcgcccggccttgtaatttttttattttttatttttatttttggagacagagtctctgtcacccaggctggagtgcagtagtgcagtggctcaatctcagctcaagcctccggggttcaagtgtcaatcttgttttttgttttgttttgttttgtttttttaaggtttttctggttaaaaatatgtaaattttcagaatattattttgcatagaacagggaagtaaacaactaacttccaaataactcagagccaggcatggtggctcacagctataatcccagcacttggggaggcacaggcgggtggatcacctgagatcaggagttccagaccagcctggccaacatagtgaaaccccgtctctactaaaaatataaaaattagcagagcatggtggcgtgtgcctgtaatcccagctactcagaggctgaggcaggagaatcacttgaatctgggaggcggaagttgcagtgatccgagattgtgctgctgcaccccagcctgggcaacaaagcgagactctgtctctaaataaataactcagatgtaagtgtatttcaccatcgaatatttttatttattttgagagacagactctgtcacccaggctggcctgcggcggcacgatcatagctcactgcagccttgaactcttggggtcaagcaatcctcctgcctcagcctcccaagtagctgggactacacacttgcacaagcacacttggctgatcttttaatttttttgtagagacgaggtctcaatatgttgcctcaatatgttgcctaggctagtcttaaactgttggtgaatcttaagtgattctcccacctcagcctcccaaagtgctgggattacaggcatgagccactacccttggctgtgatcaagtatttagtctgttgttaaatgtttactaaatagtctgaagtagagaaaatagcacccaatctaaaataaggtgaggtctagtcacttatttaaatctacattttaagctatagtttactattagtttaaactttaagacaggtaatgttcatgctgcagacaatctaagggcattattaaaatgtttgttcttccttatctcagaattgaagtatgtcagaagcaagacttttctttccattttgttatagtagaaatgcatacattaacaggtacgttttagacattacacgtgctcatctgacccaaaagctctaatgagctgccttaccctggaatgtttttcttagcttggatttgcttttttggagggattaagaaaagacttggctgggcgtggtgactcatgcctgtaatcccagcagtttgggaagccgaggcgggtggatcatgaggtcaggagatggagaccatcctggctaatacggtgaaaccccgtctctactaaaaatacaaaaaattagctgggcgtggtggcgggctgaggcaggagaatggcgtaaacccaggaggcggaggttgcagtgagccgagatctcgccactgcactccagcctgggcgacagagcaagactctgtctcaaaaaaaaaaaaaaacacacaaaaaaaagacttgaggccagaaaaaaacaagcctacagagttttcattaagccattttactgctagttgaaaagtgggatatccagtttacatagcatatagcttattcctctgatttttatttgggtccttaataaaatagaccagctgtcttgaagtttgaacgttgcttctgtttcacaatctgctctcaaatggacatttgattacacattccaagtattcatttacctggtaaaaatttcaggtgagcttaacaatactgtcagctttttgtataacatttataaaagaagtgaattcagaacattgctcattcaaaactcagcattaatatatggagatgtttattaaatgaccctcaaatgtaatatttagtaattactgtttttctaccattcataatagttatcactgtatcctataacttactgtgatgtgatttttgctgctcggcctcctgagtagtggggattacaggtgcctgctaccacatttggctgatttttgttattttcagtagagacagggtttcaccatcttggccaggctggtctcgaactcctgacctcgtgatccacctgcctgggccttgcaaagtgccgggattacaggcctgagtcaccacgcccggccaggccaacagtttattaagaaggtaaacggatatggacaagtataattaatagaaaatagcctaaactgtctcagatacttcctgtcttaatttgatcaaaaattgctaggaagcaaaaaaaaaacaaaaaaacacaaaaaccaaaccagattacttagggagtcctaagtaatctagtaacagcttgaggggaattaaacagataggcatttttatttcatttaaatcttactatcaactattcttaacaggctaaaggttggtcttcaggttgtggcagtcaaggctccagggtttggtgacaatagaaagaaccagcttaaagatatggctattgctactggtggtgcagtaagtaaaataaatgtgataatggtttgctgaatgtttatacttgtctggaatttatagatagtttaacatttcacaattagatactacaactatctgtttcttttggctctttggaaggtaggggttggattaaattcccgttaatttgccacaagtctggcctaagaatgagcttactgactattctatattgactaaatcttattgactgaataagggggtttccttttttttgttttttttggagacagtgtcttgatctgtcttgactattcttgacttgatctatattgactattcttattgacttaaatctgtggggtttctttttttttttgagacagggtgtcttgatctgtcacccaggctggaatgcagtggcacgatcttggcttactgcaacctccaccttctgggttcaagcaatcctcccgtctcagcctcccaagtagctgggactacaggtgcagtaccatgcccagctaatttttttacttttagtaatgacgggtctcactgtattgcctaggcttctcaaacttctggactcaagcaatatgcctgcctccgcctcccaaagtcctgggattacaggcatgagctaccgagctcagttttgaaaggtagaagtgtatgctacaagggatgtaggacttgagagtcaaggcctatggtcttgtcctggctctaccagtaagtgtgaccttcgatgtttttttctcaagtaaggctggtaataattaccacagttgtgagaattgagaatttggaaatgcagtgaaagagactatactcaagtcttgttctggactaacagtgatcttaaaatctctcatttcaaagaaataaagtattttgatgattctcttgcatggtgtattaataaacttggtataatggcagaaactgtaacctacaacaggtttacgtttaactctttttgtaggtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggtaacattcattattatgaataagtttcttgggttctgagtccaagaatgattttgcttctgtagtattccccagtagtaccatagaactaaacgaatacttgaggaattaacttcatagtggaattttgtttgttttgttttgagctcttcgtcacccaggctgggatgcagtggtgcgatctcggcgcactgcaacctccgcctcttgggttcaagcgaatctcctgccttggcctcccgagtagctgggattacaggcacttgccaccatgcctggctaattttgtatttttagtggagacagggcttcaccatgttggtcaggctggtctcaaactcctgacctcaagtgatccactcacctcagcctcccaaagtgctaggattacaggtgtgagccaccacgcccacctcaggattgctttttaagtaaactgcttttaaatgacttggcaattagcatcttgaatgaagaggccatactaactggaattcttttcgtctttaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtaaaaagttaccttttaaatgagtttgtggcctgattttagtttttcttagaataataatgttgcagtcccctaaatggaatagcacattcatttcctgaataacagaagtagaatagtgctaatgtcagagctaaacatgcatcacatctttttcagaggaaatgatttgatctgtagtaggattgggatttccctacatcaatatcctcacaacttataaatgtgttacaatatttacaaatgaaagtattaaaattttgctgaaatttctctgtaggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggtaaatggttgaacactttctaaaaattcttttgttgttcattttgttaatgtatcctcacatcccaaatctttgattttgtcaccagaaaaatagtctaatagcagtagcaacagcaatagctcttgtgcccatcaacaattctcatgtacatttccagcacctagatatttaatactccactaaaaggaagcaggatcccttgagtagcagttgagtccatgcctggaggcaggaaaaaatcaggatggatctggaacaccctgttcctgcctggcagtaagaatactttccaagatacgcagaacagggttttgttttgttttgaagacagagtcgctgtgtcgcccaggctggagtgcaggcagtgacaacctccacctcctgggttcaagcgattctcctgcctcaggctcctgagtagctgggattacaggcatgcaccaccatgcctggctaatttttgtatttttagtagagacggggtctcatcatgttggccaggctggtcttgaactcctaacctcaagtcatctacctgcctcagcctcccaaagtgctggattacaggtgtgagccaccatgcccagacagaaattttcaataagtcttgctcatattttactaagggaaaactaattaattaaatttttttctaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagtt

SEQ ID NO: 35675 - DNA, 13689 bp, Homo sapiens; identical to SEQ ID NO: 35674

SEQ ID NO: 35676 - DNA, 9807 bp, Homo sapiens
gtgtccctccccgcccggctggaggctgctccggaccgggacgcagagtctgcggacccggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaaggtatgcggcggggcttggggaatgtaccccggcaggagccggggtggggggcagtcgtttcgggaatttggggatgtctggaaaggttgttgccgagggggctgggcgcagccaccctgtcccgagcagatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctggtactcccagggcgccctgcgcccctcctttgcttccccacacgctctgggacccctgagagagttcttgggttaggggttagagcggttaactgaggggagcttgggtgaggggtagagggaccccggccgacgtctttctccttcctaccccagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtacggaggcctgggaggggcggctgcactggacacccccaaggagaggagaagagggccctttcttcttacctcccctgcacctctgccttgggggtggggggatagaggcatggaataggtgctctgacctctgaccctctagcccagggagaaggtgagcagtattgatttggagatcgactctctgtcctcactgctggatgacatgaccaagaatgatcctttcaaagcccgggtaagggaccggagagtaggaaaagcagggctcagggccagagagactgggcatagaactaaggaggatggtgtcctcctgactgcatctctcttccctctcccaccccttgcaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgagggatggtgataggacaaggcttggtaccagggcactggggcggggctgggtcaggagccagagcataagcataaggtgattggagagtcagggtggacacgggggttgcggggtggcgggataggaattttcatcctctggggttagcctggtggaacaatggtaggaaaatgctcctctggaggagaggcctggctgggtgtggggctgggtggggcctggctgggacggcgcagagagcatgggctctgaattaggaggatctggtggacctttccttgtgcctttaccccagaaagttaaagggagggatgagatcaccagttccaccttggtttttcccattcttgggtcttgagttaatctccctgctcctctgagcactctttctgcctgagggcttggaggtaagagacagccccagtaaacactggttgagccagcatccaccacgtgccaggcactgtgctctgtgcccaggagggtaggacatgggagggaagagatctctgcaagaagctcagccttcaggtgtcagatggacctggaatggaattcttggctcagcttctcccaagtccttagactgggcaagttaggtgaaccctgagcctcagtttctcaatctttaacattctctactccatacagtggttgtgaagattgggtgagctaatacctagagagtgttgggttctgtatctagtacaggaatgctcaaaatagaaaagctgtaattacaaaatggttcttgccttctagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgtgagtcacaggcactcagaccagggagtcaactcggggagtcaaattaggaaaggcttcgaaggatgggcaggacgtaagaatccagagaggagagggatgtttggagaacagaaagtggaaggttcctgtaggaaaatgatagagctatacttggagaggcaagcggggctggagggtgtaggaggtgaagtggctcacccaaggagctcttgagcactggagaggcattcatgatttttgagtaggtgtggggtgggtcaggagggctggtgaaagcagtgtttttggaagctttctggaaagtttcaccagcagagatgtgtattcgagggaggtcagtgatgggtgtgaattcactcttgggcaatagtaatgttagctgcaatgaaaattaaaccgtgcatgtgagagctgtgtgctagagctgttgggaaggcacagcctccaggacttagcaagggatgagcaattggaagacaagggtgaggggaagagggaaaaaaaagtctccagcacgatttggagatggggtgtgggcggatggcaggattgctgacaaaatagagaagtccagaaggggaaatggtttggacgggaagaggaggggtccagctgtcaacgttttgagcaacaggtcccaggaggactttcagctggggccgtcattcagctagaaatccagggctaggtttcaggagagggccagagatgtctagcatggtagtggggcacagtgacactgtgacgctggagggtcagggtcggagcggaggagcttcccagggagtgcagacagcggggaccaggaggtgcgggaagaagagtcaggaggagagtcagggtgcacttggagaagagagctgagctcctcagtggggtatttgagggagtgaggactcaaggctagagattagactgttgggaaatcatcagcggtcttgggatggcctgtttgtgccctgtggtgggaacacaatgtgaggagttgaggagagagtgggtggtgagaagtggggctgctggtgtagcctggtcttaaaggactaagggaaggactgtgtgtcagtggtgtgtgtgtgtgtatatatacacatatgtgaatatatgagtggcgtgtgtgtgtgtgttagtgtgtgggtgtgggtatggtgtatgtgagtgtatgtgcatgtgtgagcatgaatgtatgagtggcgtgtgatgtgtgtagtgtgattgtgtgaaagtatgtgtatatgagtacatgtgtgcatgtgtgagtgaaggtgtgtgcatgtgtgagtgtggctgtgatgtgtatggtgtgtgattgcacaagtgaaggtgcacatacatactttcttacaaatacacacaagtggcgtatgtgtatatatgtgagtggtgtgtgtgagcgtgtggtgtggtatatcttttttttttttttttttttttttttggagacggagtgcaggctgtcgcccatgcttactacaacctccgcccccctggctcaaacgattctcctgtctcagcctcccaagtagctgggattacaggcacgttccaccacacctggctaatttttgtattttttagtagagatggggtttcaccatgttggctaggctggtctcgaactcctgacctcaagtgatctgcctgcctcagcctcccaaagtgttgggattacaggtgtgagccaccgcgcctggcctggtgtggtattatctgaatgtgagtggtgtgtgtgtgtgtggtatggtatatgtgtgagtgtgtgtgtgtggtgtggtatatgtgtgagtgtatgtgagtggtgtatgtgtgtggtctggtatgtgtgtgtgcatgtgagtggtatgtgggtatgtgtgagggtgtgtgtgtttgagtctgtggtgtagcatatgtggtttttgcaagttaggggagaagggctcaggtacgtgtgtaacccggggaagcaggtgatggagggtgagtgttgtgggagagcaggggcaggctgcttcggtccctggaggagatcttggtgatgtctcctcccccagaggcataccagacagcaaggacagagtggttgcagcgtggataggaaggacgatgagggagcttaagctggctggcttccatgtcctcaaccatgtgggaggtgaggtcacggtgcgagcaaagggacgaagcaggtgggggctcaggagatggagaggtctggaacggctgctgtggggaaggctgggctggaggtcgcgcgggtgctgcagtgttgtgagctcacgctgcagtgttcagtgatctctccactgctttctgcagcttggaagcagaaacaggaagagggtggtggtgtgacttggggttggagactgggccggatagctgcgggtggctgcaggtgcccggagggacagtgaaccctgtaggagttagatggtcatgggaccaggctggggcatggtggacaaagtccaggggtgggttgcgggtgggggcaactaaggcttttctgggttcatgtagtaggtgtggatggggaagaggagaggcagataatggctggcaagagacttggaggtaaatctgaggtcaaggatgtcccatgatggatgatgactgagatggacggaagtttggtttgaagcggtggcattggtgcaggctggcagagggggcagttctggatagagtgtcctgatgaatggggatacccatgggaggtgatgcagatgaggattctgtgcttctgaaggaggagccaggcatttagaatggcactggagagcaaggactgactgagccccttcactgtgtccccaagaggccaggaagggaagattggaggagacaaagttgaagtgagtgttccagggaacgagtcagttaagagatggtaggatcttaagggaagatggctaagatcttaagggaaaatggctaagatctggagagttggacttatatggacgcatgcttcactgggcagaaaggacgcaactctgggtacagatgggggtcggggtgaggggcagtgaagccagggctgaggggagaggggctatgggaggaggtagcaggggggctttggaggttccaggtgttatgggaatgaaggcatctgcaggtagcacactcagtgatggggccacagtcctgggtaggcttttccagacatagaaaagacccacccagtgcacttgctcctgtgggcgtgtctcccggcagtgctgatgcaggtcagacagcccttcccggagttctcagggttacctctcagggttactggcagcgctgtccttaacatccaccccccactccagtccccgggatcccctaaatgggaaggttgggctggcctagggggtggcctttggaccttctctgaggctgctggggagggacctgagtgaggtagttcagaggcccctcactcgagggacagggtctctgtgtgggggtggggctgggttcttgcagacagctcagtgggtttaacctgcaattcctgcctgtgttgtatcctcacgctgacaggggctgctcagcagcaggcaggccgggtaggtgtgtgtgcgcgtgtgtgcacgccattgcgtgcccctgtcccatgggggcgatgtccgagcatgctctgtggagttgatgcgtggccctggagtgtccggtgcttcagtgacccgagctgctgtgtgcgtggcctccgtccgcccagtcattctggcctgtctgtgactgctcagggggtttgggcagagtgggtggaaatgtcttgctgtacgagatccaggcttaggtcccttcccctgttatttgtgtggtgctggggatggcgggggtagggggacgagggagaagctttaagggtcaagcctgagcatctgggacacgagctgggagctaagcctcatcggaagaagccgggtaggctggcctgggaaggttcttggaggcagcagccctctagagtgtgaggaaaatgttgggattgcaggtgcgctcccctggggccccagggcccctgactctgaaggaggtggaggagctggagcagctgacccagcagctaatgcaggacatggagcatcctcagaggcagaatgtggctgtcaacggtgagcccaccccaccgggacacccccaccctgcccccacatcacggtgggggccagggctgtggctccactccctatctgagctggctgatccctcgcagctctacatacttccttctatttactgctgtcttctctggccttcccagaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgtgagtcgggctgtgctgggctgtgctgggctgtgctgggcagtcgggccctggaagcttgctgtggggtgccggttccctgccaacctcctcctgctgcctcctcaggacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagtgaggacctgccacctgccttctgggttcccggcgtgcttggtctggtagcccggctgcttgctaccctagcctcaggacagccccaaacccctggtggtgttttctggtcccatgtcctgtctgtaaacagcagggaccaagtcatcgggatgtagctgtccaggggccttaggcctgggcatcgagtcctgctgctgtctggtccctccctcgcccttgatcactgaagcttattgtgggtgtatgtcagcatttcgtgaagtgtgctggagtgacttcatctcacacacaggctgggttctaaaagttcttttggagatcagctgtttggatttctggtttctccccagaaatagtgtttagaaggtggctactttttcaggctgacccgcagaacctcagtgcagctgtgggaacagtgcagaatctgacccccacctctgacagagtgtttgggtaaacactttcaggattccatctggggtggccacaacttcacatccctccacagtgccagacagtcagggcagaggcaacgtgcatgggggtgggaggattgggggaaggtgagggtcagggacccaggatgggatgggaggggtacctcagggctggctttctgcaggagctgcagtgtgaatgggacagtaagggtcgagtgggagagaacaccgtggcaggtgtgtgggaggctcccttgctttgggagagtgactggtgaggcaggaaattccctttgatgagggccagtcatggtgtctcactcttaggcccttctggtgagcttccttcacctggagatgcagggcagagaagtctgcttccttgctgcccaacctggcttatgcgtgcgcacaccggggatgaaagccctggctaactcggctggccctttctgccccttccaggcagtacgccccgaggtgctccgtctgctctgagcccatcatgcctgagcctggccgagatgagactgtgcgagtggtcgccctggacaagaacttccacatgaagtgttacaagtgtgaggtcagccatccctctggactccttgggcaggttctgaccaggaggtggcgggagatgctgcttactaactgggaggtggaaagcaccagcattcaggaaacagggctgtgattttgagggtggctcatggtggcaccccatctgtcctgccagaatgcttcctgccactgcaggaaatggggctgtggggcttctgaggtcactttgagtcatggataagccaagaaatgggacaagccaataggagagaagaagggcatggtgttttaccgtggtaggggatggggaaacaggagctgagagaagaggtcttcgaatggaggtgagccaacctctattttattagggtggtggtgggcaggggagcaagcaccttgggagcagctctacccactgcttgccctcttgcaggaaggtcctagtgggtgactggaagtaggatagggatggggagttgggtgtggctggaaaaagcgatgacaccagctctgagccatgaagcatctttctaattccaagatggagctggatggggtggggtagggtggagcagagcaggggccttccggtccagtgcccctcacccttccttcttcccaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 35677 - DNA, 3834 bp, Homo sapiens
tcgcgcgttaggaggctcgggtcgttgtggtgcgctgtcttcccgcttgcgtcagggacctgcccgactcagtggtgagggccctggctgcaccggctccgaggagctcggggcggcgggcggcctgcggcggccaggcgaggcggggccgcagcggcacgcccctgggagggggcgggcccggggtggagtccgccccgccggcggcgagggacagcgggagattgggccgagtagcggccagagggcctctccccgccggtccgggccgccggcgacccggttgccgccgcaaaatggcggccgcgagctcgaggctgtgcccagcgaaatggcgggagcgccgagttcccggatggagtggcgcagggtgcgcgcggggcgcatgcgcacgcggcgggggcggggccacgtggcgcccccggtctccagggccgctttcccggccttggggctggaggtatccacacaccaacgcttttgcttaccgagccttagtttcctccttttcccattgcgattgcatgagggaaaggacggcctcgtaaatcttgggtaggcgtggcccgttctagtgtggttcctcgtctgccacgtcgtgctttgcgcccaaagtttggtccaagttggcacagctcccagtgccagacttccaagtctagttctcagagccactgggtggcggccattcccagccagtgaatgctttgtctgtgtcagcactgaccgcccccttaaatagccagttctcctaaatgccacttcccctgcctggaaatcctgccttatcacttccggggccatcccttcccgattcccggcctaggtcctggctatggaagtcagtacctgccctgaggtgccccccaggacggggcggcctccctgacagccagccccccccccagtctcaggaggcattttacagtgagcagaagcacgttctggtccagcaacaagtagatgtcagttggttagggtaggagttggcacccgttcggaaataggagaacctgagagtgcagtcctgcccagggcacaactggaaggctgtgggggaagggagacacccattgtggaaatgggtgcggcctgccttcagtcttgggggtggatggagtaaattatttgaattaagaagtcctaggtggctgggtgcggtggctcacacctgtaatcccaaaactttgggtggccaaggtgggaggattgcttgagcccaggagtttcagaccagcctgggcaacagagcaagaccccatctctactaaaacaaatttaaaaaaattatccaggcgtggtggtgtacacctacagtcccagtttcttgggaggctgaggtaggaggattgcttgagcccaggaggtggaggctgcagtgacccctgcactccagtctgggtgacagttagacacactgcccccgaccccaaaaaaataagtcctaggtatgagtttgagataatgaaaaataaaaatctgattttctaatatttcccctaaaaaacacatgtcatttacataaaataggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaaggtgaggctgctgctgggcccgcggccctgggcgggggggcttgtgctcctcctacctggaagtacagctgggtgctgactgcagacctctctcccctgcacagtggtggttgtgaaagacagggagacccagagatctcggggatttgggtttgtcacctttgagaacattgacgacgctaaggatgccatgatggccatgaatgggaaggtgaggatcagggtgctgagcaggagtcccgtctcgaggatggggcacccacctgctaacccgtcccgccctctgtctccagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggtgagtgccatgagtgggtcccttggggatgctgtgaggtactgctggtgggagctggtactcactttttcctgtatgtgcaggaggaggggaccgaggctatggggggaaccggttcgagtccaggagtgggggctacggaggctccagagactactatagcaggtgagggggaggccggcccaagcacaggggtggttgcgggatggccagcttccgtcccgggtcccaggtccctgggggagctgagatgagactggctgggcaaggagcagaggcaggtggggacccaggccaagaggagaggagactgctcaggacattcgcagaagcgggagggcctgggggacaggctggtggagattttgaacaatttccaagatgctgccctgctggggtccttgttgtgtccccagaagggacggctggcatgggggctggcggctcagcctgttgtggcagagcagaagtagacgggtaccttccggtactcaacgtttgtctgtcttgcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatg

SEQ ID NO: 35678 - DNA, 18687 bp, Homo sapiens
gctgggcggcccggtctcggagaagaggggagagtggcgggccgctgaataagcttccaaaatgatggtgagtggcgtctcgcgcatccgtcgccatcagctgccatctggccggtggccggcgccgctcggcctgggcttgctctgtaggaccctcttttgcttgccgcctctgtcctcgcccagatccccagcttaggggcgaccccagccagccgcggcctggctcggcccgagcacggcgctggagccgttggcgagggctgcgtggggctttagaggagtctctgggctggccggttggggactacaagtcccagggtgcttcgggcccgcgaacccacgtcggggacctcttttttagccccgcatgatcgggacttgcgtgaaacgagtgcaggtcggccgtggttacgcggtcggcagctagacttggaagctggggctgctctgagatttgcgggctgtaaagacgtgtgcttcttggaaccggcacaggcacattggggacctcatattgtgcccgcctagggactcactatgttcactcgctgaccctcaccgcagcgtgcagagaagcagacgccttccctagtacttttaattcattcactcattcgctcagtcattaaataaacgcgtctttagtgcctactgaatgtaccaggccctggtggttgctgggggttgcagcctctcagccaggagaacgggaaaggtagatggagacactgtatcggaggtgggaagacccaggctcggactctggtgacataagaaaggcttttctagttggctacctaactctgggtctcgttttcttgaaatttggggcgagggagttgctgtgagtcctggagccacctaaagtgctccttgtagccctacttcccacacttcttttctctgtctctcggagctttagatactttccgtgggtcccaagcctcgatggtatctcctgggttgttattgagtagggccagcttccgaggtggtgtttgaccctgactgagatactgctttctgtgcacttggcagttcacttattcattttggcctgtccgactctatcttctgctcttttcctgcttcctgcagcttttctctgtcctgttagggacgcagacaccttttaggtgttctaccaaatgccctatgaatcccgcttgtacccaaggtagaaggaaattagcatttaacagtacttcctctcccctttatgtctctagcattgctcattcttgaagtcgtcttcatcttctgtgcagaggcagcatagtacagcagttgagagtaaggcctctggagctacactgaatgcctaggtttgtaacttagctctgccacttactagctgtgtgactttgagcatgttatttaatttctggttctcagtttgtcagtgtgcctagcagatagtaagcactcagcaatgttagctcttactcggcgaggtggttgtttgcttcctttcatctctgaaatcagtccatcccgctgccagggcttccgtaagagctttggttcacattcacacagctagggatcagaaccgccattctctgccgtgataaaacttcaccagtgggctctagatcatcacacttggattttccctgaactgacccctcctctgtcagattgacgtttccctgctgtattggctcttgatatctcctccccatttttggaatgtgaaacttctatctccaagagtcttcctgtcttcaaattggcccctgatattctagaatacttctgtaatcgaaagagaggtgaaaaggtcccctgaaacctcagtcctgtgatgttggtacagcttgcataaaatgtatgtccttgcctttgtggcgttgagcgctgtgtgccttggcatagacacacttgttttgtaagccattaagcttaatgatgcttagtgaaagttttaaagtaggatgaagaggaagatcagtaagctgaaattccaaaaccttccattatacctgtggccaattactggagtctgctcttgtttctttttcttttttttttttcccgagatggagtcttgctctgttgcccaggctggagtgcagtggcaccatcttggctcactgcaacctccattcccaggttcaagcaattctcctgcctcagcctcccaagtagctgggattacaggcatacgccaccacgcctggctaatttttgtatttttagtagagacggggtttcaccgtgttgaccaggctggtctcgaacacctgaccttgtgattcacccaccttggactcccaaagtgctgggattacaggcgtgagccaccgcacccgaccttgtttcttatttattagaggaataaaaaaaaggagcgaggttgaaagtaactaagggatggaaactggactttgcatacagtgcctgctgctggggaactgttagaagaggacctatcctgcttgtcttggcttgactcaatccagctctgccaccttttccaccccatagatgctctctacccagcctgctgtttcttcagggcctgcaaagcatagggaacctggggaatctgtggttagctgcttccaagctcttcttgcattgtgcttaagaactctcagtaaatgtagtgttactgtagtgccagtgcttttctccccaaaagtcaagaagccagtgctgtcaagcacttacaagtagcagttggattttcagccccaaaagctgctgaatattgcttcatgtgtggccaaatcttggcactcttcaaattaaggttattttggtccttgtctttggaaagcttgtacttaagctggatggtgataaaaagttgcgagcaagggcaagtgaagagaaagttatgggattcccctattcagatgcccttgtttattactgtagagaaaacttcttggaagaattggagctctgaggaattggtggcctggtggtgagaaagtggttttggtagaagatggcagagtgactattttagatgggggtacactttgcaggttgaggtgagaaaaagtatacacaagcattgggtaagttaacctgttgaggtgaaagaacctgttgaaggtgataggaagtgattgagactcatgttagtttttgatttaaagtgtaagactccatccgtggcaggggtggaccagagaagacttggggctgccataaggaatgatttagcaagactgggagatggtagggcctttcaggacacacatctttcccttacagaaggtgccagggactgggccagctgaagagccagaaagaatgctgggagtatagagaagccatttcttgccaccagacctgggacactccagcaaaaggaaggaattttcccttcagttgacgcctgatcccaaatgtaggggtttacatgacaagcattctttttaaaataaaaaataaaaggagtaatgtatgattatttgacaagcatttaaaaaaatttaatgagggcctggcatggtgcctcatgcctgtaatcctagcacttcagaaggctgaggcaggagggttgttagaggccaggagttggagaccagcctgggcaacattttttaaatacaaatttaaaaaattagccaggtgtggtacctcatgcattgcggtccagctactcaggaggcttgagcttatagtaagctatgatctcaccactgcactccagcatgggtggtggagcaagaccctgtctcttagaaatatatattaaaaaatgaataatatattaaattactcccactctcttattccgtagagtttattgggtatttttcgttttctttttgtagagacagggtcttgccatgttccccaggctggtcttgaactccatgagctcaagtgatcctcttttttctacagtggtttttgttttttatgtaaatcacagtatgccattcctctgctgaaagcttcccagggctttcctttttaggaatgaaatctgaactcctcaccatagtgtgtctacgagtgtgtatgtgatctggttcctgcctgcctcttcagctttattccagtcttcctcttgcttactaccctccagctgcgctggccaaaagagttgaactttttaaggaattgaccagttaataaggaatcagcctcatgagtggcaagactctgtctttggcaggaattcctcactcctcattgttaggttgggaaagctctgtgctttcctgtgccttccttgctcagacatccacgtacctctaaggactaggtgatggctttcaaactttttattgcattccacagtaagaaatacatttttaatcatagcctagtaacaaatttaacacaataaaagttttgaaatagtatttatccttactacattctgtgtcacacacaaaattagccagaaacacttgagaagactggatctagttcgtgggcttatctctgaaggctcagatttgaatgtggagagaaagtagtctggtttgctaagctgagaaattgctctctctgctaataatggtggtcactagagcaaagatatctgagcgggccctttaaaacaagcaagtatccctgtttctcagtttctaaagcaggtctgcaaatgaagcccttacggggatagggaatgttctggagaccaatgcaatatagaaagaggaaaacttctttggggtatctgattggaaattagtcacacagaagctttattcagccagcatgagagatggaaacattgctgtatgaattagatttgccatcatttttcaaaacagggcaaaggtgctgtttgtttctctgcctgttttcctacactgcagctgaacatcactgttacataaagctgactgcctaggcatctctaggacaacacctcaagctcttggcatcttgcattttgcatcagtgtcccatctgcttctctaagattgagctgtaacacagacaagtggatgttttgctgcggaatgaacacttagcagggtctgcctcttcctcctgtgttgtgacccaattcctcagcacagggagtaaggtcagaagttgaaaaggccatggtcattcagctgggtactggagaactcatgattttttcttttagattaggtcagtgcttctcaaaccattttcctgtctagcatacctgcagggtaggctaaatttgatagtgtctctggaggtagaggctggttggggaatggatgtggtagacagttgggggaatgtggtttaagaagacctctagataattctgttaagggagagatgggagcattttcccctttcccctgccagtctcattataatagatgattattaaaagcagttaatttctttcttttctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggtaagtctacagagttcctcaggcctgtgtgcaggaaaggaggctcctgagggggtgtttgggactagcataggttggtatcagaaatcccactgcttttaagatcgttgaaagatgactcactctgaagcagttccaattcttatattgtcctgactgctgagcccgtgtgggactatatgagagaacctaggctcaggagcctgttgcctcatagggagacgtggcctagaaacatgaaatagaaccatctggagtttcctgtgttcacttccattgttatcaagatgagaaaattcctgtttatatcttggtatattaattgatgtgtgagggtatcaactgtggtaagaatatctaagtggttacttttatttaaaaaatcttttctgtatccagttgacctgtattaattgctcttcaaggaaaattgggagtctgtggtctgcaaaagcttgtgattttagaccctttgtgtacagagctaattctgtatagaaagatcagataggtatcctttcccttcagccctgccgtgatcccctctgccccatcccagtaaagtgtagatgggttctaggtcccacttgaagacagcatttaagaaaggggctttagatttttgtttgtttcttttaaggcaaagcaacaatttctaatgatggggccacaattctgaaacttcttgatgttgtccatcctgcagcaaagactttggtagacattgccaaatcccaagatgctgaggtaggaaaatagttgtgtgtttaaatggaggttgaaacacatgcttgcttgctccttagttctcctctattaaatttttttaagattttatataattataattgtacaagtaatacatgcttataaaagtatttagaattaacagccttttaaaattcatactatttcgttacatgtagcttttcatatccattaatacattggtgaatgacaacagtctttagatataagtctactgcctgagatcttaacaggttgtgtgctgtcatttgtgtgagttgctaggttaaataatttgacttctcatctcttacaaaatggggctgtaaactaagacttccaatctgcctttctttcttttttttttttttttaaagagatagggtcttactatgtttcccaggttggccttgaactccggggctcaagccttctctcacctcagcttccttagtcgttggaactactggcattccccactacaccaggcttttttttttttttttttaaactgatgataaaacagacataatatttattcttaataccatgtttaagtgtataattcatggcattaaccagtctatcttttaaaaataaattctaacactggagtattaataaatgtgttgacagataggttttgtattttagagtactgcaaaatatgtatactacaggtatgtcttgaagttacgttaaaaggtttattaggagccaagcctataaaacaggtatagcatatataaaattaaagagagaagagtctggatttgatttgtttttgtcttcaacgagggaataatgccttttggtccagaaatctgcccacttaaaccttctctatagtaacctttttttttttgccccttgagaatttcttaccttacacagtgaacatacatgaagttaaaaataaatttctgggctgagcatggtggctcatgcttgtgtctcattactttaggaggccaaggtgggaggatcccttcagtccaggagtttgagatcagcctgggcaatacagcacgaccccatctctaccgaaataaatttcttccagtttagagtttatccaattttcttagaaagctctttttctttttcaccctcattaaataggatttagatcccatcacagaaaagcaccatctaaaaaagattagcagactagtaatctgcttattcccagtagttttttttttttttcttttgagagggggtttcattcttgttgcccaggctggagtgcaatggtgtgatcttggctcactgcaacctccgcctcctgggatcaagcaattctcttgcctcagcctcccgagtagctgagattgcaggcacccaccaccacgcccgggtaatttttgtatttttggtagagacggggtttcaccatgttggccaggctggtctcgaactcctgacctcaggtgatcagcccgcctcggcctccccaagtgctgggattacaggcatgagccaccgtgcctggcctcctcatagtttttgaaatataaagaactttggctggtcctaggacgtttgttttagtgtgatttgactgaaagttacctttttttttttttaactcctggccagatgcagtggctcatgcctgtaattctagcactttgggaggccgaggtgggaggattgcttgaggccaggagttcaaaaccagtctagacaacatagggagaccctttctctattaaaaaagaaaggaactcctgcagtaccttttgcttcttgagacggagtctcactctgtcgcccaggctggagtgctgtggtgcgatcttggctcactgcaacctctgcctcccaggttcaagcaattctcctgcctcagcctcctgagtagctgggattacaggcgcccgccatcacgcccagctaatttttgtatttttagtagagacagggtttcaccgtgttgtccaggctggtcttgaactcctgacctcaggtgatccacctgcctcagcctcccaaagtgctgagattacaggtgtgagccaccgtgcccagccaccttttgcttcttaaacaatgtttgtctcttgcttcttggtaccatgattattttaagtattgtattacaataagcatgacaaggactgttttattcatcacaatgccttgtacgtaacataagttctcagttcatgtgtgtaattttttaccctgaggacatttgattgtccacatcagccctctttagagaatggggctgtctggggaattaatttggtagcccaggactgtttgacatgatggatatgtaactaccattagcttctttctacttattgcaaaaacctgtgcttccagaaaaaagcttgacatccatttaaataatattcagtttaaatgggtagcgtgcctaaaaatggagtttcagggctttattccctgaacatcagaaaacgtgtatttcctgtcatcatcttccaggtgggtgatggcaccacctcagtgaccttgctggctgcagagtttctgaagcaggtgaaaccctatgtggaggaaggtttacacccccagatcatcattcgagctttccgcacagccacccagctggtatggcagtactgattaaccttctcttgggcctggacaccttcacatttctcttaggaaggggaatttcttttcaggagtgtggagggactggggaacagggtactttgggcattttctgacatctccttagtaatctcagttctactaatctgtagccatttgatgaggtgtattacttaatctctttaagcctcaggttagagtcagcctggtagactatgatgtagacatagtcttttagtaaggactaagagactcatggcatactactactacatgctatactcaagcacctcatggtgtatattgagacctagctattatttgccctctaaccttcatttgtgatctggggcaagtcatttaatctttctaggccttactttctttgctatctctaatttgagtggtgacattaaaatgaaataatatatgaggagtactttggaaaaaaataaaaagtttatatatttgtatgcatattttatatataactaatatataaagtgctagaagttgtcgtaggtgtttttagtaaaccaggaggtttggcttaatctcgtgtcacagctgtttccactcattcgttgtagcgtgttacctgcagacccagagcaaaatcttggaagcaccctgattcttcagaactgtatacccactctgcatttctgacttggaattttctgaactatagagttttacatttttctgagcagttacaagacctagaagtgttttttcagctgtagagtagaaatgcttaggatttgggagtgaacagactcaggactattgagagattgaggtccacttcagcagtttgtctttagcatgagagactcattcaacttctgttcttggcaggcagttaacaagatcaaagagattgctgtgaccgtgaagaaggcagataaagtgtaagtctgtagtgggtttttttttttttttttaaagagacggagccttgctgtattgcccaggctagtcttgaactactggctcaagtgatctcccacctgcgactcccaaagtgctgggattacaggtgtgagtcaccgtgtcaggcctttgtcagaaccttgactgacttcctgtggccaaattggatgcagaagcatgctgcaatccctctatgtgcctggggctgtttggctcctgccagacccttggctgtgtcccagcccacagagcacaaaagaagctgtcgactgtagtttaaaagctgccacatatgagatctttgactgcagtcaccatctgtcactgataatctgccctaaagatacaaaaggtgaagttggagagggctgagtttagagactggaagggaactacctccacactgtagtagaatcagataagagggatttggttttcaagacctgatgcagattctgcccttgtgtcccagggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggtaagcctgctgtggccttcctagacagctcttgctttcatattgacccttcagacagcttcatatggcagaggggtactcattacaggaataaagagaatgcatgttaggcaggaagtcagacttacattgtactttccatactgccattagaggctgttactagatgaacttggtaacctctgtggatattatttgtcagcagagtagaaaattggactgtatgattttcagaatctcaggttctctgtgtcagtgggtggtggaggggtagtaggactagctcaaatcatcaatgacctcccaattaatacatctgagagggatttttcagttcactgcttactcctaagtgatactgttaagcttgcccttctttcattcatttatcttgaatagatgatacatatttcaaactgtgaaggggcctaaagttaaaagtgtttcatgcactacccctgccccatatacagccactattagtttgtgtgtatccttgcagaattactttgtgcatatatgaacatgtatgtaaatactgttttttaaagacaaaagattgcttatatagtgttctgtagcttgcttttgtccattcaacaacatattttagaaattgatccacattagcgtgtgtagctcttaactcagcaccctccagtagagctttctgtagggtggtgggactgttacatatctgcgctgtccaatatgatagccccatccacacttggctactgagcacctgaaatgcaactaatgtaactgaagaactgaatcttaattttatttccatttaaatggcaacatgtagctagtggctactgtcttggacagcacaactccttctttttaacacagtagtatctgtctggaaacgtccttggtatctccatgctgcttttggccttttcagtctctggcctgctttacttattactcttcgtcagtgacctcaactgaagcgatttggatagaggaggaccagcttgaaagatagcctggcccttctctttaaattttaccctcccaaattgcattcccactttgccatttcccctcctattgtggcacatgtcagaccagtgggctgagattctctgtatgtaataaagctgtgaggaacctggaggtcatctgagccatttccctatcttcatcatggcttgctgactttgtctttactcactgctttagtagcgatttttcatcttctcttgggccttcctacttccataaatggttgagattagattggcatccacttctaatctagaaatggcatccatttctaatctacatagattagaaatcaggactaataatcttacctggcaagagagccagggactctaagccacacttgcgtttttccgagactgtcctacattcgttaaatacatacaaacctgacccagaattcaataaatagtggtagtgattatttacttgttaccagggttaactgggaattttctgatccatatctttagtactcacctctcctctgagcctcatgctctttcttgtgtctaactgctgttaaacgctttatcttgtcctccactcctgtgatagcattttctgtatttcttgtcatagttggtgtcaccaccgtttattcagtcactcaaaccagaaatctgggatcatccttgaaaacccttctgactccagcctgtcaattaccattgttccattttacctcgtgatttcctaattatttattgagtctgtctcttttactctttctggtactattgccacccctcttccagtcttggatcccctaaatccattgtacttatttactatttgcagggtgaagtttcctactttattcttctgcgtaaagccttctgatatctacattccctatacaaagccaggcattaacaaagcctgtaagatccttctaaactggcccctgcctacttcccctctctcttcttcactggctggttcttaccctctaaattctagcaacttcaaatggcttttcattctctgattccacaacactgcctcccacctcttaggagaaccccttttttccttttttctctttgactaatttctgctcatctgtcattcagctcaggcatcactccctttaggaagctgtggatttgaatgatgcaggaactggggacagatactcttcacccatgggttacagtattatagattagaattgtagatgagcactggcagagaaactaaaggttattgaactgaatacccttttttatggtgtgggaaatgactcggtcatttagtaaggaaaagatctgagattggaacctaagtctcacggtagtgctgagtcagccctgggtgcagtgtgctttctattatgccctgctgttaaatccaacccacagagaagctctgttgcagaacaagtggtagaagatccctaccttgagggattgaggtctgaggagctgcagtgatagcttagaaattatgcaggggatttctgattcttaagaccttttggcatcatcttctggagggaggaagcgtcaaggctatagtatccatgctgttgggggtgtgggggtggagggtgcagtgcaaattatgggtacatggaggtgtacaggaggatacttgagatttgggagctggggcatagaagagggtagcattgcacagcttttgttttgccttctttgtaaacacctggctcctcttctggcatactttttggaagtttgtacagcattatccatcggccagtgctgcagaggccagtcttagaggacagcccagtaggcctttaccatgctttgcctctgctaaccagatgattttccttatgcttaaggggtgactgaaataatatgttgtgttatttaaaaaaaaaaaaaaggatttgtcttcgattttatgataacagaaaggctgtgttacagcagtgaaataaagacatgattagctcaggctcacaggaatggataagcactagccagcaaacaactagcttgattttatttcatgttagtaccaaaccattaaagtgtttgtttttttaaaacaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggtaggtgggttcaccagttggtgggggcatggaaatgggcagctttctgagccagagccctgggtcttcatggctattgtgggcccctttctcttcctgcccccctgaatattgatgtctaagtactaggcccccttctttccatactctgtgttctccctgagtgaccttgacctgaggaaatttggatagggaacacctgttgaaatacgctgtggtcctggggaaggggatggcagggactctctagctacatagcctgcccggtattttggttcctcttgttggtgcaagtgtgagttcctccacttctagactagacctagtgctgcagagacaggtgtgctctcattgttgatgttacccaggctacctctggaggtagccatgtcacccacctttgagcagttcttggggaaggggtcttttttttttttcctttaagacggagtctcgctctgttgcccaggctggagtgcagtggtgcaatctcggctcactgtaacctctgcctcctgggttcaagtgattcccctgccttagccttctgagtagctgggattacaggtatgtgccaccatgcccagctaatttttttttgtatttttagtagagacagggtttcaccatgttggccaggctggtcttgaacttctgacctcaggtgatctacctgccttggcctcccaaagttctgtgattacaggcatgagccactgtgcccggccaaaggggtcttattgggaactccatgaatccagcacctcagaagagtctagacctcagccagtttaaactatttctcgcatctggacagcaccagctgtggttctcagccttggggttactttctgcttttgtgttggggagtttcaggtgattcctaagtcatctcatggggtccttatttgcttggactgaggagtagctattctgtttatctctgttaattcccagatgaatcagcatgttttatttggtgggggcagatgggtatattttaccctaccgtatatgtcaaccttcaccccaaagcattctcatccttttctgggtctctccaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggtaaccagattttcacaggctgcttctcggcctttgtggccctgaagggttttcactgacccctggtataacagagtgtactgtcaggttggcgtgtgaattgagccctgttttttttttttaactcttttttttccaggacacattccatttccatgtgtgtgtgcccagtagcacaaactactttagtctaaccaaaacaagtccagaaatctggtttgtgagagaacctagcagtaatgctatgattagctggacaaactcaaatattgattcttccagccagattttttccctttcatgagcatcccacaaaagatacttttaggtttaaagtactcctgagttcagttgctggacccagtgccaccctagtttaggggagggagtataagctgaattgaatgggtccctatctccttttaacttcttctgtttgcctttgatgtgttttagttctattttgttttttttttgctctttcagagagggggaagggtcgcctggaagtcaagggaaagggcgggtaatgtagaggctctgggggcatgcgtgggaattggctttgagacgaggtggcaggaagctgcctggcctcgggaaccttcactgctagatcttgccttccttgctccctaggcctgtggaggctcaatccagaccagtgtgaatgctctgtcagcagatgtgctgggtcgatgccaggtgtttgaagagacccagattggaggcgagaggtgagccgtgggcccaggccgagctcacaaacctgcctgggtctggtcttctgccatcttttggctgtggtatacagcttttacaaagtctcacctttgtgtacaaagtggtatacagcttttacagagtctcacctttgagccataaagagctcagataatatacaggattacaggaagatctaaaagccttgactccacaatcttttatgccctagtggtacagctgcagacctttccaagaaaatgtctataaggttgggattgggtaacctgagtgaagaatgtaagagcagctgctgagtgttgggggggctggcagtgaggacaatacagtaggatggtggcagacaagagttcatgtgtgtactgtttaatcctgggcataggtacaatttttttactggctgccccaaggccaagacatgcaccttcattctccgtggcggcgccgagcagtttatggaggagacagagcggtccctgcatgatgccatcatgatcgtcaggagggccatcaaggtactgggctgatatcctcctgcttgcacagcctactctctcctatctccctagctgatcagaccttggatttgtgtggtgattccttctctatataacctgccctttcctgggtggtgtggtgagccctgatttgccccacaaatggtagagaaactgagcctcagtttctcaaaaataggtcatcctgccttgaaagctaagacttgttcttttagccgggcgtggtagctcacacctgtaatcccagcactttggaaggccgagatgggagggttgcataagaccaagagtttgacaccagcctgggcaacatagcgagatcctgtctctacaaaaataaaaaaattagccaggaatggtggcatgtgcctgtagtcagtcccagctactcgggaggctgaggtggaaagatgccttgagcccaggagttggaggttacagtgagctatgatcacaccactgcactccagcctgggcaacagagcaagcagaagaaaaagacttcgttttgttagcaaactggagctaatgtagtcagatattccagtaattgtgccagtgtccttgagctgcaggtgaccttgaaaatagtcagaaaccataaggttcaccaggttgaagttgggatgttctagataggggctgtgtctgggcgtttggggcttgggatggaggaaggaatgaagaaccactctttctgggctgaagggacctactgagtggcccagcatggaagcttggaccaggggccctcttacattgagaggtggtctgatctctgcagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggtgggtcctttctctccccagggttcagggtttgggcgggtggggctagattctgaatgtgagctgtgcttactcaagctgtgcacgcctggcccaggagataggctgcaactccccccagcctgtctgcctgaccaactccctcctctgagggcagaaggaaagccatggtgctagcacaggagatccagggtttcttcattgcttctaccaagagtatgatcgtggccaggtgcggtggctcacgcctgtaatcccaacattcgggaggccgaggtgggcggatcatgaggtcaggagttcgagaccagcctggccaacatagtgaaaccctatgtctactaaaaatacaaaaaattagccaggcgtggtggtgggcacctgtaatcccagctactcaggaggctgaggcaggagaattgcttgaacccaggaggcagagcttgcagtgagcagagatcgtgccgctgcactccagcccgggtggtagtgtgagactccatctcaaaaaaaaaaaaagagtatgattgcttcttatggtaccacaggaggaaccttgcatccaccttcctggaagcacatactgaccacatggagtgggcttactggtgtggtgaagctctccagagccctacaagtgtgaccctgggctagttacttcaacctctctgagagtttaatttctccatttgttaaatagatagaggtttgttaagtgcttagcacccagtgaatgaccctgcttctggcttgtattaggacttttgcttaaagtcactttacctctgtgtctcacttgcctcatctgtaaaatcgggctatttgaagcaatgagatgaaagatgggatagtatttttgttattcctgtttatcttgagaactcattgtttgatatatatatatatatatatatatatagtcctcaggtgacctgaggatggggccgccccaaaacacaacagcttgcctgggagaagatcccagaggtcttgtgtggtatgtccagggctaaggggaggagttggcgggagtaggggtgtttccaggttcctggcatgctcataggaagatgcagtattcttcagcgaaatgccaccaagttcagagagtctgcgggttcctagcagtgtcttttggagtaccagtttacaagaggaaagttgaaagtagttccatattacctcctttcttttcctactcttttaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttc

SEQ ID NO: 35679 - DNA, 91953 bp, Homo sapiens
agctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcccctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtaaggcggcgcgggtctgcgccctcccctctgtctcctccaccgcgcccgggcggctgcaggccggacccggcggcctgacgatgtggctgcgccggtcccctccctcccattctcccctccccctgcctccgccgccgcctcctccttcttcttctctcctcgctctcaaaatggcggccgcgacggccgttgagtgagagacccggaggagggggactgtccggggagggcgctgccctcgctcctctcctcccgggcccggctttgggggctgccggcgcctctgcgacccccgccccgcggccctccccaagaagggatcgccctcctccctcggtgacttagcaagaaaagtattcttgggttggaagggcgtggggaccaggtagctctctgatcttggggaaaaggatcggccctgctctccccggccgcggagacgagcaccgcagtccccaccccaccctcagttatcggctcggggaccggctcagccccgcgccgccggggcactcatagggccttccaggcattccgtccccgactggtccttaagatggggttgaccagcggagggtggcccaccgtctccctggcccccggtgcggcggtccagcctcagcacccgccgaggagaggcagcccggcccaccgagcaatccgcagcatccacccaccgaatctggcaggattttctttctgccaccggctcctcggtcgggagttgccttttgatgctgttaacattcagcttcgaggctccctgccattccccttcgtctaatctcatctccctgcccctttgggaaacgcagtgcctctgcatatttaccctctttagcctcccacatgagaaaatgcctttgaggtggtcgacacattttgactctgcacctctaaacgtagcagtagaggggaagaggttttccgtatttagtaggagagagcaaggtaccatagctttatatgttatgctacctttcttcagtgacttagcaagaaactccttgggaagagggcaggaaattttcttttggggtttgggcccaatttatatcagtcttttggttaagaaaatacgcctttgaagaggaggaccagatttgtggtctcgttctcaatgggcgatgtcatgccaaggtcccccctccctctttccttaagtggcagtccggacaaatagagatattactgatattcccatctctcctttaagcacacagtcttggagtttcataaggttttaaaggccaaacaaacaatttgtgccatttttggcaattctgtttttgttgggggggtgggttattttgtgtgaatttcttttcgaggctagggcggaggagacagtgcttgggcctttcataccagtgataatgtcatccctccctttttgccacaggagtgtttgcttttttttttttttttgctgcagcagggcggcttaattgctgcggggtccagtctcataatcaggaaaatttcctgttgactgtgtcatagtgatgttgaatatatagtaaaagcttttacttaaaaaattctgatttggttttaaggcattagctagcttttaatctctaatgggtgtcttttaggacacagtttcacaaaataattagcagttgcaaattgcagtttttaataaagcagaagagtaatctgtatttagggtgatttctttcgtgttcattaatgatcattgtttggattgctcagaaggggggaatctcctaaaagaaattgaaggctggtatatattttaaaatcagaaaggaatccaatttttcacttgaagtatttctgtatatgttgattttgatggagcaagccctacgttggtacctccccccacatccttttttaaaaaaatgggctaatatttgtggatgctgtgaacagccattgagccgagaagactgggtggagtaagggagcagaagctgtgaaatgctgtattgccctttcacagcgtctttctcttgcttatgttttgtaaggttatttgatatgaatggttgctacaactaagtcatttctctgtcgtaagtcttaaaatctaatgttttccaccttttttgcatgatgggcattgaatgattggaataaaaagcaatgtccctgctttaaaatagacacttattgtctccttatttgtccctgtgtgtgtgtgtgtatatattaatatataaagatacacacacacatatatctacactcttgttaatgttttttattgttctcgccatataagtataaattaatgtcagaaatatttggcaagaaatagggggtacaggaatactgcaataatctaagaaaaatactacaattgttttacttaaaacagtaaatctatttgagattttaaaatagtgaacataaaaggtggggaaaaaaggataagataatttgcatgaaagccccttcagatcttttctcttgtgttgctctttgaaagggacctttttgtgagatactgccataagctagggtaggtcattttaatgccctgtatcaagcattcacatgagtagacatcttcaaaagaatttcacatataggtggtaaatgtgactttgattagccttatgaatgcttgtcagtgtatgatgtatttttacacttttgttctttttaatatgattagaaagtagaagggttattatggtgaggaaatgagtaaggttgggaatgataattcactgtattatgtgtctgacatatccctattcctactgtttgtagaatatcaaagcacactaaggtccaggtgcagtggttcacgcctgtaatctcagcactttgggaggccgaggcaggtggatcacctgaggtcaggagttcgagaccagactgaccaatatggtgaaaccccgtctctactaaaaatacaaaaaaattagccatgtcttgtgccatgcgcctgtaatcccagctgctggggaggctgagacaggagaatagattgaacccgggaggcggaggttgcagtgagccgagatcgtgccactgtactccagcctgggcgacagagcaagactctgtcaaaaacaaacaaacaaaaccccacacactgagtggtgatttttcagtagattgttgttaatcaggagcttaagataatttgacttaaggagctttagttccaagtgtatgtagtgtttcttgatacatgttggagaatcttaggcttaatttggagattaatttttaaaattattcatagttctgtatagaactcttaatgagattggaaggaattttttagtacaattttttgttacctgtttttccagataaaatatctctagtgtaaagagattttgagatgtttctgggaaggaaaagtcagaatcataatttatgcttttctagctagaacatccgtgtctttttttttttttttttttttttttgaggggaagtcttgctctgttgcccaggctagagtgcagtggggtgatctcagctcactgcaacctctgccttctgggttcaagcgattctcctgtctcagcctcttgagtagttgggattacaggtgcctgccactacacctggctaatttttgtatttttagtagagatggagtttcaccatgttggtcaggttggtctggaactcctgacctcgtgatccgcccgcctctgcctctcaaagttctggaattacagatgtgagccaccacacccttccctattttctattttttaaaaataatataaatgtttctctctcagttgtatactaagtaacagagagacagaaagtgtgtgtgtgtgtgtgtctgtctgtctgtctgcgtatatgagactttatggcttatattttaagtatccagcaaaaataagaccctcttgtttacatgtggttcatgttattcataatttgtcatctttgtgaataagtcatggatgctatagaaattgtcaacattaagatgaagatgtctggccagacatggtggctcacacttacactcccagaactttgggaggccgaggcgggtggatcacctgaggtcaggagttcaagaccagcatggccaacatggtgaaaccccgtctctactaaaaatacaaaaaaattagccgggcatggtggcgcacacctgtagttccagctactggggagactaaggcaggagaattgcttgaacccgggaggtggaggttgcaatgagccgagatcgcaccattacgctccagcctgggcaacaagagcgaaactccatctcaaaaaataaataaataaataaaaataagatgaagatgtcttaaaaaacccaaagcaaaatattagggcagagtgaattttcaatatcttcccattgagttctaaagcagtgagtcatgcgctcttttgccaaagggacttgaggctcggttggttttaaaccaagctggccatttctgcttgtggtcctaaaatattttttacttgcctctaagtccctgttaacgaaaatatttcattatgacaggtaacttatttttatgtgctttggaaagagggaaatagttaagttttgaagtggaaattctttgccactgtttttattatgtcatctacagtacaactattactttttttttttttttacttagaaagttgttctatttaaaataaaactagtggtatacaatacgagttctgaaaaaaagacagacctaccgttctccagaagatgcttagctgtaaattgaatcctcgtcattgaaggtcaaacattttgagaaatctgtatttcatgaagaaagatgctgtattatgtaagcgtaatagttaactgcagtgaaggctttttggattgttctttgttgctggtttggcatggcactttttggctagtcattgaaatggaaccttagtttaacttctgttacatatgtaatttttaaccttggcatggcagtcatagaatttaattgatatttatgaaatgctttatattcattggtggcaggcatcataagcacttattattttatttcttgttttctttttaaaagatggtggcttcttgttgaaacttacctagataggactaatctgcatttgtcaaggatacttctggaatggtactctctattgtcttttaacattgtcataaacgtttctctagaactttctaaatattgagcttggtactgattttcatttgttcttctgccagctactttttgaggtagattggtatttttatggatgagagaactgaaatccagagaatttcttttcctgtcgaatgttaggttagtgactagaataaggtaaatattgcagtcacagaactcttgggtactgctttgtaaaatcacacattccttctttctataacgattggactccttaatctttgttaaatggtgaaagttggtggtatttattgcctgcatcatttaaattggcatttattaacatatggtcttgtattgttgactgctttgcatgcataaggcttttggcatttgagtagcttctcccaaaaaatgcctaatactgctttacagatagtattaataagtgaataagtactagttgcatttgactgaatggttatgtgaaaggaaatgtgctatcctaaagatctttgtaatagttgactccggtgatctcaagagaattaaggtgatggaggaaagagtggctgcatttcgtatacagagattttatattctctgagggaacagggttacactttgacagaattcttaagtataaaaagtgaattaactcaactggacaaattacctatacattttgattatctgcttttggggctcttatgttgacaagaattgacagttaactgaggccattaaaaaattttctgagactttttacaaaagtaaaattaagaatctttgaacattttaataaatttaatttttgaaagcattgtagaaagttatatgtttattaaaattttacagtgcagattaatccatttttaacctttttttttttttttttttttttttgaggtaagagtctcactccatcacccaggctggagtgcagtgtctcgatctcagctcactgcaacctccacctcctgggttcaaacgattcttctgcctcagtctcccgagtagctgggaccacaggcacataccaccacagacagctaatttttgtatttttactaaagaactcctggcctcaagtgatccacccgagttggcctcccaaagtgctgggattacaggtgtgagccaccacacccagcccaatccatttttaatctaaggtaaagatagaagagtttgttttatgggttgggcactgtggttcatgcctgtaatcccaggactttgggaggccaaggcgggcagaaggtgatcaggagttccagaccagcctggccaatgtggtgaaaccctgtctctactaaaaatacaaaaattagccaggtgtggtggtgggtgcctgtaatcccagctacttgggaggctgagacaggagaattgcttgaacccgggaggcggaggttgcagtgagccgagatcgtgccattgcgctccagcctgggcaacaagagtgaaactatctcaaaaaaaaaaaaaaaaaaccaaaaaaagaaagaatatgttctatgatatactagtgttttatctatttcttttcatatttttattttataaaaaatatgctaactacaaaagaaagaagatggagataaatgagtcagatgttttgattatttagtattttggttaagtttttctttttgagacggactctcgctgtgttgcccagactgtagtacagtggcgcgatctcggctcactgcaacctccgcctcctgggttcaagcgattctcctgctttagcctccctagtaatagctggaattacaggcatgtgccaccacacctggctaattttttatttttagtagagatggggtttcgccatattggccaggctgatctcgaactcctgacctcaggtgatctacccacttcagtgtctgaaagtgctaggattataggcatgagctatcatgcctggccttggttaactttttatgggtgaggaaaggctatacatttagcattgtcagagaaaatgaaataagctgttgactaaactcatacatgaatatttatttattatttatttatttatttttcaagactgagtctcgttcttgtcgcccaggctggagtgcagtgttgcgatcttggctcactgcagcctccgccttttgggttcaagtgattttcctgcctcagccttctgaatagctgggattacaggcatctgttaccctgcccagtgaagttttttgtatttttaatagagatggggggtctctgttggccaggctggtctcgaactcctgacctcgtgatctgcccaccttggcctcccaaagtgctaggagtacaggcatgagccaccgtgcccagccacacctggctaatttttgttttttgagatggagtctcccaatcttgttgcccaggctggagtgcaatggcatgatcttggcttacttcaacctctgcctcctggattcaagcaattctcctgcctcagcctcccgagtagctgagattacaggtgcctgccggcatacctggctcatatttctatttttaggagagatggagtatcaccatgttggtcaggcaggccttgaactcctgacctcaggtgatcctcctgcctcggccccgcaaagtgctgggattacaggcatgcaccacggcgcccggcctaatttttctattttctgtaagaggtgaggtcttgccatgttgcccaggccagtctcaaactcctagcctaagcaaactgcctcaagccatctgctcacctttacctcccaatgtgctgggattacaggcatgagccactgctctcagcctaagaaaaaatatttttaaagttgacaaatgtagaaatgagctaagatttgtcaaagggatcaataagtaatgaaatattctggttatcaaagtttatcatatatgaatgaacagtgaaaaaattggaaataacagaattaacaaattttaatttgtctttaatggttcagcagtcacttaaaaatttttacagtattaccatgatgctatagtctttatcatcacaaatcccaacgtaaagataaaaaaaaaccccacttaataaaatcattattcaagctttctggctcttcgacttgggctaaataagtgttctgtataatggtatgtccttaaagagaaattatctccacctactgaaaaaaaaaacaaaacagcgagggcctatcaatttgagagtttaaacaggcctgtggttcgcatttttatggaagcatcataatacaaccccaagacatcaaatgtcactagcacagaagacatctaggatccaaagttcttagaagaatattacttttaaaaacattagaaataatactttacgtgggactcaaccttgactcttctttcttcctctatatccaatcaattaccttgtcttgccaattttacctcctcgatatttgttgagttagtccccttctatccatacttaccattactactactaccatcatagttcacataatctcttacccaactaatttcacatcgtctctctaaattcagtcttgtccggttaacgtctttctgctacatagtccccagtcatctatctaaaatgcaatctgaccatatcacacttccctacttaaaaagaaccctcccttggctccctttgtatttatttaacaaatatttacatagcacttactaatacgccaggctctgttttaagtgctttacaagtattcgtttactcctcacaacattctgggagaatttagctagccctttgtgacagctttgtaagtagcagagctgaaagttgaacctcaggtactgaggctccacagttggggctttcagccaccgtactgtgctgactccctctttcctatagtccacatactttaacacagtttgctaggtcttcagtcacttcaagtttcatttctaatcaagccccaccttgctcacactctaatatatatatgctttctccctccccactttgtgatctttgtgattctactcctgctgtcctctctgtctagagcaacttgtagtatctcagaacagagtgcagtgaatacattttgacaaaagaatgatttttttttttgagacagggtctggctctgttgcccaggctggagtgcagtggctaactacaactctgcaaatcctgggctcaagcagtcttcttgcctcagcctcctgagtagctgggtctacaggcccgcgccaccatgcctgggtaatttttgtatttttcaaaatacaggccaggcgcggtggctcacgcctgtaatcccagcacttggggaggccgaggcaggtggatcacctgaggtcaggagttcgagaccagcctggctaacatggtgaaaccccgtctctactaaaaataaaaaaattagctgagcgtggtggtagatgcctgtaatcccagctacttgggaggctgaggcaggagaattgcttgaacccaggaggcagaagttgcagtgagttgagattgcaccactgtactccagcctgggcaaaaagagcaaaacttttgtctcaaggaaaaaaaaaagtatgtatatatgtatacacacacacatttttgtttttattcaatttcataagaagggggaaaatcttgattgacattgggtaatttgaaattttctccagattcttttttttttttttctggacacggagtctctctctgtcgcctagactggagtgcagtggcacgatcttggcttactgcagcctccacctcccaggttcgagtgcttctgcctcagcctcctgagtagctgggattacaggcatgcgcaaccacgcgcggctaatttttgtatttttagtagagatggggtttcaccatgttggtcagactggtctcaaactcctgaccccgtgatcctcccaccttggcctcccaaagtgctgggattacaggcgtgagccatcgcgcctggccagattatttttattttcttttttgagacggagttgaggtcttgtcgcccaggagtgcaatggcgtgatcttggctcactgcaacctccacctcccaggttcaagagattttcctgcctcagcctcccgagtagctgggattacaagtgtgtgccaccacacccggctaatttttgtatttttagtagagatggagtttcaccacattggccaggctggtctccaacccctcacctcaagtgatccccccgcctcggcctcccaaagtgctgaggttacaggtgtgagccaccgcaccctgctgagattcttaataaaatgattaaatggataggaaaatcagtgtacttggtattttaaagctgtcctgagttgttatggtataccttgtatgtgacctgtgtcatttaggctatttcagggcccatcaaatctacacactaaagacagccaagagatgatacttgaactgaatcttgaagaatgaataattgggccaggcgtggtggcttacacctgcaatcccagcacttcgagaggctgaggtgggtggatcacttgacgtcaggagttcgagaccagcctggctaacatggtgaagccctatctctactaaaaatacacaaattagccgggcctggtggtgcatgcctgtaatcccagctactcgggagactgaggctggagaatcacttgacccaggaggagtattggagtgagccgagatggcggccactgcactccagactgctgagcgacagcaagactctgtctcaaaaaaaaaataattggagtgaacgtgggaggtcattttaggtggagggaacagcaacataaatagtcacagaagcatgagaaactattttatgtatgctggtaatagtttggcagaggggattgtagaatttgaggttggagaggcacgtctgagccagattgatagaatttgtatattgtgtagcttgtaggcaagttggaagtcattaaacaatttcaggtaaaaacaagcattatgagatgatgtatattttggagagattatgcaggtggcaataatgaatgtggattttggaggtcatgtagacttcttcagaaaataatgattagtgcttgaagcaagacagtgacattaaatgttgttgagtggagaaaggtttaggaggtccggttgtgaatgagtagtgtgatggggagaggcaagttgaaacaattcagatttgtagtttgggtgactgagtggaactgagaaacgaggtgttattagccatagcagagaataagaggaggagttgtatagaatattacataaagcagccagataaatgttcctgaaccacaattttcaagtcactttgttgccaaaaacccatcatcagctttttactgtctttaatgaaaatgcaaagaacacaatggcaaaactatggtactgaataggtgtttattgaatcctaaatgggcactcaaagacttctcttacatgtcctggcttttcatcctgtttcttattgccttccatgtctactgtgattcagctttgggaagatattttctgttccttttgctgctttgactccctgccgcgccccccttacttacgcttcaaatctgcctaccaggttttccatttccaggcagtcttttctaattttttccacctggaagaaactttcttttctctgagttcgtaatcttataataagtacctatttttctcttcttctagcgtatataaaatgtattatctgacgtgtcaagtgagttaatgcatttaaagagcctaggaatggtacctagaacatagtaagtactcaataaatattgttattatggtgatgattgatgatgattaagatgaggtgacctttgctttctgctttcttgtgatggcaaaaatgatttgttgtctgtctttggacactagggaagcaaagtcttttactttgcttatgtatataaaagtacaaaagtgaaattattcttgagctgtaggtgagagatatacaaagctagacaagcccttaaatattgacgattttgttaagcttcaccacagctgtttgaggtaggcggtatattagtccctttttaaaaatgggtaaataggcttaggaaatttgtagatttccccaaggtcacacagtttgtaaggagccagattgatatatgaatcttaactattcgactccaaaattcttcacaggagggcttcatgtgtgtaggacttacccttcagggctttcatttcatttatgtatccaacttgttacctgtcagaaagcctatcatgagacctatgcccaatggaaaaaaagtgctttttgagttttctttaatttttttttttggagacgaagtttcactcttgtcgcccaggctggagtgcaatgacgctatcttagctcactgcaacctctgcttcctgggttcaagcagttctgcctcagcatcctgagtagctggaattatgggtgcctgccaccaagccaagctaatttttgtatttttagtagagatggggtttcaccacgttggccaggctggtcttgagctcctgacttcaggcccgccttggcctcccaaaatgctgggattacaggtgagccaccatgcctggctaaaattttattttgtgtatttacagtttaatttgttttctatttttattagggaatatgttaaatgttaaaagtacctgcagtagtaaaacagaatagccatataagtattaccagaattgacagatgttaacattttgtcatatttgcctcagagctttttttttttttttttttttttttttaagacggagtctcgctctgtcgcccaggctgggctggagtgcagtggcgcaatctcagctcactgcaacctctgcctcccaggttcacaccattctcctgcctcagcctccctagtagctgggactacaggtgcccgccaccacgcctggctaactttttgtatttttagtagagatggggtttcaccatgttagctaggatggtctcgatttcctgacattgtgatccacccgcctcggcctcctgcggtgctgggattacaggcttgagccaccacgcttggcctagagcttttttaaagaaggcattattacagttatagttgatatctttttgtattttgttttttattttgagacagagtcttgctctgtcaccagagtggagtgcagtggtgtaatatccgctcactgcaacctcggcctccagggttcaagagattcccctccctcagcctcctgagtagctgggactacaggcgtgcaccagcgtgcccggctgatttttttttgtattttagtagagatggggtttcaccatgttggccagggtggtctccatctcctgacctcatgatctgtctgcctgggcctcccaaagcgctgggattacaggtgtgagccaccacgcctggccttttcttttctttttcttttttttttttgagatggagtcccgctctatcacccaggccagagtgcagcagcaccatctcggctcactgcagcctccacctcccaggttcaagcgattgtctgcctcagccacccgagtagttgggatcacaggcatgtaccaccacacctagctaatttttgtacttttagtagagacagggtttcaccatgttggggccaggctggtctcaaactctgggcctcaagtgatccacctgcctcagcctcccaaagttctgggattacaggtgtgaatcaccgcacccggcttgatgtcccttttgtacttctttccaattgtgtccaccttcctcttctcagtagtaaagtttctcctaaatgttgtatatagcccttcgttccatatttttatgcatttactatatttgggtgtatctataaacaatatatagtagtgctttatagattgttagaatttacgtgaatattctactgtatatctatattaatctacttggttttctttcctgttttttagatgcattattgatatatgtagatctagtttatttagttgtataatttcttatatatgataccatattttctttttcttttttttttgtgagacaaagtctcactctgttgtccaagctggagtgcaatggcacaatatcagctcactgcaacctccacctcccaggttcaagcgattgtcctccctcagcctcctgagtagctgggactacagacacgcaccaccatgctcggctaatttttgtatttttagtagagatgggggttgcactatgttggccaggctggtctcgaactcctgacctcgtgatccactggcctcagcctctcaaagtgctgggattacaggcgtgagccatcacacctggcccttttaccatattttctttatgtttagactacagaaatgggcaattaggttgtttacagctttttactattacagacaatgctgcagtgaacataaggaaggtgtttgctagtgagatgatatgatgtgtttacttgggctgggtgtggtggctcacaactgtaatctcaacactttgggaggccaaagcaggggattgcttgaggccaggaatttggcaccagcctgggcaacatagtgagaccctgtctctacaaaaaacaaattaaccggatgtggtggcatgtgcctgtggtccctagaagtttgaggtcgctgtgagctgtgcttgtgcctctgcactccaacctggacaaccgggtgcgacctcatctctaaaaataaaaaatgatttgtttgtttttgcactgcagaattcacccttaggttaattaaataaaatatttgttctttggtaatatttatgcttcgagctgaataaagagaatggataatattattgcatcaattttagaccataatttcctaaacttcattctgttttcttccgtctcttcaaccattcaaacatatttattcattatctagccaggggttgaatactggcagccttgtatttctctttgcattgatggttaacatttttttgagccaacatttaaaaactagctgttttacataaagtctctattttctggttatcctgaaaaattaggagctctgtcaacaggcagcccacattttcccatgacagcagttaacctaagctgaattacagctgccttcttgaatttttttttccccctgctggagatggggtctcactctggtgctggggctggtctcagactcctgggctcaagtgatccccctgcctcggcctgccaaagttgtgggattgcagggatgagccaccgcgcccggctcccgctgcctgcctttagatgagcatacgctctccagtggaacaagttgctggtcctccttgttggtgtttattatcgcccttgtattgttcatggtggacagatacttctctattgatgatgtttctttcaaaaatgaaaaaaagtatagcttgacagctgtagttttcaagaaaagtagaaaagagcatatttttctggaaatgaagatttttttttttgagacggagtctcactctgttgcccaggctggagtgcagtggcgctgtctcggctcctgcaacctctgcctcccaggttcaagcgattctcctgtctcagcctcccgagtagctgggattagaggcgcccgccaccaggcccagctaatttttgtatttttagtggagacggggttttaccatgttggccaggctggtctcgaactcctgacctcgtgatccacccgcctaggcctcccaaagtgctgggattacaggcatgagccaccgcgcccggctgaaacgaagaatattttaatatatatatattttaagacagagtcctgctctgtcgcccatgctagagtgcagtggcacgatctcggctcactgtagcctttgcctcctgggttcaaacaattcttgtgcctcagcctcccaagtcgctgggattacgggcgtgtgctaccatgccctgctaatttttgtatttttagtagaggcagggtttcgccatgttggccatctggtcttgaactcctggcctcaaattatttgcccacctcagcttcccaaagtggtcagattactggcgtgagccactgtggctggccagtaattttgtttttaattgaactttgaaaacgcagttctatcattggtgttctatttctagccgactcagactttcacctggcaagttggtctctgtatttgatttgtaactccttatttaaagcaatttatgaggatgcataaaactacaaaatgcctcagataaaagtaaggagaaagaagaaacaaaaacaaaagataaagataaagtcaagtcaggatgtaggccaaaaaggtttattataattttcttcctacaggcagagcacagatttgactctgagctttctaggaaccagcaggagagaaaaacttggtagtttatttttttacagtgtccttaagatacaaaataactagatagttcagaaagataactaaccacttggcactatcaggctagagcagaagtgtccaatattttgacttccctgggccacattggaagaaaaagaattgtcttgggctacacataaaatacactaacgatagttgatgagcttaaaaaaagtcacaaaaaaaatgtcagtgttttaggaaagcttacgaatttgtgttgggccacattcaaagctgtcctgggccgtgggtagcacaagcttgggctagagtttctcatggggctctcataaagaggattatgttgtaattattattatcctcttcaacatctttaaggtagatggatgacaagtatttaagtagtcttagtgtgggagaccaatcacatcacatgagtcagtctgaaagagtggatagatttgtctttcagtgtctgatgagtggatgagtttccctcaacccagctttttaacctccttggcaggtacctccatacatcaagtacagaccattcatatgtaggatttaaattaccctgtgaaaatctaattttacccagaatagaatttgtgggagtgactgtacattaaaattcttgttagaaaataatttcaaatcttcttcatccttgtctgtcttcttctctgtaatttgaaggtgggtagagaatattcttccagaatatccaaaagtggtaaaaacattaagaaatatagaaaagggccaggcgcggtgactcatgcctataatctcagcactttgggagactgaggcaggcggatcatgaggtcaggagttcgagaccagcctgaccaatatggtgaaaccctatctctactaaaaatacaaaaattaaccgagcatggttgtgtgcgcctgtagtcccagctactcaggaggctgaggcaggagaatcgcttgaacctgggaggcagaggttgcagtgaaccgagatcacgccattgcactccagcctgggtgacagagcaagactccgtctcggggcaaaaaaaaaaaataaaaaaagaaagaaatacagaaaaggggtccaggacacagctgtgttttatattgctagaatttgcttcagcagaagacccgtgaatcaggactcatgctggttttcagcatagattaaatgtaaggagaggtttggtttttgtttgttttgagtcggagtctcgcttactttttcttttgaattttaaaaaagaagagtgagagtacgtctttactctctcagaacacagtaagttttgatcttagtttttactaggatgcctacagtagttgtttagaaacactaattaccatgagtttggtcgggacacaatgaacagtgtgtcaagggttgaggcaacatcagggcagataattacagtgtattgtgagaagtggtaaatacgtgtatgtatgaagtactatgaagtcacagaagaggtggttactctgtgttcgcttaattgtttggggtcaaaactagtgagaatggtaactaaacccgcaagttctgctgtttatgctagctgctgagaggcttgctaatgatgtttaaatatcattgatagctattaggttgaaccattattggcagtttttaatggtttaaccctagtagtatcttggtgtgacgatttaaaaggtattttattttttgccaatactgtttgacggttgttgaataattgatattttgttaaagctttgaatattgaataaatgtgccattttgggaaaatggcacttttttttttttttttgagactgagtctcatcgcccaggctggagtgcagtggcatgatctccactcactgcaacctccgcctcgtgggttcgagtgattctcctgcctcagtctcccaagtagctaggactacaggcgcgcaccaccacgcctggctaattttttgtattttttttagtagagacgaggttttgccatgttggccaggctggtctcaaactaccgacctcaggtgatctgcccgcctcagcctcccaaagtgctgggattaaaggtgtgagccaccatgcccggccgtatcttcccgacaatcttgtgaaatagatactactattaaaagtagctgtatcagataatttctagatgtaagagggttcgccaactatagctagcaagtcaaatcctgctgtttttattttgagaaggggactctgtcccccaagctggagtccagtggcctgaacacggcttctctgtagccttgacttcctaggctcaagcaatcctcctgccccagcctcctacgtagctgggatcacaagatgcgcaccactacgcctggctgtttttgattttttgtagaggtggggatctcacttttttgcccaggctggtctcagactcctgggctcaagtgatcctcctgcctcggcctccacaagtgctgagattactggtgtgagccagcatgcccggcctgccacctgattttgtaccataagcctaaaaatgtttgttgtttgttttttcaatttttagtggtcgaaaaatcaaaataaaatgttttgtaaaataattttataaaatccatttgataaattaataatttgtaaaaaaaaaaaaaaaaaaggtgaaattcaaattttagtgtccataaagttttgttggaacaaaaccatatctttttctttctttttttttcacattttcctttaaaattttgtttttgtttttgtttgcatccaaaactgaaagaaagaatgcaagctgtgggaggcaggccattgcatcaagtggtggctcctgggagtttgtgtggccccaccccccacccacccctggccacttcagcacagaggctgggaagggtctgggggccctggaagcagagccaaggtcccattttcttgcttgggcgaagctcagccggcagggccgtggcccccttcatagggggaggtggctgtcatgggggacaagggctgctgctctcctgtgctgagttccctctctggggcccgcagtgttggtggctgcagcggcagagccatggggaagctggccatgtagaagatgtggcccaggcgcctggccacctgggcctgggtcttgagggcaggccccagcttcaaccccgtggtggtcagcgggtgctcccccgtcagcagtggcagggtctccccttcgatcccctgctccctgaagacctgagtatactctccacagccagacagccgcccctccgcgaagctgcagacatcatccatggtccacttgctgacgtcctcaagggctggggcctcctccccatccacagagagtccccctgtggcgctgggccaggttctgcttctgcaggagctcctgatgccgggcgagcatctccactcgggcaggggcaggaatccgtagcctgggatctggcacagaggtgagggcactcccagaaaggggggcctgaaatgggggcccagggtgatgtgaggggcattctggggcgacagcaagagggggcggctgtggcagctccttgtcaacagtagcgcaatgagcggcctctttatatattatatattgtttatatattgggtttttttttttttttttttttgagacgtgggtctggctctgtcgcccagggtggagtgcagtgatgtgatcacagttcactgctgcagcctcaacctcccaggctcaagctatcctcccaccttagcctcctgagtagctgggaccgcaggtgtgtgccaccattcctggctaatttttaaatttgtggtagaatgaggtcttgctgttttgcccaggctgatctcaaactcctgagctcaagggatcctcatgcctcagcctcccaaagtgctggattagtgagccgtggcacttacctagccagtatattgtttattgttgctttcttactgcagtggcagaagagttgctacagaatctgaatggcccacaaaacctaaaatacttactatctttgcagagtttgctgacccctggtctagatacaaaggggagagaacataagatagaaagcagcaaacttaatatagatgcaaagaatgtgtctgtattacaacatcccaggaagactagatagttatataatgaacaaggcaactgtgttttcttcttgaaggatttttaaagacgacttttataaaagctctgttgcctaggcgggagtgcagtggtgtcatcatggctcaccaaagccttgaactcctgggctcaagtgatcctcccaccttagcctcctgagtagctaggactacaggcacatgccaccatgcatggctagattttataattttttcttttctttttttttagagatgagtcttgctgcgttgcccaggccggtgttaaacttctggcctcaagcaatcctcccacctcagcctccaaaggggcaaagattatagtgcaccaccattgcaggccaacattaaagtaaatttaaaggaaaaaagtgacccacaatcttgaaaatcatacgaaaacagtcaatgtttgtcctcacattccttcccactatttgtggcatatgcagttggccgtccatatccatgggttttgtactgtggattcaaccaactccagattgaaactattcagacaaaatgatagttgtgtcagtactgaacatgcagttttcctgtcattattccctgaacaatacaatataacaactatttacatagcttttatttttttaggtattctaagtaatctagagatgatttaaagtatatgagagtatatgtgtaggttatatgcaaatactaagccattttatataagggattcgagcattgttttattggtatccggggggtcctggaatgactgtacatgtgtataatatacaacaactgatatcagatagaaagtacaaggaaaaagcgatttatgacaaaatctaaagtcataattcagtttctttagaacctttaggtgttcaaaatggcttcatttcgaagacaaaagtaggaaactttctttctttcttttttttgagatggagtctcactgtgtcgcccagcctggagtgcagtggcacaatcttggctcactgcaacctctgccgcccgggttcaagcgattctcctgccttagcctcccgagtagctgagactgcaggggcctgccaccgcgcctggctaatttttctatttttagtagagacagggtttcaccatcttggccaggctggtcttgaactcctgacctcatgatccccctgccttggcctcccaaaatgctgggattacaggcgtgagccaccgcgcccagcctgaaactttctctttttagaggggcagtgaagaagtagtctttgagcacccatcaacaaatgaacacatctgggatgaagattgtacctaacatgtttgatcagtctggtgtggcaataaggatgcacccaggaggtgataaggaaatccaggaggtgataaggtagacagactgagaaagaagacacaaggagagaaaagtaaagagaggaaagatgagcattaatgagggtgcttacaagcggcagaggcagtgaatacaaaaacttagtggaaagaaagcaacgacgaaacaagaataggatgagttctcagttacctactttattcttcaaatagcccttattcagcacatctttcttgtttgttgtagaatggagagcagtttattacatttgataatccttgaaagcattaatttgcttggagggtacccagggagtagagttcaagcagtatgaagagtgaagaatattcattctggtagagtttagtgacagactaagcttatattaataacggttctatattatagaagaatactactgctggagtatggcagtatattaggtttctccagagaagcaaggccaatagggtgtgtgtgtgtagagattgactggttgattgatgtttgaggaattggctcatgctattgtgaaggcttgcaagttcaaaatctgtagggtaggctgacaggccggggacctggggaagaggtgatgttgcatctcaagtccaaacgcagtcttttggcagaattctatcttacttgggaaatcagtcttttctttttctcttaaggtcttcaactgatagaataaggcccgcccacattataaagataattgactttactctgagtctgctgacttaaatgttaattgtatctgaagaaatatcttcacagcaacatctaaactattgtttgatcaaatatactgggcctagccaagttggaatgtaaaattaaccatcacaagactgtaatagaaaccatctcataatgtacatttgggacttatggtgaaaggcaaagggcagaccgggtgcagtggctcacgcctgtaatcccagcactttgggaggccgaggcgaacagatcacgaggtcaagagatcgagaccatcctggctaacacggtgaaaccccgtctctactaaaaataccaaaaaaaaaaaaaaattagccggacctggtggcgagcgtctgtagtcccagctactcgggaggctgaggcaggagaatggtgtgaacccgggaggcagaggttgcagtgagccgagatcgcaccactgcactccagcctgggcgacagaacgagactccgtctcaaaaaaaaatgattgctcttaataagaaaaaaacagacatccagatatgacttatattgtgttacttaaatctaagtctgattgatttcaaagccccaaaactatttctactttatttcttcagatttaaagctgtggaccaactatttgcagcacttgcctttaatactggagttagtagatttgaggtcagtaggaatgcttctcagtgaaaaaagtggtagcttaatctttggctcaaggctaatcgtaaaataggaaacattttcctatgtaaattttggatgggtaacttaaatcttgcaaaatgaatgaagtatagtggttagctgtaactaatagaaaagcgaggagatggtgaagctgtaaaagaattttacaactttttcagtgaaccatacctgagcacagtccatccctcagtgattttaccatactgataaaccaacctgatctctttttttgtttttattacctgctgacagcagatgctagtgaatcatagatgggcctccaagctgaagcagaataagaagtagacgtgttaaagtctcagtgtttgaggccaggcatggtggctcacgcctgtaatcccagcactttgggaggctgaggcaggcagatcacttgaggtgaggagtttgagaccagcacagacaacatggtgaaaccccctgtctctactaaaaatgcagcatttagccaggtgtggcggtgggtgtctgtaatcccagctactcgggaggctgaggcaggagaattgcttgaacctgggaggtgaaggttgtagggagggagtggagattgcgccattgcactccagcctgggcaacagagcgagactcagtcccgcatcaaaaaacgtctcggtattggattaaaaacttgcatttaggccgggtgcggtggctcacgcctgtaatcccagcactttgggaggccgaggtgggtggatcacgaggtcatgagctcgagagcagcctgcccaacatggtgaaatcttgcctccactaaaaatacaaaaaattagctgggcgtggtggtgggcacctgtaatcccagctattcgggaagctgagtcaggagaatcgcttgaacctgggagatgcgaggttgcagtgagccgagattgcgccactacactccagcctgagcgacagagcaagactctgtctcaaacaaaccaaactttcatttatcatttgtaatagtgtgaatgggaaaagtctaaattctctcatatcttcagttattcatacagagcacacgatacttcaagaacatgaagttaatcttttgataaattttgccaccttttaatcagaaaacaattttaaaactctagaaatttacctctctgggtaagaaaggaaataaaaagattgatctaaggaaatgaagttactcttacggagtattttgtccttctatgtaatctcatggatttagctaaagactggagtctttttcagatacgtgatgcaatgattttataggaaaatttacttttttaaaagaaattatttgactgcattatagtatagtgttaatgatggagttttatttatttatgttatttttttatttattttgagacagagtttcgctcttgttgcccaggctggagtgcagtggcgtgatctcggctcactgcatcctccacctcctgggttcaagtgattctcctgcttgggcctcacgagtagctgggattacaggtactcgctcacttgggaggccgaggtaggagaatcacttgaacccgggaggtggaggttgcagtgaggcaggagaatcacttgaacccaggaggtggagactgcagtgagccgagattgtaccattgcactctaggctgggcaatggagtgagactccgtctcaaaaaaaaaaaaaaaaaaaaaaattcagagcaacagtcatataacactcccacaagagataattcttcacgatgttaaacgagaactgtcaaaagtaagccaatttcagggacttttataagaaagcatgtctcaagttcattgttttagctggggttttttgtttgcttgttttgttttttgttattttgttatttttctttatttatttttgagacagggtctcactgtgtctcctaggctttcgtgtagcggcgtaatcaccgcagctcactgtagactccaactcctgggcttaggtgatcctcccacttcagcctctgggtagctgggacctaagtatgtaccaaccaccacacccggctaattaaaaaaaattattttgtagagatggggtttcactagctgggactacaagcatgtgccaccatgcctggctaattaaaaaaaatttttttggtagagactgggtttcactgtgttgcccaggctggtcttgaactctttagctcagtctgcccacctcaccctcccaaagtgctgggtttacaggtgtgagccactgtgcctggcccttacctgttttttttttgttttttttcctctcaggagatgttcctgaattacctggggtcttgacttaaagttcagaactaattgtaataggtaacatatggtacttcttagtttataaaatttgtttacattaatatcctgcctattcctcactgaatcttttaaggtgaatttcacatttaagtctattatacaattgaggaaactcaggcttaatgaggaaactggggtttagggagactttgtgaacatcaaacttttcttttaatggcagagtctccctctttcacccatgctggagtaccgtggtttgatcgtagctcactgtaacctcaaattcctgggcccagatattctcctgcttcagtctcctatgtagctaggaccacaggcatgcaccactatgcttggctaattattatttttttattattattctttgtggagatgtggtcttgctgtgttgcccagcctggttttgaactcctggattgaagcaatcctctggccctggcctctttgtaatatgcccccacaaatatgccccagccccatattttcataaatgctacttgataaattctacctgatttttagtatattcagaagaaagtgcgtaatctcttattttgattaaattttgttccttgtagcttagaactttaggtgagattccccaagcatttggtgagttgattgtctaagcctaaagtaaggtaatgttgctttatgctgcattcagaacattcttgtaactgtaacattcaccttagaatggaaatgtacagattgtttataaacatcagattcctatctaattctctttactttttgtgactttgttgtaacttaactcagtatcttataatattttggtttgattcttttttgattatctaaaaaatagattattaggtaggaacattaagacttaaaagtgaataaacaagttttatgtctcttttctgttggatgctggttgtctgtgctgtttaagtttttgtctggttttaaaaagcttgtagaaccagcataactaagaaagtagcgtggccgggcgccgttgctcatgcctgtaatcccagcactttgggaggccgaggtcggtagatcacaaggtcaagagattgataccatcctggccaacatggtaaaaccccgtctctactaaaaatacaaaaattagctgggtatggtggcgcgtacctgtaatcctagctactcgggaggctgaggtaggagaatcacttgaacctgggaggcagaggttgcggtgagccgagatcacaccattgcactccagcctgggtgacaagagcaaaactctgtctcaaaaaaaaagttgcttttacttttctaactgaaattcagattttaattcactaaattgtaggcaaaacatctttaattctttaccagcttttttaaaaaatagattttttcctttaatagattgtgtacaaaactaaagataattgaataaaatggcaaaaattgttgaaaacaagagtatatctgtgatatgaatagtcatacatattaataaaaatcttctgtctcataaatgaatttgaaaaaatgctgttattttgaaactaccttttttttttaagttgaggtgtatatgtgcaggtttgttacataggttaagcctagtacccattcgttatttttgctgattctctccctcctaccatccttcaccctccgaaaggccccagtgtgtgtggtttccctctatgtgtccacatgttctcatcatttagctcccgcttgtaagtgagaacatgcgctatttggctttgcaatcctgtgttagtttgttaaggataatggcctccagttccatccatgtggaattactattctaaacatctggtaacttgcaaggtgtcatggaacccagcttatcaggaaacattgcttaacagattcttgaaagcaactggcctgaaaagatacttagttcttgactgagaataacttctgccttgcttcattgctgcatctggaaaatatttggattaagagccataatatataatacgtgctattcaagcatggtagataatctgtcttttttttttttttttttttttttttttttttttttgagacagggtcaccctctgttgcccaggctggagtgcagtggcgtcatctcagctcactgcaacctctgcatcccaggtgttgccctcccacctcagccttctgagtagctgagactacaggcgtgcgccactatgtccagctgatttttgtattttttagtagagatggggtgtatgtattcgttcgttttcacgttgctgataaaggcataaccgaaactgggaacaaaaagaggtttaattggacttacagttccacatggctggggaggcttcagaatcatggcaggaggcgaaaggcacctattacattgtggtggcaagagaaaaatgaggaagaagcaaaaccagaaacaagataatcccatccgatctcgtgagacttattcactatcacgagaatagcatgggaaagaccagcctccatgattcagttacctccccctgggtctctcctgcaacacgtgggaattctgagagctacagtgcaagttgagatttgggtgaggacacagccaaaccatatcattccacccctggtccctccatatctcatgtcctccctttcaaaaccaatcttgccttcccagcagtcctgcaaagtcttaactcatttcagcattaacccaaaagtccacagtccaaagtcttatttgagacaaggcaagtcccttctgcctatgagcctgtaaaatgaaaagcaaactagttacttcctagatacaatgggggtataggtattgggtaaatgcagccattccaaatgggagaaattggctaaaacaaaggggttacagggcccatgcaagtccagaatccagcgggacagtcaaattttaaagctccaaaataatctcctttgactccaggtctcagatccaggtcacgctgatgcaagaggtgggttcccatggtcttgggcagctctgctcctgcggctttgcagggtacggcctccctcctgtctgctttcaccggctggccttgagtgtctgcagcttttccaggcgacagtgcaagctgtcggtggatctaccattctggggtctggaagacagtggccctcttctcacagctgggactcacagtagggactcgtatggggggctctgaccccacatttcccttcagcactgccttagcagaggttctccatgagggccctgtccctgcagcaaacttttgcctgggcatctggacgtttccatacatcttctgaaatcaagttggaggttcccaaacctcaattcttgacttctgtgaacccacttgctcaacaccacgtggaagctgccaaggcttggggcttccaccctctgaagccacagcctgagctgtacgtcagcccctttcagccacagctggagtggctgggacacagggtaccaagtccctaggctgcacacagcatggggaccctgggcccagctcatgaaaccacttttttctcctgggcctccaggcctgtgatgggaggggctgctgccaggaagttctctgacatggactggagacattttctccatagtcttggggattaacattaggctccttgcttcttatgcagatttctgcagccagcttgaatttctccccagaaaatgggtttttcctttcttttttttttttttttttttttccctgagagggagtctcactctgtcgcccgggctggagtgcagtggcatgatcttggctccgcctcctggattcatgccattctcttgactcagcctcccgagtagctgggactacaggtgaccaccaccacacccggctaattttttgtatttttagtagagacagggtttcagcatgttagccaggatggtctcaatctcctgaccttgtgatctacccgccttggcctcccaaagtcctgggattacaggcgtgagccactgcgtctggccaaaaaatgttgtttttttttctatcatatagtcaggctgcaaattttctaaactttcatgctctacttccccgttttttttttttttaaagatggagtcttgctctgtcgcccaggctggactgcagtggtgcgatctctgctcactgaaacctccacctcctgggttgaagtgattctcctgcctcagcctccaggtagctgggatcccagccacagtagctgggattagccaccactcctggctaatttttgtgtttttagtagagatggggtttcaccatgttggccaggctggtctcgaaactgctgacttcagaggatccgcccaccttggcgtcccaaaatgctaggattacaggcgtgagccactgcccctggttgctctgcttccctttgaaaacgaaatacttttcaaacacccaggtcaccttttggatgctttactgcttagaaatttcttttgccagataccctaaatcatctttctcaagttcaaagttccacaaatctctagggcaggggcaaaatgctgccagtctctttgctaaaacataataagagtcacctttgctccagttcccaacgaactcctcatttccatctgagaccacctcagcctggaccttattgttcatatcaccatcagcatttttgtaaaagtcattcaacaagtctctaggagattctaaactttcccaggttttcctgtcttctgagccctccaaactgttccaaactctgcctgttacccacttccaaagtcacttcctcatttccgggtatcttttcagcaattccgcgttctactgttaccagtttactgtattagttcgttttcttgctgctgatacagacatacccgaaactgggaacaagaaaaggtttaattggacttgtagttccacatggctggggaggcctcagaatcatgataggaagtgaaaggcacttcttacatgtcaggggcaagagaaaaatgaggaagaagcaaaaatggaaacccctgataaacctgtcagatcttgtgagacttactatcgcaacaatagcacaggaaagactggccccgtgattcagttacctcccgctgggtcccttccgtaacacatgggaattctgggagatacaagtcaagttgagatttctgtggggacgcagccaaaccatatcacctggtttctctgtgttgcccaggctagtcttgaactcctgggctcaagcgatctgcatgcctcggtccatcaaaatattggaattacaggcttgagccactgtgcccggcctctgctgaccttttaaataaagctttggcaagtgacagtttgaggttaggaaccattgataattgatgaattaccggataagtctttatttcttccttctacatctgataataaatccgatgatttccattttcatgtcattgcgcctctactgttaacatataattatttatactttctatttttttttttttaactcttccactttctctttttgtggtggggtacttaccctagcaataaacacattgttgtcttagatgctgcattggatagcagatacgtggatatagtattagactagagaatgcttaagaattctgcattccaaaagcatactaaagcctctgtttctagtgcttaagcaacagtgtccttgatatcagtctaagaaagtctggatattgacatgcaaatgaaaaaatcagactctttgaattttgtttgtcatatatgcaagtagcttaaaagaatattggaatactgccaaaatacatttcaaaaatattaaatcttcttattcgttattttgactttggaaagatttgtgaacccccttaaaatacatgcaatattttgtttattttcatatgtgcttctttgagaggaaagatcttagctttcattatattctcaaaggagtccagtaacctcaaaaaaggttaagaacttctataccaggtagtatgaaaatattgcctgatttatttgtactgttggttaatgtagattgttcgttgcaaaatattctaaactctttctttaaaaaatgtttactccatttaagaaccatttattagaggctgggcatggaggctctttcctgtaatctcagcactttgggtggccgaggtgacagaatcgcttgagcccaggaattaaagaccagcctaggcaacatagcgggaccccgtctctagcggaggttgggggtaaaaagaaaaaattagctaggcatggtggcatgcatctgttgtcccagctactcaggaggctaaggtaggaggatctcttgagcctaggagttagaggctgcagtgagctatgatcgatcatgccattgctctctagcctgagtgacagagtgaggaccctgtctcaagaaaaacagaaaaacgttaataaaagccaggcgtggtggctcatgcctgtaattccagcactttgggaggccaaggcaggtggatcacttgaggtcaggagttgggaaccagcctgaccaacatggtgaaaccctgtctctactaaaaatacaaaaaaatttagctaggcatagtggtatgcacctgtaataccagctactcgggaggctgaggcaaaacaatcgcttgaacccaggaggcagaggttgcagtaagccgagatcacgccactgcactccagcctgggcgacagtgagactccgtctcaaaaaaaaaaaaaattatttctgttttcatgtggtattttgcgattatgtgttaaccattaaaaggcaactggaaaggtaaaattgtattcttaaaataagtatgataactcaatcatatacttgtgctttctgatagcaaaaatacatgttaaaggttggaaaggttaaagttagaaaattcacaggctgaaataatctgagttaaagggtgccttagatgttagctactatgtagaaaatttagattaattactcaggttatagagttgatgacaaacttgaaccggcatcacctttcttccccccccccccccccccgaggcggagtcttgttctgtcgcccagagctggagtgcagtggcgcgatcttggctcactgcaacctctgactccctggttcaagcaattcaactgcctcagcctcccaagtagctgggattacatgcgcgtgccaccaagcccggctaatttttgtatttttagtagagatagggtttcaccatattggccaggctggtcttgaagtccagatcttgtgatctgcccgcatcgacctcccagagtgctgggattacagtcgtgagccaccccgcctgggtgcaattttttatatgtttgttggccatttgtatatcttcttttgagaattgtctcttcatgtccttagccaactttttgatgggattgtttgttttttcttactgacttgtttgagttcattgtagattctggatatcagtcctttgtcagatgtatagattgtgaagattttctcccaccctgtgggttgtctgtttactctgctgattgttccttttgccatccaaaagctcttcagtttaattaggtcccagctatttatctttgtttttattgcatttgcttttgggttcttggtcatgagatccttgcctaagccaatgtctagaagggtttttccagtgttaccttctagaatttttagtttcaggtcttaggtttaagtccttaattcatcctgagttgatttttgtataaggtgagagatgaggatccagtttcattttcctgtatgtggctagccagttatctcagcactatttattgaaaagggtgtcctttccctactttatgtgtttgtttgctttgttgaagatcagttggctgtaagtatttgggtttatttctgggttctccattctgttccattggtctatgtgcctattttttaccagtgccacgctgttttggtgactatggccttatagtatagtttgaaagcagatagtgtgatgcctccagatttgttctttttgcttagtcttactttggctatgcagtctcttttttggttccacataaattttagaatcattttttgtaattctatgaagaatgatggtattttgatggggattgtgttgaatttgtagattgcttttggcagtatggtcattttcacaatattctacccatccatgagcatgggatgtgtttccatttgtttgtgtcatctctgatttcttttggcaacattttatagttttccttgtagatgtctttcaactccttggttaggtatattcctaagtattttatttgtggctattgtaaaaggggttgagttcttgatttgatcctctgcttagttgctcttggtgtatagaagagctactgatttgtgtacattaatcttgaatccagaaactttgccgaattcttttatcagttctaggagctatctgaggagtctttagggttttcaaggtaaacgatcatatcgtcagcaaacagtgacagtttgacttcctctttactgacttggatgccctttatttctttctcttgtctgattgctctggctaggacttccagtactatgttgaagaggagcggtgagagtgggcatccttgtcttgttcgagttctcagagggaatgctttcaacttttcccctttcattattatgttggctgtgggtttgtcatagttggcttttattatgttatttcccttgtatgctgattttgcagagagttttaattataaagggattctggattttgttgaacgctttttctacatctattgagatgatcatgtggtttttgtttttaattctgtatgtattgtatcacatttattgacctgcatatattaaaccatccctgcatccctaatatgaaacctacttgatcatggtggatcaacacatctttttgatatgttgttggatttggttagctagtatttttttaaggattttagcatctatgttcattaaggatattggtctgtagttttctttttttggttgtttggttgtagtttcctttcctggttttggtattagggtgatgctggcttcataaaatgaattagggagggctccttctttctctgtcttgtggaatattatcaaaagaattggtaccaactcttctttgaatgtctgatagaattctgctgtgaatccgtctggtcctggacctttttttgttggtaatttcttaattaccgtttcagtgtcactgcttgttattggtctgttcagcgtatctaattcttcctgatttatgtgaggagggttgtgtttttccaagaatttatccatctcttttaggttttctcatttatgtgtgtaaaggtgctcacagtagccttgaatgatcttttgtatttctgtggtgtcagttgtaatatctcctgtttcatttcttagtgaggttatttggattttctctctgctttccttggttaatcttgctaatggtctatcaattttgttttatcttttcaaagaaccagcttgtttcatttatcttttgtactgtgtttttttgtttgtttgtttcaatttcatttagttctgctctgatcttggttatttattttcttctgctgggtttgggtttggtttgttcctctttctctagttccttgaggtgtgaccttagattgtctgtgctctttcagactttttgatgtaggcgtttagggctatgaactttcctcttagcactgcgtttgctgtatcccagaggttttgatagggtgtgtcattattgtcattcagttcaaagaattttttaatttccatcttgatttcatttttgacccagtgctcattcaggaacaggttatttaatttccatgtatttgcatggttttgaaggttcattttggagtttattttcagttttattccatcgtggtctgagagagtgcttgatataatttcaattttcttaaatttattgatgctcgttttgtggtctgctttggagaaagttccatgggctgttgaatagaatgtgtattctgtggttattggatgagatgttctgtgtatatctgttaagtccatttgttccagggtatagtttaaatccgttgttcctttgttgactttctgtcttgatgacctgtctagtgctgtcagtggagtattgaagtcccccactattattgtgttgctgtctgtctcatttcttaggtctattagtaattgttttataaatttgggcactccagtgttagatgcatatatgtttaggattgtggtattttcctgttggacaaggccttttactattatataacgtccctctttttctcttttaaccgctgttgctttaaaatttgttttgtctgatatgagaatagctgcccctgcttgcttttggtgtccatttgcatgaaatgcccttttccacccctttactttaaatttatgtgagtccttatgctttaggtgagtctcctgaacaggaggctgcagatggttggtgagttcttactcagtctgcagttctgcatcttttaagtggagtatttagtccatttccattcaatgttagtattgaaatgtgaggtaccgcggcattcatcatgctctttgttgcctgtgtactttgggtttttttgttttttgcttttgctttttaacttgaatttttgttttgtaggtcctatgtgatttatgctttaaagaggttctgttttgatgtgtttcaaggatttgtttcaagatttagagctccgtttagcagttcttgtaatggtggcttggtaatggtgaattctctcagcatttgtttgtctgaaaatgactgtagctttccttcatacacgatgcttggtttcactggatataaaattcttggctgataattgttttgtttgaggaggccgaagataaggccctaatcccttctagcttgtagggtttttgctgagaaatctgctgttaaactgataggttttcctttataggttacctggtgcttctgtctcacagctcttaagattctttcctttgtcttaactttggataacctgatgacagtgtgcctagtgaagatctttttgcagtgactttcccaggtgttctttgtgcttcttgtatttgaatgtctaggtctctagcagggccgggggagtttcctcagttattctcccaaatatgttttccacgcttttagagttctcttcttcctcaggaacactgattattcttaggtttggtcgtttaagataatcccagacgtcttggaagctttgttcatattttcttattcttttttctttgtctttgttgggttgggttactgtcttcaagctggtaattgaaaatagacatgatttaaatatctagccataaaagattgttaaaaatagtacatccacatgatcaaatatcattcagtcattaaaaattatgacaaggctgggcgcggtggcccacgcctgcaatcccagcactttgggaggctgaggtggtggatcacctgaggtcatgagtttgagaccagcctgaccaacatggtgaaaccttgtctctactaaaaatacaaaaattagccaggcgtggtggcgtgtgcttgtaatcccagctactcaggaggctgaggcaggggaatcactagaacccgggaggcagaggctgcagtgagccaaggttggaccactgcacttcagcctgggcgacagagcaagatgctctgtctcaaaaaaaaaaagaaagaaaaagaaagaaaggaaacttggcccaggctatctgcctcccagcggtgaaagaaaagggctttagttcttccgtagtctgtgaagtctgcatgccggattcgcaccctcccctgagttctggccaggaggcttcccaccccattcagatggttacaaaatttggctagagaattccttctccctgtggggttttaccccctccttctctgtccaccctccctgtggtgccaggcaagaatgggctgcttggggatccagtgagctcccggggcctttctgctgcatcctctatccctgcattttgcgtggctctctaagttagtctgaaacttcgactgcaaacggaccttcagcttctctagtgggggtgtgtgctcaggagaggagggtcttcctttctcacttctgcagttgggacactcacagtatttggggtgtctcccgggtcctgcaggagcaatccgcttccttcagagggtctgtggatcctcttggggttgctggtttgttcttgcagtggatctggagctaaaattcacagtgcaagcctctgcatgcagctctgtccgaagctgcaatctagtcctgcttcctgtctgccatgatcctttaattcctctccttctgattttttaaaaaatgttttattatggaaaatgtcagacccttccacaaagttagagtagtgtaatgaaccattatgtacccattacccagcctcaacagttagcaattcaaagcctgtcttgtttcatgtatctctcttattcactgtcattacccaagtcacagacatgatattattttacttcgatttgatgtagctttttcattgtttattttctttttgtagagatggggtcttgctgtgttgctcaggctggtcttgaactcctggcctcaaacaatcctcctgccttggcctcccgaagtcttgggatttcaggcgtgagcctccacactcagcctcattgtgtatttctgaaagatttttaaaaatagccacaatactgttatcacttcaaaaaaattcagttatttagtattaccagatgtccagccagtgttcaaattttcccaagtttgttcattggtttattttacaatttgtctaactctagatctaaattaagtctataaattgctattggttgatatgttacttgtctcacttaatccagaggtttccctttctatctcttttttcttcccttggtatttattgaagaaactgggtcatttgttttataggacttttcacagtctagattttgttgattgtatccccatggtgttctttaacgtacagttggccctctgtatctgtgggttctgcatctgtgaattcaatcccggatagaaaatattagaaaaaaatatgtctgtactgaatatatacagacttttattcttgtcattctcttaataatacattataacaactatttacataatatttacattgtattgagtattatatgtaatccagagatgatttatattataggggaagatatgcataggttatatgtaaatcctacaccattttttatcagggatatgagcaacctcggataccaaaatcctggaggtcctagaaccattgccccatggatactgaggtgcacactgtattcatctgccctctgtacttcttgcagattggtagttggagccagaggcttgattcatgtttgatttttgtggcaagaatacttcttgggtggtagttgttattccatcactacaccaatataaactgtagttatatagatatataactataatcatacccctggtctggttgtctttttgttgtttcactaggctttggttaattctttcttcatttctcctgtggtctttttctccaccatcaagatttatttttttctttttctttttctttcttttcttttttttttttggagctggagttttgctctgttgccagggcagtgcagtgatgcaatctcagctcactgcaacctccgtctcctgggttccagcacttctcctccctcagcctcccgagtagctgggattacaggtgcctgctgccacaaccagctaatttttgtatttttagtagagatggggtttcgccatgttggtcaggctggactcaaactcctgacctcaggtaatccacctgcctcagcctcccaaagtgctgggattacaggtgtgagccactgtgcccagccaggatttctttttttttttttaatttgtaaggcatcatacctagactatcaggatttaagtatctaatttggctgggggaagaaagagaaaaactgcttttcaatattttcatctacttttaaaatatttgtttatggtaccatctctgcttcatctctttcctcatttaaatatttctgccatgtgaaaccattttactgaaaccattctcatcaaggttatcaacgaactccttgctgagtacaacagacccatccaaccttactttgcttgatagttggacaggtttggatactgttgattgcttccttgaaatactttcttggcttttgagacatactctctcctctttttcttttacctcttgaactgttactttcagcctcagttgtaggctctttttaatataggtgttgctctgcacagtctccatgggtaatcttaccatctgctgtggtttcagaaaacatttctaaataaaaagtaccaaaccttttttttttttttttttttttaataggttggttcgcttcagaactaacttgtttgttacagtttggtactggagatttcacaggcatcttagaatcaacatacgtaaaatggagttaatcatactttcctcatcccctcacacattctagtttcctgttcaatttagtttagtttttttgtttgtttttttgagacggagtcttgctctgttgcccaccctggagtgcaatggctcaatttcagctcaactgcaacctccgcctcccaggttcaagcgattctcctgcctcagcctctcaagtagctggattacaggtgctcgccaccatgcccagctaattttttgtatttttagtagagacggggttttgccatgttggccaggctggtcttgaactcctgacctcaggtgatccacccaccttggcctcccaaagtcctgagattacaggcatgagccaccgcgcccagtctcaacttggttgtaagccagaaatcacttgactccttgactgactttctccctttctggctgtccacattgagtcactagtcctgtaagatatacccagtaaacaacttaaatgcatctcattttttttatttactcctgttgtcctaatgtagacctctgtcatctgtaaccttcattactgtaagcttcctttctgatctattcttcactatgtaagtgagtgatttttttttttcctaaaatcttatctaatggctccctattggccctgggataaattataaagacctgagtttattttgtggcctgtttgcttgctcagcttcgtcctgagtcatcacccgcaggtggcaatacttgtcacattattcacgctgttttaattgccttcttggccgatgcttccagtagactgtaacttcttgaatgtaaagaccaagtccagccaggtgtggtggctcaagcctgtaatccgagcactttggagaccaaggccggcggatcacttgaagtcaggagtttgagaccagcctggccaacatggtgaaaccccgtctttactaaaaatacaaaaagtagccaggcatggtcgtgggtgcctgtaatcccagctactcaggaggctgaggcaggagaatcactagaagctgggaggcagaggttgcagtgagctgagattgtgccagtgccctcctgggcaacaagagtgaaactctgtctcaaaaaaaaaaaaaaagaccaagtcattttccccattaaacatgttatttaagacaatacgtagcacataatataaattaagtgttctttatatgtttgttgaatgaataaatttgttcagtacaccaatatatttaatgatttatgtatgtgttttatcattattagataatcctactgtgccagtactgtcatcattctttcttttatttttatttcttaagagacagagtttctctctggcgcccagcctggagtatagtgccacaatcatggttcactgcagccttgacctcctgggctcaagcaaccctcctgcctctgccgcctgagtagctgggactgactataggtgtgtgccaccatgccctgccaattttttttacttgtagagacagggtctcgctttgtttcccaggctggtctcaaactcctgggctcaagcaatccttccacctcagcctcccaaagtgttgggattacaggcatgagccaccatgtactacactgtcattattcttgtacattcatttgcttttttggctagcagagatatgtttataattaaattggactctgtaatatacataatatagtgggggtttttttctgattaaagcagggagttttgccctacctcgttttcactctatataattgagccaggcatggtggctcatgcttgtaatcctaggactttgggaggccaagccaggaggattgcttcagttcagaaatttgagaccagcctgggcaacgtggcaaaaccctgtctctacaaaaatagaaaaatacaaaaaaaaaaaaaaaaaaaattagctggggttggtggcacatgcctgtattcttagctactcaagaggctgagcccagcttggttgaggctgcaatgaaccatgattatgctgccactgtacgccagcctggacaacaaaataagaccccatctcaaaaaagaaacagtatgaagaaaagtgagacttgaataattgggagttgttaagtaccaaagaagtatggtttactggcttgtctgttgtgtttggttccagttccactagttcttactgattccaaccatatttctcagaatttagatggagtgatagtgatggctttcagctatcatttgtagttagctgggctccaggtcagaagaatccttaaggattataaaataaattcctgcttatatttactagaattgttcttcagataaggatctctaatgaaatagcagttgccatagcgagcacctgagctgtcactttttcactcagggctcatgttcgtttttcgtttgtttgtttttgagacggactcttcctctgttgcccagactggagtacagtagcatgttggctcactgcaacctctgtctcccaggttcaagcaatttctcgcaaatttttgtatttttagtagagacgagatttcaccgtgttggccaggctggtcgcaaactcctcacctcaagtggtctgcccacctcagcctcccaaagtgctaggtttgcagacataagccaccacgcctggcctcagggctcatatttgaaacccgaaggtatgcatttttttttcctttaaaagaaattgggtctcgctttgtcacctaggctggagtgcaatggcatgatcgtagctttccataaccttgaactcttgggtagcaagcattcctcctgccttagcttctcaagtaagcatgcaccatcacacctacctaatttttaaaattttctgtagagacggggtctcctgtgtttcccaggctggtcttgaactcctgggctcaagtgatcctcttgccttaacctcccaaagtactaggattaattacatatgtgagccaccacaccccgcctctcattcttctttcttcactggcttattcattactgtattctcagtgcctggagcagtgactggaatggcatttgaaaggtactcaggaaatggtccttaactcttctgtccatgataggtttctagattggttgtcccacaggatcttcattatatgttaatttcatatcatttggaggatgatttttttattgctttgaattgcctcttccaatcaaattttatatataccagtagcctctattttaagtaagaccatctcaaatacatttcttaattaggtacattggttaagagagcataagattccagcactttgggagactgaggcaggaggatcccatgaatacaggagtttgagaccagcaatgtagggagacctgtctctacaaaaaaaaaatttaagaattagctgggcatggtggtgtgtgcctgtcgtcccagctgcttgggaagctgaggtgggaggatcgcttaagcccagagggggaaggctgcaataagctgtgatcatgccactgcactccaacctgtgtgagaacctgtctccaaaaaaacaataaaaagcgtaagattgctaagtagtgtatgttataaataccggccattctaaggttattggtgactaacactcaaccttgaaggttacttcagttatagttggcactgttcggcttgtgcagttcatgaaacccttatctgttttaccttttataccttttttgtaaatttgaaattttactttttgtctctaagagagaattacattcgtttagagttacatgttaatatttgaaatcaaatgtatctggcaggttaacatgattgggagtgggtaaatgtatgttaaatttaaaagtaatgctgttttggctcattgaattattaatttaaaagacaaaacagtatggtttttgacattagttgactttcactataagtggaaaatcatcatctaatatttatactaacatcacaataaaatttatctttgaaaatgagtactgtaactaataatttagaaataaattttaagtgaaataatctttttttttcttctctttctccttaggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactgtaagtttctttgttttgtgctttaaaaaaaatctccctcatgagagagaaagtagtaaattaaaatacagctttgggaggtctcttctaagattaaaactatttttaccagtgttccaatattagtttaggcagtttggtctgattttaaaacagtcttattatgatatagcattatttttaaaatttatttattctttctgagaaggagtttttcgcttttgtcacccaggctggagtgcaatggcgccatctcggctcacttcaacctccgcctcccaggttcaagctattcttctgcctcagcctcccaagtagctgggattacaggcacccgctaccatgcctagctaatttttgtatttttagtagagatgggctttcaccatcttgtccaggctggtctcgaactcctgacctcaagtgatccactcacctcggcctcccaaagtgctgggattacaggcatgagccactttgcccggccgtgatacagcattattcacccttgtgacttgactgtatgtaagtttaacgcaaaacagacaagtcagttgggatgagttttaccctaagcttatttttatttttatttttgagatggactctcgttctgtcacccaggctggagtgcagtggcgcaatctcggctcactgcaagctctgcctcctgggttcacgccattcttctgcctcaacctcccgagtagctgagactacaggtgaccgtcaacacgcctggctaagttttgtatttttagtagagatggggtttcaccgtgttagccaggatggtctcaatctcctgacctcgtgatccgcctgcctcggcctcccaaagtgctgggattacaggcgtgagccaccgcgcctggcccctaagcttatcttttaaaatattatgttcaataggaagttaggtgcttcatagctcctctaaacctttttttggtgtggaatctgtgcattagaaaaatgaaagctgttttgttcttgttatcactgatgtctttcctttgccttgttgtgtttcttttatcttccaatggccattacagaatttgaagaatttgaactttatgaggtagctaataaaataattaatgcagatgctttaatgagagaggtgtgaaatggtttgacctcttctgttttagagtattttatagcattccatttttataggtgaagaacatagggggattttccactcccccgcttcacctgactagctttaaaaacataaaaacaaaacgggaaaatgtagctttatgttctacttctttttttttttgagatggagtcttgctctgtcgcccaggctggagtgcagtggtgcaatctcggctcactgcaacctccgcttccagggttcaaccaattctcttgcctcagcctcccaagtagctgggattacaggcgcctgccactgcgcccagctaatttttgtatttttagtagagaaaagggtttcaccatctttgccaggctggtctctaactcctgacttcgtgatcctcctgctttggcctcccaaagtgctgggattacaggcatgagtatgttctatatttttacaattaaaaaaaaaattttgtggcttttcaacaatttttatttggaagtaatttcaaatttataaagttgcaagattagcacaaagcatactaatgttttttgaaatacacccattgttaacattttgtaccatttgctttatcatttgcactctgtgtgttgggggtctgtgtgtgcagtatgcaataggtttttcttaaaccatgttagagtaagttgcatatatcaaagaaataccttttcccacaaataaacttaagtagttccccaaaataaggatattctataaaaccatagtatagctagcagttttattaaatttaaccttccatattccagttttatcagttgattccataatgtcctttgtggcactttgttactctcgtacatcatcccatccaggatcaggtatttcatttagccctcatgtgtcttcagtcacatttaatctggaacagttcctcagcttttgtcttttttttttttttttgaccttgatgtttttgaggaatagtctttgttttaaaatagagtatttctcatattgtccttttttttttttttttttgagacagagcctcgcactgtcactcgggctggagtgcaatggtgtgatctcggctcactgcaacctccacttcctgggttcacactattctcctgcctcagcctctcgagtagctggaattacaggcgcacaccaccacacccggcttattttttgtatttttagtagaggcggggtttcactgtgtcggccagactggtctcaaactcctgacctggtgatctgtccacctcagcctcccaaaatgctcatattgtacttttctagtgtttcctcatgatgagattcaggttacgcattcttggccagaatactacataagtagtttgtattcttcttaagagagttggatttagagagacataatggtcatctgcccctcagttttcatcctcaaccaagatgattgattttttcactgtgtagttactgtcattttctttaccacaaataagtgggaagtactttaagaccatgcaaacattcatgttttccatcagtatttccctcctggatttgaggtctattgattctcgcctgaaccatctttactacagtggttatagagtgatggttttcaccaccactcattccacactacaggcagcacttatcattttgctgtaagcaagggactttctttttcttctttttatttacttgtcttttttcttttgtttttgtttttgtttttttgggagatggagtctcactctattacccaggctggagtgcacagagtgcagtgctgcgattttggctcactccaacctctgcctcccgggttcaagcgattctcctgcctcagcctcccaagtagctgagattacaggcacccaccaccactcctggctaatttttgtatttttagtagagacagggtttcaccatgttggccaggctggtcttgaactcctgacctcaggtgatgcgcccacctcggcctcccaaagtgctgggattacagatgtgagccaccacacctggctgtcttttcattattggtgtgaactcatgagttctcatattttccatagtttatcattcattactattctcactgttttcatacttgaattgtcccaaatttggcccatgagagccccctcagttgatgcttttgtatgcttctatcattttgggagattatttccttactttctagaataacaagatgttccgggtttactgtgtacctatcctgccttaattctagaatcagctctttctccaacaagctttggttcttcttagtggcgcatgatatgtattagagaccaagatacgggcactaggtatgggcattattactgggatgtctttgtttctgggccctttaagtagacagaggtagaaaatacatgcatgtataaatacatatactgacaccctagtatacacatatacaagtgttttctcagtcttggcacgattgacattttgggccaaataattccttattgtggggtcagtcttgtatagttttggttgttagcaacatctctggcttccacccactagatgctacaaagaaaattatctccagacattgccagtgtcaccagttgaaaactactgataagtacctacatgtccacatacttaactttagaaatcattaggctacagtgatgcttctaattctggtctgtccccacagaattctttatcttctctcataccatttatttgtatccctcttcttctatagtgagaactctgactcccaataatatcaatagattgattcacttcctcaattctgtaatataggatgagcagcccaagtccagaaatccaaaatgcttcaaaatctgaaactttttgagtgccaacatgacactacaagtggacagttccacacctgactgaccccatgtgacaagttgcaaatgttatttaaaattttgtatagaattaccttcattagaacttggggataagtgttcagaaaaaaataaataaaattgccttcagtctgtatgtataaggcatttatgaaacaaatgaatttcgtgtttagacttggttgagtctcatatccgagatacctcgttagatacatgcaaatattccataatttagaaaaaatgtcgaaatctgaaatacttctgatcccaagcatttcagataagagctactcaacctctacttctcaaatagttttagaattgtttccctcatacttccacgaagaccagacatccgggaaaggattgagaattcgcatgcagctctgctcctgcctgtcctgcccacgacatgatcatcaaatgtgttaataggttacttagaatttgttttgttgttgttttccctctttgcatgatggtattactcatttgaaatatagttgggttcatcttgcttgttttcatcctccccctcactccccgctgtcctatctttaatttttttaatatataaaccattatctatagaaaaacatgtacccagaagtgttactctcttctgaatcccttccaccatgttacccccaactcctttcatcccttgagggaaccaagcttattgtttttaaaaatatgagatagatatatatcttcttatttctccctctttcttaaataaaagtagcatactgtatatgttctttgtttgtttttttgttttggagacaagagtctcattctgtcttccagtctggactggagtgcagtggcatgatcatggctcactgcagccttgacctcctgggctaaagcgattgttacacctcagcctcccgagtagctgggactacaggtgcatgccatgccaccatgctcagctaattttttcctttgccttttttgttttcccccttttgtggagaacggggtctcgctatattgcccaggcaggtctcgaactcctgggctcaagctattctcctgcctctgcccccctaatagctgggattacaggcatgagccactgcacctggccacactcagctaatttttctttagtttttgtagagatggtctcactatgttgcccaggctgcctctgggctcaggtgatgcttgcacctaggcctcacaaagtgctgggattacaagtgtgagccaacacacctggcttttttttttttctcttcccccggagacagaggctttctctgttgcccagactggagtgcagtggggtgatctcagctccctgcaacctctgcctcctgggttcaagtgattcttgtgtctcagcctcctgagtagctggggttacaggcaggcaccaccacaccccgctaattttttgtatttttagtagagacaggatttcaccatgttggccaggctggtctcaagctcctgacctcaacagatcacctgcttcggccttccaaagtgttgggattacaggcgtgagccaccgtgcccggcccacacctggctctttttgatgttgttaaagacagattcaacccctttcgcccaggctggagtacagtggcgcagtcagagctcactgcagcatttaatttctgggctcaagagatcctcccacgtcagtcttctgagcagctgggactgcaggctcccgccaccacatctggctaattttttatttacagattttttttgtaaagatgaagtcttgctatgttgcccacggtggtctcactcttgggcccaagcctcccgagttgctgggattacaggctcaagccactgagcctctcttgctcttttttttttttttcttaccaatccagtatctcctggaactttttccatataagctcataaagtttttccttatttttctttttaaaacagttgtaggctgggcacagtgactcatgcctgtaatcccagcactttgggaggccgagacgggtgcatgaccttaggtcaggagtccaagaccagcctggctaacatggtgaaaccccatctctactaaaaatacaaaaaatgagccgggcgtggtggtgggcgcctctagtctcagctactcgggaggctgaggcaggagaatcacttgaacttgggaggcggaggttgcggtgagccgcgatcacacccttgtacttcagcctgggcaacaagagtgagactccatctcaaaaaataaataaataaataaaacagttgtatatgtagtacctagttctctacttataccttaatgtattcaaccagtctcccgtgtttggtatatttaggtagttttcaatattttgtaactccaaataatactgtaatacataaccctgcatatgtgtacctttgtattatttggaggtatatgtgtttttttagtcattgttatttctgagtcaattcagatctgtcttccagatgctttgtatgaactcactgcagtcacactaccttcataatcaggataagtatttaagcattatgatattatggcccaaaagagagcttttaatttgaataaaaataaagtgaaagaggagaacctaatttcagatgactaaatttatagagagctttagataaataatttaaaatgttcatcaggccaggtgtggtgactcacacctataatcccagcattttgggaggccgaagtgagagaatggcttgagcacagaggttcaagaccagcgtgggcaacctggtgaaaccccgtctctacaaaaaatacaaaaattagccggttgtggtggcaggcacctgtaatcccggctactcagctggctgaggcaagaggattgcttgaccttgggagattgaggctgcagtgagccatgatcatgtcactgcacaccactccagcaacagagcaagatcctgtcaaaaaacaaaaacaaaagtgttcttcaagcaaagaaaatttgtcttataataagatttaaatgtaaatctggggccgggtgcagtggctcatgcctgtcatcccagcactttgggaggctgaggcagatcacttgaggtcaggagttggagaccaacctggccaacatggtgaaacccacctctactaaaaatgcaaaaattagctgggcgtgatagcgcatgcctgtaatcccagctagtcgggaggctgaggcacaagaatcacttgaacctgggaggcagaggttgcagtgagccgagatcgcaccactgcactccagcctgggggacagagggagaccctgtctcaaaaatatatatatttatatatatatatatattttttgttagacggagtctcgctctgtcccccaggctggagtgcagtggcacgatctcagctcactgcaacctccacctcttgggttctcctgcctcagcctcccgagtagctgggactacaggcgcatgccaccacgcctggccacttttttgtatttttagtagagacggggtttcattgtgttagccaggatggtctcactctcctgacctcgtgatccacccgcctggacctcccaaagtgctaggattacaggcatgagccaccacgcctggccaaatatatatatatttctaaatagctaaggagttgagattaaaataaaacttaggagctgaagacatcagtaataatgagggtactgataacaaaaacctatcagatacagccaacatagcctacagaaaatacagtcttcaatgaatctttataaaaatgacagaaaatgaactatgtgttcaatttaaggataagaacgacaaaataagtctaaagaaagcaggaaaggggaagaattaataataaataaaagcagaccttaataaaatagaaaatagtccagtaaacttaattgataaaaccaaaaactagctttttaaaaagaccagtaaaatagacagttttttaaagagaaaatttataaaaccaatttaagaaaatttataaccaatttaataaagagaaaagacataaatgaactttataggaatgagaaattcaacataaaatgaactcagatgattttcaaacttatgagagtacggtatcctattaggtttgaaacaatctgctgggcgcagtggatcacttgaggtcaggagtttgagacctgcctggccaacatggtgaagccccatctctactaaaaatacaaaaattagccgggtgtggtggcacatgcctgtaatccccactactcaggagctgaggcatgagaattgcttgaacctgggaggtggaggttgcagtgagccaaggttgcgcactccagcctgggcaacagagtgagactctgtctcaaaaaataataaaataaataaataaatttgaaaatctgaatgacctgggtgctttttctaggaaaatatgtgataacattggttcaagaaatagtaggaaacttgaatagatcattaaatatagagaacattgtaacattaaagatttcaagcccaggcagtttttaagcctagatgctaattttttcaaatcttaaggaccatttgcttcccagattacattgctttttccgggacataaaggtagtaaatttaggagcttattttataaggtgggcaccaccttcgtagaaacactgggtgaggccaggcatggtggctcacacctgtaaccccagcactcagagaggccgaggtgggtggatctcttgagtccagcctagccaacatggcaaaaccctgtctctattaaaaataaatttggctgggcacagtggctcatgcctgtaatcacagcactttgggaggctgaggcaggtggatcacctgaggtcaggagttcaaggccaacctggccaacatggagaaagcccttctctactaaaaatacaaaaattagctgggcgtcgtggtgcacacctgtagtcccagctacttggggcggtgagggaggtgcgagctgaggcacgagaattgcttgaacccttgaggtggaggttgcagtgagccgagatcgtgccactgcacttcagcctgggagacagagtgagactgtctcagaaaaataaaaatacaaaaattagctgggcatggtggcacacacctgtaatctcagctactattttgaaggctgaggcgtgagaatcacttgaacctgagaggcagagattgcagtgagctgagatcatgccactgtattccagcctgggtgacagagtgagaccctgtctcaaaaaggaaaacaagaagattacagtctaatgatttctgtgaactcagattaaacatactaaataatataatagtggaatccagtcggatatgaaaaacattgctcattgccaaatgtattcatccactctcatgctgctaataaaaacatacccaagacagggtaatttataaaggagagagggcagccgggcgaggtggctcacgcctgtaatcccagcactttgggaggctgaggtgggtggatcatggggtcaggtgattgagaccatcctggctaacacagtgaaactccgtctctactaaaaatacaaaaaattagccgggcatggtggcgggcgcctttagttccagctactcgggaggctgaggcaggagaatggggtgaacccgggaggcagagtttgcagtgatccgagatcatgccgctgcactccagtctgggcaacagagtgagactctctcaaaataaataaataaataaataaataaaggaaagaggtttaattgactcacagttcaacatggctggcaggcctcaggaaagttaaaataatgacagaaggggaagcacacgtcgtccttcacatagtggcagaaaggagaagaatgagagacgagtgaagggggaagccccttattaagccattagatctcatgagagcttactatcatgagaacagcatgggggaaccaccaccatgatccagttaccttccaccgggtccctcccaccacacgtggggattatgggacctacaattcaagatgaggtttgggtggggacacagccaaaccctatcaccaagtataatttttcccgtgattacaaggttggttcaacattaagaaatttatggccgggcatggtggctcacacctgtaatcccagcactttgggaagccaaagtgggtggatcacttgaggtcaagagttcaagaccagcctggccaacatggtgaaaccccatacctactaaaaatacaaaaaaatagccgggtgtggtggcacacacctgtagccccagctaattgggaggctgaggtgggagactctcatgagcccagggggcagaggttgcagtgacctgagatcgtgccattgcactccatgctgggcaacagagtgagactctgtctcaaaaaaaaaaaaaaaagtgaaacaccatatgattaacccaaaatatagaaaatggtgtatttttaatacccattcctgatggttaaaaaaaaaaaaccctgtagaaaataacaggatattttcttaacttgattatggctacctaccagaaatttacaacaaacattaaaatataaatactaggtgcattcccattaaagtcagcaagaaactaagagttcctgtgtctctgcatctatttcagtatatatttgagattccagctcatgtagtaaggcaacagaaagaattagaactattggaaaggaagcagccaaacatttataggtgacagcatctacagagccaacctaagggaatcaacaattacaattaatggtttcagggccaggtgggggtggctcacacctgtaacccgagcactttgggatgtcgaggctgagacaggaggattgcttgaaactgggaggcagaggctgcagtgaggcgagatcatgccactgcactccagcctgggcaacaaagcaagactgtctcaaaaaaaaaaaaaaaaaattaatgggtttagtatggtaacctgaaacaagatggcatacaaaaataaactcttcctggccaggtgcagtggctcacacctttaatcccagcattttggaaggccgaggcgggtgaatcacctaagataaggagttcaagaccagcctggccaatatgacgaaaccccatctctactaaaaatacaaaaatctagccagccgtggtggtgcgcgcctgtagtcccacatacttgggaggctgaggcaggaggatcgcttgaacctgggaggcggggaggttgcagtgagcggatgtcgtgccactgcactccagcctgggcaacagtaagactccgtctcaaaataaataaataataaactgttcttgttgttggataatatagtagaaaagattttccttgtttctggatgaaaaagtcagtattggacagatatcacaactcttaaaataataaaattaaatgcaatcccaatcaaaattcaaactaaatttctcattaacttgaccagcttgatcttaaaaatcatttggaagagaaaaataaataaaatattttaaatgataaatgggaaagcacctgaatctatcagatatacaaatattattgtaaaatgtggaatagacaaataggttaggggaacaaagttcaaagacatgcccatttatgaaatttagcatgggataaggtggtattaaaagccttaatgttgaacacatacagaataacagtataaagtggtagagaaaatataccctttgggtagaggtggacttcctcaaggtataaaatgtagaaacaaaaggaagactggtaagtttgactgtatcaaaatagaaaacttctgtgtgaagaaaggcctcaaaacaggccaggcactgtggcttaggcctggaatccctgcgctttgggaggccaaggagtttgagatcggcctgggcaacgtaggtgcaagattttatctttacaaaaaattgatttaaaaaatagtctggcagccaggtgcagtggctcacgcctgtaatcccaacactttgggaggccgaggcgggtggatcacttgaggtcaggagttcaagaccagcttggacaacatggcaaaaccccatctctactgaaaatacgaacattagccagacgtggcggtgtgcacctgtaatcccagctactcaggaggctgagacaggagaatcacttgaacccgggagctggaggttgcagtgagccgagactgcaccactgcactccagcctgggtgacagagcaagactccatctaaaaaaaaaaaaaaaatacagggatgtcggcgcagtcttgggacctacctgggaggcctcagtgggaggatcctgggaggtcttgcgccactgcactccagcctgggtgacagagcaagactctgtctcaaaaaaaaaaaaaaaaaaaaaggaagttaattgaaaaaatcaaattttatgtgggtatataaaagtaatcccacaatttatagaaatattttctttaaaattattgtgagttctaaccatttttttgtgtgtgtataatgccattctcttcctctgtgaagtgcctgttcggggtgttgctacgtttttgttttgttgtgttttctgttgtagtgtttacatttttcttgtcgattcctaagaggactttagggtactgagtcacccatggtcatgtgttgcagagaagtgtcacagagtgaaaactgtcttttccttgatactacctttagattcatatttgggaagaccttcgctaatcatgactacataagtattcacttttactttcttaagacctttttgttttcatttctttttatagtaatgtctaagccatctggaatttatgtttgttgattatgcaagaaagggatcgaagtgctttttctgagtcattatccacatgccgaaacatttattgaatagccctttccttattgatctgaaaacaccttcttataaaaccttgcattggtttttggacttgctgtgctttcaggagtcagaagaacattcttttgattattgtagctttacattaataatacattttggccgggtgcggtggctcacgtatgtaatcctagcattttgggagactgaggcaggcggaacacctgaggtcaggggttcaagaccagactggccaacatggcaaaaccccgtctctacaaaaaaaaaaaaaaaaaaaaattagctgggcatggtggtgcctgcctgaaatcccagctactttgggaggctgaggcaggagaacctcttgagcctgggaggtagaggctgcagtgagccgagcttgcaccactgcactccaacttgggtaacagagtgagactccatctcaaaaaaaaaaaaaagaaaaatacatttcaatatgaggtaataaattctcctaaattttttgttttgtaaacctccttgcttctcttaaattattttcccaaaaagccttaagtgttttccgtagtaattttgatttgggaatggagtgagtgacttggtagagggtgccatatgcctttttgcctttccccagtttcccctactgttaacatctcacatttatgtggtgtatttattataattgatgagccaacattgacacattattactgaagtccatagttgacattagggtttactctttttgttgtatattctgttggttttgacaaatgcctaatgttatatatccatcagtcatacagaataaattcactgccctaaaaatctcagcctccccctattcatccttccctgcctccctaaacccctcatatttttactgttaaccatagttttgtcttttccagaaaattacaattatatagcttgtatccttttcagattggctgctttgacttaacaatatgtacttaacatttctaggccagacacagtggctcacgcctgtaatcccacactttgggaggccaaggcgggcaaatcacgaggtcaggagatcgagaccatcctggctaacacggtgaaaccccgtctctactaaaaatacaaaaaaaaaaattggccgggcgtggtggcgggtgcctgtagtcccagctactcgggaggctgaggcaggagaatggcgtgaacccgggaggcggagcttgcagtgagccaagatcgcgccactgcactccagcctgggcggcagagcgagactccgtctcaaacaaaacaaaacaaaaaccaaaaacatttctccatgtgttttcatgactgtgatatatttttaagcatttttgttgttgtttactttattgctttaaaaaactgacttttgcagttagttgaggtcctgaggtttctcctgtgaatctgtttgaacatcatatatatttggcattgattggaaagcggtttttccctggcctgtgtgaaatacactgaaggtctgcacctgcccgcgcacttcacgttgtacatgggaatgtactatagctgcacatgttcatgtagtggcgttagatgccaaatagttctagggcttagtttaagattgggtactttttgtcaggaaacaacaggtgctggagaggatttggagaaataggaacacttttgcactgttggtgggactgtaaactagttcaaccgttatggaagtcagtgtggcgattcctcagggatctagaactggaaatatcatttgacccagccatcccattactgggtatatatacccaaaggattataaatcatgctgctataaagacacatgcacacatatgtttattgtggcactgttcacaatagcaaagacttggaaccaacccagatgtccaacaacgatagactggattaagaaaatgtggtacatatacatcgtggaatactatgcagccataaaaaaggatgagtttgtgccctttatagggacatggatgaagctggaaaccatcattctcagcaaactattgcagggacaaaaaaccaaacaccacatgttctcactcataggtgggaattgaacaatgagaacagctggacacaggaaggggaacatcacacaccagggcctgtcgtgaggtgaggggagaggggagggatagcattaggagatatacctaatgtaaatgacgagttaatgggtgcagcacaccaacatggcacatgtatacatatgtaacaaacctgcacgttgtgcacatgtaccctagaacttaaaagtattaaaaaaaaaaaagatttgggtactttttgcctgactttgtgatctataataaggcatgaaagtaatttttagatcttgttagtgactcagctttcaaacaggtattttccactcctttttaaatcttctggctcagtttaattgaagaatactctgagactgcaagttgagctgtttaaatccagggactgtttgcactgtttacctgtgtgaatttgaattttgttaatatagggcaacaaaaacaaagtacacgaatgaatttggatagtaaggttgaaataagactataactataatctaaatttcagatggttatatttataaaaacagctatatattttcattgattgtcaaagtaactatacattttttatttttattttttaaatttattattatttttgaaaccgagtcttatactctgttgcccaggctggagtacagtggcgcaatctcggcttactgcaacctccacctcctgggttcacgtgattctcctgcctcagcctcccaagtagctgggattacaggcgcgtgccaccatgcccggttaattttttctatttttagtaggaacaggtttcaccatgttagccaggatggtctcaatctcctgacctggtgatacacccgcctcggcctccaaaagtgctgggattacaggcgtgagccaccatgcccggccagtcactatacatttaaatataaactatttaatatgctgcttctatccagcttacatgttgaggtccctgttgtcttttaaacctttttttttttttttttaaagacagttttgctcttatcgcctaggctgaagtgcaatggtgctgtcttggctcactgcaacccctgtctcccaggttcaatcaattctcctgcctcaacctcctgaatagctgggattacaggcacgcaccatcactcccagctaatttttgtatttttagtttcaccatgttggccaggctggtctcaaactgacctcaggtgatcgcccgcctcagcctctcaaagtgttgggattacaggcatgagccactccactcggtctgtcttttcaactttaaaagtttgataatgatggaatctataatcatattgtctatattttcactttctatgcagtgacggttgtttctaattattgccttaaggtaaaaaattaaaaaggccctctgagtcttcagaggaggattaaaatattctcagtttgtgttagtttttgtttgttttttgagatagtgtctggctctgttaccgaggctggagtgcagtggctcaatctcagttcactgcagcctccgcctcccgggctcaaaccatcctctcacctcagcctcccaagttgttgggactacaggtgtgtgccaccatgcctagctaatttttctattttttatagagacagatttttgccatgttgcccaggctggtcttgaactcctgggctcaagcagtctgcctgcctcagcctctcgaagtgctggaattacaggtgtgagccaccctgcgtggcttttttttttcttcttttttttttttttaaaagagacagggttcaggctggagtagtgcaatggcatgatcatagctcataactctggggctcaaacaatcctcccgcattggcctttcaaagtgctgggattacaggtgtgagccaccatgcccagcttgtgttagatttttttattctttggaaatttttgatttccagaatgaaattgctgatcatttaaaaaatatatatatacatatatgtgtgtgtgtgtgtgtgtgtgtgtgtgtgtgtttataagagtgaaatgtaggcatctataaagatgatcaagatatgatcaaggtcaaaattgttgactttctggagaattcatacaaagcccttttacataccacatcacattgcatttcactgaaagatggagggtattctagagaattgtattagaaagagaagacacatcgtaggccaggcacagtggctcacttctgtaatcccagcaccttgggaggccgaagcaggtggatcacctgaagtcaggaattcaacatcagcctgaccaacatggagaaaacatgtctccactaaaaatataaaaattagctgggtgtggtggcacatgcctggtaatcccagctactccggaggcagaggttgcaataagctgagattgtgccacagccctccagcctaggtgacatggcaagaccctgtctcaagaaagagaaaacacatcacagaagaggaagggagattcttttgtagttgctacgtgtgacgacagggtgttcacacacatgtgtaagatgtaccaccctccagccttgttacaatgtcgtcacattacccgaccgatgtgaaaaaaaaaaaaatagaagaggaaagcagtgccacaaatacaggaaactacattgagaaagttatatgctgagtagcttctattttctgtgtggagttggaggtcagctgaaggatgggatgcaattaggtggttttcgttttgttttgtttgttttgagactgagtctccatctgtcacccaggctggagtgcagtggcacgatctcggctcactgcaacctccgcccctgggttcaagtgattctcctgcttcagcctcccaagtgactgagactacagacatctgccaccacgcccggctaattttttttgtatttttagtagagacggggtttcactatgttggccaggctggtctcgaactcctaacctcgtgatctgcccgcctcagcctcccaaagtgctgggattacaggcgtgagccactgcgcctggccacaattagctatttaaaagggaaaaaaggaccagtctagacaacatattgagaccctatctctactttaaaaaaaaattaacccatcatggtggcatgtgcctgtagttccagctactcaggaggctgaagcaggaggatccattgagcccaggagcttgaggatgcagtgagccatgattgtgccacagcactccagcttgggtgacagagcaagacctcatcttttttttttttcaaagagtgaggaaaggggcccgggacaagtaaatgattcatcaggtggcagtgaatgactaccatatactatgacttgacctatcctaattctaaaaatataaatacattattagcagtattgtagataattgaatatcctgctcttcagtgcagagtaaaaactgctccatcaacaattggaagctatatttaatcagataattctggggatgcctattatgaatatgacctgattttaagggatcttcattgttttttagggcttgacttactatacagtggtcttcctttgtttagtttgctgtttcatgtaatctgcctgtatacttctgacacttctgataaataggtcttttaaaattactgttttcattcaattgctttttcttgccttgaatgtcctacatagtctgtttctgtttctagccatttctctcattattttaatgccacctgatttagagcagttttttttttgagacagagtctcgctctgtagcccaggctggagtgcagtggcgcagcctgggcccactgcaagctgcgcctctcaggttcacgccattctcctgcctcagcttcactagagcagttttaagtaataggaatgattatagcatctttgccttgttctttgacacaagtgtttctagtgttctgccattaactattagatttattggttgaaggtttgagagatttcttttttcctgatgttaatgaacattcttaatgaagacctttccgttaatgaggaatgtttaaaaatcaagaatgttgaatttgtttctgttttttgagacaagagtctcactgtgtcacccaggctgtaaggcagtggcgccatcttggctcactgcaatactccacctcccaggttcaagtgattctcctgcctcagcctcccaagtagctgggattacaggtgtccaccgccgtgcccggctaatattgtatttttagtagagctgaggtttcaccatgttggccaggctggtctcaaactcctgacctcaagtgatccacccacctcagtctcccaaagtggtgggattacaggcgtgagctaccacgcctggccaagaatgttgaatttgatcagatgtttttaggtaaacattgagatctccataatgtaccattctgattcacttggtccagctcagctccctgcctaggtaatacttactatttcctttaagtcctcgcatctcgcctttataaaaagattcttccattcagtctcatttctctcgtctttgaattaaatttcatagacttcagtagcttttattttgctcctcagataggtttacaagatcctaggaggcaagggaccatatataacttaaccttcttttatattccttggtataaaactggaaataacaagcactcatcccttcttcctctttccttttttctttacatgttttatagtgaaattttgctttacattttaaaaatataaatgtttcaaactattcaatacatgacagttgtattgtgtatctttcctattgtacaacctgactttgccttatgagtttttgaaataatgcaaaatatttttataggaatatatcctgagtggatctcacagttgtaaattatgctgaacaactaaggcaaaatctcctcctctctggaaacgtagctgacctctggcctgtagcaggccatgcagtttttttctaagtgtcagtcaataatatagtaactttaaaacaacataattaggagttcagctgggttagtgtgacattctctctccctctcccccaaccccctttctctcttagacctttaagtattttagttttcagtaatgttatttttcttaacaggttaaaagggtaaagagggaaacacagataaataagggtggaggctgaaaacaactgtttagtgactgccctctgttttgtgtttccattactcaagaaatttaatcgaaatacgagaatgaacagtaatgcatattttttgtttatttatttggttttgctttttaaaaagtgcagtgtgatatacttaactggtagatcatttttggcttttgttgcaactgtgggctggagggtatatcaggatgtcatctgagacccagccgtctgatgaaaagaaatggaatcgagcaggctagtatactgggtacagggttctttttgcttgatggggaagataaaggtccactcaccctgcattgcctgaattacattcttcttcactttgtctctgccatggataaggtctcattataacctcttgctgaacttgtacttgtcctaagactggtagtagttaaatcctgaactaccttttggaagtagttatcttagaatgtgatggtgaaggatggtaatggcaatcaatttgtcagacagatttcttagggtacgtgaggttggagaagtataagacctatggccaggaactcatcacatctgtgctgccctttccctgaagagtcagtagggtattgtagcataaaagtttaggaagtcttggctggacacagtggctcacacctgtaatcccagcactttgggccaaggtggacgaatcacttgagatcatgaattcaagaccaccctggccaacatggcaaaaccccgtctctactaaaaatacaaaaattagctgggcctaatggcacgtgcctgtagtctcagcttctcaggaggctgaggcaggagaatcgcttgaacccaggagggggaggttgcagtgagccgagattgccacactgcagcctggatgacagaataagactccgtttcaaaaaaaaaaaggccaggtacagtggcccacgcctgttatcccagcactttgggaggccaaggcgggcggatcacaaggtcaagagatcgagaccatccttgccaatatggtgaaaccccgtctctgctaaaaatgcaaaaattagctgggcatggtggcacacgcctgtagtcccagctactcgggaggctgagccaggagaatcgtgaggttgtggtgagctgagattgtgccactgcattccagcctggcgacagagtgagactgcctcgccaaaaaaaaaaaaaaaaaaaaaggaagccttggctgggcgtggtggctgatgactgtaatcccagcactgggaggccaaggcagtcaggtcacatgaggccaggagtttgagaccagcctagccaacacagtgaaaccccgtctccactaaaaatattaaaaaaaaaattagctgggcatggtggtgctcacctgtaatcccagctactcaggaggctgaggcatgagaatcacttgaactcaggaaacaggcttcagtgagccgagatcatgccactgcactccagcctgggtgacagagtgagactccgtttcaaaaaaaaattaggaagccttgttacctgtttgagacttgattgatatcctgtggctgcagcttagggaatgatcccctgtatatctctgccctggaaataaattttaatcacattctctcccaagactatatagtttcatcttgttatctaaaacagtatagcccggggtggtgtgagagatgtcttttggaggagggtactaaggatgactccatgtgtgcttctggtggtgtcatgcttgatactgcctggtcttttgtgttaccttcccagagccttcaacagccctgcagacatctcagatttgttgggcccctggaccttttagaggaatgcatgttatctccattgctgccctgaatatgcaagcttagccttttcagtgtatctttttttttttttaatttttattttactttaagttccgggatacatgtgcagaatgtgcaggtttgttacataggtaaatgtgtgccatggtggtttgctgcacctatcaagtcatcacctaggttttaagctccacacgcattagctatttgtcctgatgctctccctcccctcaacccccacccccaccaacaggcccgggtgtgtgttgttcccctccctgtggtccatgtgttctcattgttcaactcccagttatgcgtgagagcatgcggtgcttggttttctgttcctgtgttagtctgctgaggatggtggcttctagcttcatccatgtcgccacaaaggacatgatctcattcctttttatggctgcatagtattccatggtgtatgtgtaccacattttctttatccagtctgtcattgataggcatttgggttggttccatgtctttgctgttgtaaatagtgctgcagtaaacatgtgtgcatgtgtctttatagcaaaatgatttatattcctttgggtatatacccagtaatgggattgctgggtcaaatggtatttctgcttctagattcttgaggaatcaccacactatcttccatgatggttgaactaatttatattcccaccaatcgtgtaaaagcattcctatttctccacagccttgccagcatctttcgtttcttgactttataataatcgccattctgactggtgtgagatagtatctcattgtggttttgatttgcatttctctaatgatcagtgatgttgagctttttttcatatgttttttggccacataaatgtcttcttttgagaagtgtctgttcatatcctttgcccactttttgatggtttttttttcccgttctgtaggttgcatgttcactctgatgatagtttattttgctgtgcagaaactcttgagtttaattagatcccacttgtcaattttagcttttgatgcagttgcttttggcattttcatcaagaaatctttgcccatgcctgaatggtattgcctaggttttcttctaggatttttatggttttgggttttacatgtaagtctttaatccatcttgacttattttttgtataaggtgtaaggaaggggtccagtttcagttttctgcatatggctaaccagttttttgagcaccatttattaattaaggaatcctttccccattgcttgtttttgtcaggtttgttgaagatcagatgtttgtagatatgtggtgttatttctgaggtctctgttctgttcccttggtctgtgtgtctgttttggtaccagtagcatgctgttttggttactgtagccttgtagtatagtttgaagtcaggtagtacgtgtgatgcctccagctttgttctttttgcttaggattgtcctggctattagtgtatctctttaaatgggtctagtaagaaaacatctcagttcatcagcctttgacttaaccttgttttttcttcatatgagcaatgaaattaaaatggttacggaactcttagaactttttcattcttagaatgctagagtatacagtttgtaaaatactattattggccaggcgtggtggctcatgtctgtaatcccagcactctgggaggctgacgtgatgaaaccccatctctacaaaaaaatacaaaaaattagctgggcgtggtggtgggtgcctataatcccagctactcaggaggctgaggcaggagaattgcttgaacccaggaggcggaggttgcagtgagccgagcttgcgccattgcgctccagcctggaggagactccatctcaaaaaaaaaaaaaaaaaaaaaaatcttatgggtggtattgatgaggtgttatgactagtattacagctgcagaaattaccctaggggataaaaacaaatgaaaagaatgtaggaagtcagctaaagtgcttaaaatcgaatgctggcattttcataaacttgtaatagtttagaaaataatttcattcgttatgtttgtaatagtttgatatttaagcctaggctgtgtctagcttaggatctgtttgctcatggataaaagtccttcatctcagttttgattttaaccattttcttttttatttttcttaaccatttttatttttttaacctctttgtgtgtgtgtgtgtgtgtgtgtgtgtgtgtgtgtgtgtgtgtgtgacggagtttcactctgtcatccaggctggagtgcagtgacgcaatcttggctcaccgaaacctttgcctcccagattcaagcaattctcctgcctcagcctcccaagtagctgggattacaggctcctgccaccatacccggctaattttttgtatttttagtagagatggggtttcaccatgttggccaggctgctcttgaactcctgtcctcaagtgatctgccctcctgggcctcccaaagtgctggaattacatgcgtaggccactgcgcccagccttctctgattctttatagtattactggttttggtctactccattttacttctgtgtgaatttctctttaattctagtgactggtttcaaagaggtgaagattccatccttaataaagctgatgaggccaggtacagtggctaacgcctgtaatcccaacactttgggaggccaaggtgggcggatcacctgaggtcaggagtttgagaagaccagcctgaccaacatggagaaaccccgtctctactaaaaatacaaaattagctgggcatcgtggcacctgcctgtaatcccagctactctggaggctgatgcaggagaatcgcttgaacctgggagacagaggttgtggtgagccaagatcacgccattgcaccccagcctgggcaataagagtgaaactctgtctctaaataaagaaagaaagagccaagcgtggtggcgggcacctgtagtcccagctactggggaggctgaggcaggagaatggtgtgaacccaggaggcagagcttgtcgtgagtggagatcgcaccactgcactccagcctgggcaacagagcaaaaaataaaataaaataaagctgatgaaaatcaactctaggtcaacaactgagattagtagcaagccccagaagcaccctttaggctgttagaaccaagagttttgtgggtttttgttttgttttgtttgttgtttttttgagagagggtcttgctctgataggcaggctggaatgcaggggctcactcacagcttgctgcaacctcaacctgccaggctcaagccattctcccgcctcagcctcccaaagtgctgggattacaggtgtgagccactgccacctgctgaggttcttcagtctttacttaacttattacttttagtaacggtagtacaccttgctgaagttaaaggttctacattaactggatcagattgttggcttaaatattgagaggcagggcatcaaaggtggtagtgctaaaattctctggattttttttttttttgagacagagtttcactctgtttcccaggctggagtgcagtggtgcagtctcagctcactgcaacctttgcctcccgggttcaagcaattctgcgtcagtcttccaagtagctgggactacaggcgcataccaccacacctggctaatttttgtatttttagtagagatggagtttcaccatgttggccaggctggtctcgagctcccgacctcgtgatgcgcccacctcgggctcccaaagtgctgagattacaggcgtgagccaccgctcccagcctctggtcttgaacttctgaccttgtgatttgcccgcctcggcctcccaaagtgctgggattacagacgtgagccactgcgctggcctaaccctgtaattattatacgttgatttttggcatgctcataattacctggaacataaagtttttgctggtaattccctgttatctttctttgctgatttgttttaaacataccattgaattaaagccagtaatcccaccagttatacaatactactggagtgtgttttgttttgtattttgagacgtagtttcgctgttgttgcctaggctggagtgcagtggcacgaactgggctcaccacagcctccacctcccaggttcaagtgattctcctgcctcagcttcccaagtaggtgggattacaggcatgtgccaccacacctggccttttttttttttttttgagaaggaatcttgctctgttgcccaggctagagtgcagtgatgcggtcttggctcactgcaatctccgcctcccgggttcaagcaattcttctgccttggcctcccgagtagctgggattacaggggcttgccaccacgccagctaatttttgtatttttagtggagacggggtttcaccatgttggccaggctggtctccaactcctgactttgtgatatatatctatatctatctatcgctctctctctctctctctctctctctctttctctctccatctataaagcccaaaacatttttggtcccgagcattttgtataaagggtactcaaactgtagaaggcaaacatgaaaaggctaattcagcttctctaaccttcaagttctaattctaaatgaatgtctcattctacgacagtacactaagtttatactgtatgattgctttttttcacccactccaatggttcaaagttatttctaatatgaaaatactttagttttctcaaaacttttctctgcaaaactaaattccagctgtcagcccttgagtgtataacaagtggtaaagaaagactaaatgtaaatgttagcaaaattgatggttgctgtcacagagccatagcttgatctatagagtgcctacagcttgtgaggtaagcaacacatttgaaacttataaatatgaagtttctcttctgatgttaaaaaaaagaaagaaaaacttataactaagaatataatattatggatgtagtatgacaggggctaaaagttctggaggctttgcgggggtgtcctttttaatgaaatacttgtatgatttgaaagggaatactcttgaaaagagtatcttcagggttaatgagattttaaataaattctatttcttcagaatagaaatgaggtcttttttttaggagtcatttgaatttttctttcagaaatcgagctatagcagattatcttcgttcaaatggctatgaagaggcatattcagtttttaaaaaggaagctgaattagatgtggtatgttttactttttacaattcaaagtatagttaatgagtggattttcactcaagtatctgtagttaacagttacgcacaattttgtcatttgttattgtggtctacttggtactgaacttgattttcactccttttttttttattttttattttaatttttgagatggagtctcactttgtctcccaggctggagtgcagtggcgtgatctcggctcactgcaacctctgcctcccagattcaagcgattctcctacttcagccttccgagtagctgggattacaggcacgcaccaccacacccagctaatttttgtatttttagtagagacggggtctcgccatgttggccaggctggtctcaaactccagacctcaggtgatccacccgccttagcttcccaaagtgctgggattacaggtgagccaccatgcccagccactccctttttttataatcagatttttagtaatatttggacttaaagatgaatgatctttgtcttgaggatcatagttaagccattttttaaaaattctaaatttattttctctagaatgaagaattagataaaaagtatgctggtcttttggaaaaaaaatggacatctgttattagattacaaaagaaggtaactaagtcttttttctttaaaattagttgtattcagttatataaactttctgaaaataacattcttctgcattaattaataattgcatctaatctttaaaaagcaaataaaaatacattttttgtgcttcatgaaaagtatgacctaggcatattattgcagatacatggtaattcacatatctggagttgctgactgggttcaatctgcatagtcctgactttgaggaattgatactgaaagaactcatttgtgcacttagaaggaaagaatacatggagccattgtgattaatgctgggaaaagaacactaaaatgtgctcgtagacaagttgtttttatctctgagcttttatttttatctgtaaatacaacaaataatattccagtcctaaaatggatacttcataggcaaagttagaataagtaaataacattgttatgagttcatcatataaagctcttagaaaaatgcttagcacatagtagatgctcaataaatattagcttttattaatattattattaccatatataatgtggtttggaaagaacttactaagagtagcagccttagagggaccaagacaaattcactgcccttctctaattagtagaggactctgtcaccagatacaaatcgaaatttttctttttgttaaagagttaaggcaattgtactgaatttttctcaatttttagtttcctcacatgacttagattttgatgctgtacaaaataaataattttcatttaaatttgacaaatgctttggagattactgaaattttttcaagtatcctacatacatagttgcaaaataaaggcagttttttaaaatgtcacatgctatttttattgaaatctatctgtacgtaactacatgttctttttcaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtaattttttgttaaaagcagacttaacgggaggctgaagcaggagaatggcatgaacccgggaggcggagtttgcagtgagccgagattgcaccactgcactccagcctgggcgacagagccacactctgtctcaaaaaaaaaaagcagacttaatagggtgaagaaaattaaaagatcctgaaaatgagggcctatgaagagggacaggaggtactctgaaacgtgtgatttggttctaaatcttaaaagacagaattggaataaaatatcattgtggctcctgagaggcatgctgccaggtaagtttgatggtgaatttgagaaagtcgggtgtcactaactgagttgatgtcagtacatcaccttgtgcttgaacaatttttgttcttggagaatgaaaagtgtgtgtcttacctttaaacggaggttatgtgtgaaatactgattgacaaaactagtaattgatagggtgaatctatactgcaaaagaattcagtagaggattcatttaaattgggctttccttgatgtatttaaaattggctttccaggagtgtgggaatatacaagcttttcattttataaattacgtatttcattaaaaaatttttttcacagtaaaaatattattaccttttaatgttgtgcttttttaattaggaaaagagttgtttttaagttgcctttgttccggacacaataaaatgaccgttgtataaaccacctacagaaagataagatagttgcaatataggtagatttaggtagatgcctctatcctaagggttatttcaaagtaagttacagatattaagtttcatttacaaaagtataaccaatcggccgggcacggtggctcacgcctgtaatcccagcactttgggaggccgaggcgggtggattgcctgagctcaggagttcaagaccagcctgagcaacacggagaaaccccatctctactaaaatacaaaaaaattagctgggcatggcagcgtgcgcctgtagtcccagctacttggaaggctgaggcaggaaattcgcttgaacccaggagacaggttgcagttagccaagatcgctccactgcactccagcctgggcgacagagcgagactgtctcaaaaaggtagttacaactaaccaaatagtaacgacggtttggccttactactaacagcagaagaaataaacactgaaattatgggccgggtgtggtagctcatgcctatagtcctaggactttgggaggccaaggtgggaggactgcttgagctcaggagttagagagcagcctgggcaacatagcaagacctcgtctctacttaaaattagccaggtatggtggtgcatgcctgtagtcctagctactcaggaggctgagatgggaggatcacatgagcctgggagttggaggctgcagtgagctatgattgagccagtgtactccagcctgggcgaagagtgagaccctgtcttaaaaacaaaaaaattggactgggcacggtagctcatgcctgtaatcccagcactttgggaggccaaggtgggtggatcatgaggtcaggagatcgagaccatcctggctaacatggtgaaaccccgtctctactaaaaaatacaaaaaattagccgggagtgatggcgggctcctgtagtcccagctactcgggaggctgagtcaggagaatggcgtgaacccgggaggcggagcttgcagtgagccaagatcgcgccactgcactccagcctgggcgacaagagtgagacacacatacatatatatgtgtgtcaaattgtcaaggtattttacctattaaataagaattcccagtgatgataagattttgataaagtagtcattctcattacatatgatacagtcttacgggatatcaatttaatagagtatatgaaggctttaaaagtttatactttttgacccactaattgtttctccccattactgtctgacctaggtattataaaatgaggacagaatttttttatattaaaaaatgttcactataatgttttctataatagtgatttagccagcaattagaattttttttttttttttgagatggagtttcactcttgttacccaggctggagtgcagtggtatgatcttggctcactgcagcctccgcctcccaggttcaagcaattctgcctcagcctcccgagtagccgggagtacaggcgcccaccactgtgcctggctaattttttgtgttttttagtagagacggggtttcaccatattagccaggatagtctcgaactgacctcgtggtccgcccgccttggccttcctaagtgctgggattacaggcgtgagccactgcgcccggccatatttcattttttaactcaaaatgacatatgctcttgttcatttgctattcgtgaacagttaacatcttctgaaatctttccttggccctttagatgtctgagttctgatggtctagtaggatcgagtattcatccattgttcctcaaatattctacatacaaatgcctgctatagccctctgaagctccttcccttccccttccctttcccctttctttccctttcctttccatctctttctctttctttcctcttatttcttccccttaagtttccttatttacatgtcattcctgctctgagacagggagcggactatgtcttgtgactttatataccttatcactattacagttggttatgtgatagaaaccttataaatgtggttctagagatagattttaataattgcaacattagttttccctgtagaaaaaaagaccaatttatacatgagatacaatatttctaaaatagttatcctttgttacttgttcggttagttactcagtaaggtgccagactggcctgctgagtgcaaatgtgaaacaagaaaggagtgatggagttggtgttaaccaattttctgttcacttgacaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggtaaggggtagaggatagtgctttaacagtaatttctatcatggtacttcagaaggaatattgtttctaacagtgtacagtgttcctttattcacctcttaattgtcagtattggtggaagagcataccatgtagatagtccagggataagccacagtagttgagagtgctttctattaggaagttttaagtatcttttagtactttacataaaatatttgtatgagtatttcttggtaagaaaaactgccaggtcatttatctgtatttgagttaaaaatggttttgtttgtgttttaatttttgttagttgggaaactgaagtccagagagagtaggtcgagtgaaaacgagcccagattctcttgctcacttaagtgaaatgagctgagcgcacagaccccatgccctcgttcattatttcccgggtcttgttgtgggaactgttttctgaggcagtatgttttgtggaaagagagtaatttgctttggagtcagacacctgggttcaaattcctacttgtctacttacggtattagaaaatttaaacctctttcatctgcaaaacagaggtaataataccagagtcatagagttgtcatgaggataagatgaagtcataagataaatcatcttggtgtagtacctgccacataggagatgctcattacttagggatttttgttgtttctttatacatgatgacatttgaatgttgggattttgtacaaggaacacgttaacacatgagtaaactgtgtttacctagagggcataatttgaaggttgtgttttctctgtcccaaattaaatgcattggggaagtttataattacaggaattccacgcatgaacactgtttttttgttgttgttttttggttgttttttttttgagactgtgtctcactctgtcgcccaggctggagtgcagtggcacaatcttggctcactgcaacctccgcctcccaggtttaagtgattctcctgcctcagcctcctgagtatctaggattataggcacgcgccaccacgcccgtctaatttttgtatttttagtagagacggggtttcaccatgttggtcaagctggtctcgaactcctgacctcctgatctgcctcagcctcccaaagtgctggaattataggcgtgagccacgtaaggtctatcatttatttttctttaagttgcctgtatcttctagctgtaactttaaaaagagttctttctaatgcattttttttttttacccccaacaccacctttttttttttttttttttttctggagatggcctcttgctttgtcacccaagctggagtacagtggcacaatctttgctcactgcaacctccacctcccaggttcaaatgattctcccacctcagcctccaaagtagctggcaatacaggcaagcaccaccacacccggctaacttttttatttttagtagaaacagggtttaaccatattggccaggctggtcttgaactcctgacctcaggtgatccgcccgcctcggcctcccaaagtgctgggattacaggcatgaaccactgcgcctggcccaccattttaaacagagaaccaattccccattttttgtatccatttgctttatcttttttatatcttagaatatcaacctagaagctaggcacagtggctcacacctataatctcagcacttttggaggccaaggcaggaaggattgcttgaggacaggagttcgagaccagtgtgagcaaaatatggagaccttgtctctacaaaaaataaaatagttgtgggtgtggtggtaccagatgtggtggtacacacctgtgtagttccagctacccgacaggctgaggcgggaagagctcttgagcccaggagttcaaggctacagtgagctatgattgcaccactgcactttagcctgggtaacagagcaagtccttgcctcacaaaaaaaaaaaaaaaaaaaaaaaaaaatgtttccctagcgttcatatgtaaacattcagactcactgaggtaagtatatgaatatattcaaatgttgataatcgtgatgccttttgtttttaaaccatttgtacaggttgaaatttaatcctaaatggagttgactatttccttgtgggttgttgttttactgatttttttaactttatcgtgtaaatccaggtttcttatccaatttgtataaaatccagtgtatttagaacttgctttgacatagtgaaaccccatggtaaaatcccatggtcaattgatgtttcattgctcttggtggtatattacttcataatatattgctgttatgtgttttaggccatgaccacaatgtttcttcagtagccatcatgcccaatggagatcatatagtgtctgcctcaagggataaaactataaaaatgtgggaagtgcaaactgggtaagtaagtttagttgaaaaggcatcagcggccaggtgcagtggctcacacctgtcatcccagcgctttgggaggccaaggtgggcagatcacctggtcaggaattgaagaccagcctggccaacatgatgaaaccccatctctactaaaaatacaaaaattagccgggtgtggtggcgcacacctgtattcccagctacttgggaggctgagacaggagaatcacttgaacctgggaggtggaggttgcagtgagccgagatcgtgccattgcactctagcctgggcaacaagagtgagactccgtctcaaaaaaaaagaaaaggcatcagcttaaagacatatttataaaaaacaaaattgtgttctggtgttgcagtcacttcgactttaacccggaatgatcattatgacagtcatattaaatatactttaaaactaagtttgatctgtacatgtctcccaaaaaggagcacagagacattgtaaggagagactctatgtccttgagaagcatttctgtgtaatggcttatttcctctgtggtcttcttttaggtgatctctctgtgggtttaaattaaagtgtaaataatctttggccgggcgcggtggctcacgcctgtaatcccagcactttgggaggcagaggcgggcggatcatgaggtcaggagatcgagaccgtcctggctaacacgatgaaaccccgtctctactaaaaatacaaaaaattagccgggcgtggtggcgggcgcctgtagtcccagctactcgggaggctgaggcaggagaatggcgtgaacctgggaggtggagcctgcagtgagccgagatcgcgccactgcactccagcctgggcgacagagcgagactccgtctcaaaaaaaaaaaacaaaaagtaaataatctttgtgctggtatacctctgttaggctgaatttggttgtgcatagaattacacttgatttttgtagtacaaagttactagttttactcagattagtagagcatagcttttttccaatatggctggaaatacttttaagtgtgcatttagttttgaaagattttatttcttatacatattttatcttctagatgttgattttattagctccttaatgatatgtctgttagcttattgttcctactttaattaaccaggattgtacatttattctgtcgacttgcatctctaacttggtaccattctcttcatcccagtacatatttttatatcacttctgggaagtgtcctgatgattgtcattcacagtgtaagttattatttatattgacagctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgaggtactgtatatacaaatgtcttcatggttttattgctgatatctgaagtccttagataactttgctaattccctgtttcagggctgttaatgcatttaaaaatctgcatccagcaattctgaatcttgaaattctctactcttcacagcttgctgatgtgtttacattatttaaccagtgatgattattgctgtcagcctatccttgatttgatacgtgatgggtattctcctaaagaattaaaatttatcagaaaaatcagtgttatgagatcatctcaatgtaaaacaaaacctgagggagaggttaaagttttctgtcagaaaaatagccttcattaatgaagataatgattttatttataaatttatggtaaaatgcagttcagtatttattttttaaaattaattccagatgtgatagtataaatgtttttttaaatgaagactaatccatatggcagcctctgatgttcttgatcatttaaaagtactagctgagcctggagttttaacgcatttctttgtgatctttatggttttggtctttattattaatatgttaaaaattacaaggtacagcggcacatggctatagtcctagctactcaggaggctgaggcaagaggatcacttgtgtccagaagttaaagttcagcctgggacaacatagcaagatccctgtttctaataaatgaatgaaaatgaatggtctaaaacttttgtttgtttttgagacagtctcactctgttgcccaggctggagtacagtagcgtgatctcggctcactgcaacctccgcctcccaggttcaggcgattctcctgcctcagcctcctgagtagctgggaccacggatgcatgtaccaccctgccagctaatttttatatttttagtagaaacaaggttttgccatgttggccaggctgctctcaaactcatggcctcaagtgatccgaccacctcagcttcccaaagttctgggattacaggtgtgagccactgtgcctggcttcacattgattttgacagaggcattcctatcatgtatttttaaaactacatgtcaataaacaaaggaggcagtttcctctccctctacccccatcccacttatttttctaaatgaatcttctcttgtgagttctctttattttgattggcccattgcattttgagattctgtttactgccctctggtggtggttacatgctgtatgtcataaatttgattctggtgtggtggctcacgcctgtaatcccagcactttgggaagtcaaggcaggaggatcacttgagcccaggagtttgagcaacatagcgagaccccgtctctacagaaaactttttttttttttttaaactcaccactatactaatgacggaaaaaattttcaaaaacttagctaggtgtggtggtacactcctgtagtcccagccactagggagactgagacaggaagattgcttgatcccaggagttcaaagctgcagtgagctatgattgttccactgcactccagcctgggtgacagaatgagaccctgtcttgaaataaataaatattccctaatccagatcaaaaaaataaataagtaaatttggttttggttggatttgtaaaagttaaattaaatagtgattacagaaatcttgaaaagtaaatttattatctgttggttttatgaaaactgagtcctaacctaaatagagacttctgttcttacattatctgagtccttcctgtgtagcataggtatggtgtgaaagacttgtgtatttcaacagataaaaacaaattgggctgggcgcagtggctcacgcctgtaattccagcactttgggaggccgaggtgggccgatcgatcatctgaggttaggagttcaagaccagcctgcccaacatggcaaaaccccatctctactaaaaatacaaaaattagccacatgtggtggtgcgtgcctgtaatcacatctacttgggaggctgaggcaggagattcgcttgaacccgggaggcggaggttgcagtgacccaagattgcaccacggtactccagcctgggtgacagagccagactccgtctgaaaacaaacaaaaaaccaaaatgcaacaaaaaaattggaaatatatatcattattagatagaagccatttaaagtccatacctaacttcttgtgtgggaaacttaatttttattatgttttctgtagactaaaaaaagtggtaaacctgggccattcttgctgtctggatccagagacaagactattaagatgtgggatgtcagtactggcatgtgccttatgaccctcgtaagtttgcataatcttaccatttcttttgcatcttcactgtttatacctttttggattaatgctttatgatatcttaaataatctgaattattctgggctttaaaataacttctttataaagatagttttcctttagcttttgttgttgttatagtgatgtgaaagttatttctctagaatgcagattctataaagaatctgtagagccagtcggtgtttgagggggagatgctgctagctcactgtatctttaaaaattgtgtaatatctcggccgggcgcggtggcttacgcctgtaatcccagcactttgggaggccgaggcgggtggatcacgaggtcaggagatcgagctaacttggggaaatcccgtctctaccaaaaaatacaaaaaattagctgggcgtggtggcgggcgcctgtagtcccagctactcgggaggctgaggcaggagaatggcgtgaacccgggaggtggagcttgcagtgagccgagattgtgccactgcactccagcctgggcgacagagtgagactccatctcaaaaaaaataaaataaaacaaatgtgtaatatctcttacggagaaaaagcagcattcttagagacctgttcactgttgaagatgtttgtttctctgtttcactttatttatatgaatccttttaactgttatacctccttgctcacatgatctagtttatttggcttatttaggagcatctgtatttccatagaaagatatgtcaatactagtaagggattgtggacattcctatgtgcctaaaggagttccaaggagatctgtggatgtttgtttagtagtagtttttataatttggcatccacatttgtttagagattttttaggtgctaatgataccttgaagtgattgtctctctgtaggatatgacagacatatgtggaagcatcttcaagaactgattagaaaatgaaactctcggccgggcacggtggctcacgcctgtaatccccgcactttgggaggccgaggcgagcagatcacgaggtcaggagattgagaccatcctggctaacatggtgaaaccccgtctctactaaaaatacaaaaaattagccgggcatcctggcgggtgcctgtagtcccagctacttgggaggctgaggcaggagaatggcgtgaacccgggaggcggagcttgcagtgaccggagatggcaccactgtactccagcctgggcgacagagcgagactccgcctcaaaaaataaataaataaataaataaaaagaaaatgaaactctcctctagtagtattctgagcggagttcagctataccatgttgctgttaagaaaagatgatatataattaaaataaagcaggccaggcgcagtggctcactcctgcaatcccagcacttttggaggctgaggcaggtggatcacctgaggtcaggagttcaggaccagcctggccaacatggtgaaaccccgtctctactaaaattacaaaaattagccgggcgtggccaggcgcggtggctcacgcctgtaatcccagcactttgggaggccgagatgggtggatcacctgaggttgggagttcgagaccagcctgaccaacatggaggaaccccatcgctgctaaaaacacaaaattagccaggcatggtggcacatgcctgtaatcccagctacttgggaaggctgaggcaggcaaatcactttaacctgggaggcggaggttgcagtgagccaagatcacgccattgtactccagcctgggcaacaagagtgaaaccatctcaaaaaaaaaaaaaaaaaaacccgggcatggtggcgcacgtctgtaatcccagctactcgggaggctgaggcttgagaatcgtttgcacctgggagacggaggttgcagtgagccgagatcgcaccattgccctccatcctgggcagtgaagtaagactctgtctccaggaaaaaaaaagaaaagaaacaagaaaaacatactcttggccaggcacagtggctcacacctgtaatcccaggactttgggaggccaaggcaggaggagcccaggagtttgagaccagcctgagcaacataacaagaccctgtctctaccaaaataaaagtttaaaaattagtcatgcatgatgatgcatgcctatagtcctagctacttgggaggctaaggcaggaggattacttgaacccaggaatttgaggctttagtgagccgtgatcatgccactatactccagcctgggcaacagagttgctgtctctttttaaaacaaaacaaaattttgcagtgctgtgctataactgcactatccagcgtggtagctactagccacatgcagctattatactcttgaaatgtggctagtgagactgaagaactgaattgttggttgtatgtaatcttaatattatatattaaagtaggcgtacatggacagtagctaccatgttcaactgtgcagttctaagcctttttctttaatgtgtagatgaatgtgctattttttataaaaatggtatcatgccccttaaggtagctttgtagcaaacctttaatttagaaagtatgtgatccttgcttatgttgttagatgctcttctacactgatctacagacaatgctttgtgaacatctttgctaactaaatctctgggcatgtccttaaagataaattgcaagaacagaactgctgcgacaggggaaatatggatggatagatggatggatgattaaatggatggatgattagatggatgaatgattggatggatggatggatggatgattggatggatggatagatggatgattggatggttggatggatagatggatgattggatggatggatggatgattggatggatggatggatggatgattggatggatggatggatggatgattggatggatggatggatggatggatgattagatggatgattagatggatgattggatggatagatagatgggtgggtgggtggatggatggatgattggatgattggatggatggatggatggatggatggatggatggatggatatatagatatatagtgaatgcctgtatatccttcacttagttaccatttgttggttttccttcatgtatgtgtgtatattttgctgaaatcatttgagcgttctttgcagacatcgtaacactttacccccaagtattttagcatgaaccacctaagaacaaggatagtatataaataaccaaaataaaattattcacactcaagaaatttaccattgatagactacatattgagatttgttcttgttatttccataatgccctgcgggacttctttttaaccctcatccaggacccagtcagggatcgtacgttatattcactcctcatgtcttatgagttttcagtttcctttaatctagaatcccctagacttttattttcttctggtcttttgatgtttttggtatgtatagttttatcgtattatgaaatagatgctatttaaacattttgccttttactgagtcaaataacttttttgtttttaaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttgggtatgtacgcctcgcgaggtctctgaacattagattttggagtgccagacaaactgtgttttacataatcgtgtggactttgccaggtaagaaatgactgtgctttcagggcagaatagagaagacatgaaaatcttgtggattcctaccatttgttttaaattctcctttcccgttaactctttccatcgttagccttataataaaaacattactttctccactgcacaacattggttttggaaaccacaatttgtgaagaggttacttaccactctgatgggtaatttttctcccctattagtttgtttctcaaacaaaatcttcctcaacctttcccactggcaggtgtatactatcagatactagaaactcagaaaattgtatttgatttgagtaaacatcctcactatcatctggacttgaatctggaatttaagagagtgaatacagtcaagtataataaatgcactaaagtataatggaccaaagcctgcgtaaggtgggctaatacctgcctcacaggattggttcaaggattaggcacaaatacggagcatttatgccatgcctggaacatcgtgttcagtaaatggatatggcgagactgtgtattgttagatttgagccctgctgtgccttagtcccagctactcaggaggctgaggctggaggattgcttgagcccaggagttctgggttacagtgtgctgtgctgatgggatgtttgcactaagtgcagcatcaatatggtgacctcctgggaacaggagactcccaggttgcctaaggaggggtgacctggcccaggtcagaaacagagcaggtcaaaactcccttgctgatcagtagtgggatcgcacctttgaacagccactgcactccagcctgggcaacatagtgagaccctgcctttgaaaaaagaagaaaaaggatttgagccccatttgggatgggccaaagaggaacaggcgtttttattgagatgttaatacaggatttgatcattgagtctcaacttccctaactgaattggcaaactagataccttcttgggttatggtatattagagaaacacgaaaactactggcatttggactttcttagaattttgtggctcattaaaaattgtatctggctcagtgtgatggagggttgggaccgggcagggtcttgctctgtcacccaggctggagtgcagtggtgcagtcatggctcgctgcagcctcgacttcccagctcaaacagttctgcatcagtctcccgagtagctgggactacaggcacacactaccatgcccggctaattttttttttaattttgtattttgtagagagggggtctcactatgtttgttgtccaggcttacgtgtgagttttaaataaaccatttctttttctttcagatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtggataagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaac

SEQ ID NO: 35680 - DNA, 91953 bp, Homo sapiens; identical to SEQ ID NO: 35679

SEQ ID NO: 35681 - DNA, 2114 bp, Homo sapiens
ctgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctagtaagggcggccgcgggggtcgcgggcaggggctgggccagcggtggggcttgtccgggtgagggcggcggggcgggggtccaagcgcctctgcggcggtgggcgggcacggtctccgcgcgggtttggaactgagtgtggtcttgcgcccagaaaactgtccagagacgttgaggtttttgcttatttgcaacctgccccccgttgttcacttttccgcggcttagttggaaggtgtagcccctgtctgtagcccacgtgacttagaataaggggctgcgttagactccttagattttaagggcggtggaggtcgctgggtcctttccaggcagggtggtggtgggcatctggcttgcgcttttattttttaatttttgattattttgaggcggagtctcatcctgtcgcccaggctggagtgcaatggctccgtcccagctcactgcagcctcccactcccgggttcaagcgattctcttgcctcagcctctcgagtagctgggattagagggcccccccaccacgtccggctaatttttgtatttttagtagagacgagtttcagtgttgcccaggctggtctcaaactcctgacctcaggtgatccacctgcctcggcctcccaaagtgctgggattacaggcgtgaacaccgcgcccgaccttgatttttgattatttgtggaaacagcgtttctctgtgtcgtccaggttggtcttgaactcctgggctcaagcgaccctcccgcctcaacctcccgaagtgctgggatcacaggcgggagccactgcgccctacctgccttcccctgcgtttttagaggcctttggcccgagctgtacgctgcagcaccttgtctgaggctgtggtctccgggccgcttgttctctctgaatctctgcagtcacacggtggctcttgcatgtgaggggtgagtcgcgcatatctggcgggggtgccagagggacttggcgtgttcattgtagtcactacaatggacagtgacaggtccactgcggctctgtccctggagagaaccaagccttagttctctgtccgccggagtgcgtagggtctccccaggccgggccgctcacaaaactgcctggtgcatcctccccagcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcagctgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactcc

SEQ ID NO: 35682 - DNA, 9243 bp, Homo sapiens
agaggcggagctccaactgacatgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaaggtaaagtcggcaggcccaggaaaccgagtgttgcgggcgtgggaggcgctacgaggtgtctggacccaaccaagtcccgggccgcggaagccacctcggtgccagcgagactgaggcgggctgggggatccgatggggtgaaagatttggaacagccaaagtgggggctcggagggcgtcaagaagcgagagagggacagggagcgttgatggtcacgcctgtaatcgcagcgctttgggaggccgaggcgggggagcgtcgcttgagcccaggagttcaagatcagcctgagcaacatagcgagactctgtctctacattttttttttaagtgagagatgactggaatggacccacgcgggggtggtgggggaatgattggaagacttatggcagaactgagtgaggggttagatttttggtgcgtggaggcttaactggtcggagtggcaggattgggattcgggcttttcctgatggtggattccaggcaagaccaagtgggaagtgaggactgcccggagtgataaaagaatgaggctgaaaaggtgggctgtgtagagggtgtgtggttaagaccaggctgggttaggatctgagagatctggggcttaggctcgcatctgttgggagagggggcagcctagttgtgaaggcaggactgaacctagaagaaatattcttacaagtagagaacaagaatacggggcccagagtgcttcagaccaaacatctgttgggagggagtgtaaatccagtggcttggaacaagctgctgagcctgctaaggaaagatgtatgggctgaactgtggggggagatttggacctccccctcccagatatagattttggggatagcccagctaccccttccccaatagattgtggggaagatgggccaagaatggaatgtactcctgtccccaccgccgcgtgattccactgggtcaggcactgagtgtccctccttgtttccccagtggggctattaataattgtaatgtgatgtaatcttaaatgggcatgtgttgcgtgctcaggccctgttctgagtgctttatgagaaagcattcctcatgagtctggatgatggttagctccattttccaagtgggaagaccagagcgtagagcaggtaagtcatctgtatttgaattcccttcttttctttcttccctccctcccctccccatcagctagttcttctggagctcaacttcttgccaaccacagggaccaagctgaccaaacagcagctaattctggcccgtgagtgtcactggggttggttgggggtgataatctgggggtcatggcaggaatggtagcactggtggttggggaagagacctcagtcacctcctgagagctcactctgtcacccacaggtgacatactggagatcggggcccaatggagcatcctacgcaaggacatcccctccttcgagcgctacatggcccagctcaaatgctactactttgattacaagtgagaatgggccctgcccccaactgggggggtggttgcatggaagctcctttatttctggagctctggctgcttgggtcctcttccttcatctgggaactcctcctggcttagttctctcctcagtggtgcagggtcagggcttggcttggaggtcctgagacttggcttgactagtcagtctccccctacccattcccacattgcaccccctctgcccagtggggctgccatcacctttcacgtgtcctggccccagccttgcccctctgactcaaacccctgtggcagccagtaggatcatgtgacactaaaatttgacactgtccataccccgctcagaacctgccgtggctcttcatggtcctcaggcacaagaccaagttctttcctgtggcttccaatgcagttccagctcacacccctctgcctgtgcctgctcatcccagccctttctctcactggactgtgagctttctaaaggcagagcttggaactgtctcagttactgctatgtccctagcactgcctaccacagggccaggcccagaacagggactcactggatatgtgttgaatataaaactgaatgatacctgcacagattaatgattgggaatttgacatcagacaaatctggctttgaaacatccagccgcttcctgattatgaggtcttgggcaaatgactttacctctctcagtttccctgttaaagtagggagtggtgattcttttatttatttatttttggagacagggtcttgctgtgttgcccaggctggagtgcagtggtgcagtcatggctcaccacagccttgacctcctgggctcaagcggtactcctaccttagcctctcaagtagctagggctacaggtgcacaccaccactcctggctcttttattttaattttttgtagagatgggggtctcgctttgttgcccaggctggtctcgaactcctggccacaagtgatcctcctgccttgggctcccagagtgttgggattacaggtgttgagtcattgcatctgactccaataactttttttttttttgagacggagtttcactcttgttgcccaggctggagtgcaatggtgcaatctcggctcaccacaacctctgcctcccgggttcaagctattctcctgcctcagtctcccaagtagctgggattacaggcatgcgccaccacgccctgctagagtccacccaggctagagtgcaacggctggatctcggtgcactgcaacctccgcctcccaggttcaagtgattctcctgcctcagcctccctcagcctcctgagtagctggtattacaggtgcccacgaccacgcccagctaatttttgtatttttagtagagatggggttttgccaggttggccaggctggtcttgaactcctgacctcaggtgatccacccgcctcggcctcccaaagtgcttggattataggcgtgagccaccgcgcccggccagtaactcttaatatagttatagctaacactttgtgtttatttgggccaggtattgttctaatcaccttacctgggttgaatcatttaattcacttaacccttgttcattcaacccatctctacgaaatggatactgtgaggccgggcatgatggcacatgcctgaaatcccagcactttgggaggctgagacaggaggatcacttgagcccaagatttccagacctgcctggccaacatggcgaaatcctgtctctacaaaaaatattgaaaaattagctgggcaggctgggcatggtggcttacacctgtaatcccagcactttgggaggccaaggtgggcggatcatgagcttaggaggttgagaccatcctggctaacacggtgaaaccctgtctctaaaagaaaaatacaaaaattagccaggtgtggtggtgggcgcctgtagtcccagctactcgggaggctgaggcaggagaatggcatgaaccgaggaggcagagcctgcagtgagccaagatcgggccactgcactccagcctgggcgacagagcaagactccgtctcaaaaaaaaaaaaaaaaaaattagctgggcatggtggtgtgcacttgtagtcccagctactttggagtctgaggtgggaggatggcttgagcgtgggaagttgaggctgcagtgagcctgggtgacagagcaagaccttgtctcggaattgaaaaaaaaaaaaagggctgggcgcagtggctcatacctgtaatccaagcactttgggaggccgaggtgggtggatcacgagatcaggagttcgagaccagcctggccagcatagtgaaaccccgtctctactaaaagtacaaaaaattagccgggcatggtggcatgtgcctgtagtcccagctacttgggaggctaaatcaggagaatcgcttgaacccggcaagcggaggttgcagtgagccaagaacgcaccattgcactccagcctgggcaacagagagagactccttctcaaaaaataaataaaaggatactatggtgatacccagtttacactttgggaaaccgaggttgtcatttcactgaagtgaggtcactcgctcttgtatgactcaatatgactcttgtaaatgacttattcatgcatctttgggacacagtttcctcatatgaaaacccaggacctgatacctcttcaggaagatgcatggggcgttgtgaggattcctggagcctggggtagagggctcgctaggcccttaaatcctccttaacctgcttccccatcccacgtccacagggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaagtgagatggcaaggggcaggggaggacctggccaaagtgggtggtgcaggggtggtcttaggagggctttcctgaaggagtggccagggttcacccatctttccacccacggacccatcctcttgtttgtccaacaaatactgagtcccagctgtgtgcctggcactgtggtaggttgtcagactgtgcagtgagccaagcaggtgaaattcatgatcttgtggtgatgacactggggtgtggaagcagatagtaagcccgaagagtgagtggcctgcgcagtctgtcagatgctgagtgctgtggagaaaaagcaggaaggagggtggagaggcagggatgggtgatatttatctcggggagtcagaaggcctcacctaaaaggtgaaattggagaaagacttgaaaagggtgaggaactggcttatgcctgtaatctcagcactttgggaggctgaggcaggaggactgcttgagcccaggagttcaaggctgcagtgtgctatgatcacaccactgtattctagcctgggtgacagtgagattctgtctctatttagaaaataaatgaataaaaacatattttttaaagaaaagggtggccgtgcacagtggctcacgcctgtaatcccagcacattgggaggccgaggcgggtggatcacctgagttcaggagttcgaaaccagcctggccaacatggtgaaaccccgtctctataaaaatacaaaaactagccaggcggatggtgggtgcctgtaatcccagctactcgggaggctgaggcaggagaatcacttgaacccaggaggtggaggttgcagtgagccaagattgtgccattgcactccagcctgggcaacaggctcaaaaaagaaaagaaaagggtaagggactgaaccctgtggacagccgggcagaggaaccagccagtccaaatgtcctgaggcagtactgtgtctgctgtgttcgaaggacagccaagaagacagtgtttttggaacaaagtgagcagggccagggcaaagccttaggacctaaggttaggaagttgttcctggagctgacatcttatgggaggatttggtcagtggggagaggatgggagagagggcagttagggcgggcagcacagttcgggcaaaggtgtacagggatgagcctgtggtggagccagcgctgtctccctcctggaaaatagatggataattggacagtagatgagataatgagatgccagcccagagcaggcttggggggagggagggagggaggaagagggggtgagagagagagagagagagtgtgtgtgtgtgtgtgtgtgtgcgcataaaccagcaagggctttctggaagagggggtacccagggcaggggtgtggctgtgtggcaaagggattacaggggcactaggagtgtgatgaggcccacacaggtaggcccctttgcagcctcctcttcattctctcttcttcccccttcccggcttctgcagtacctgatggagggcagctacaacaaagtgttcctggccaagggtaacatccccgccgagagctacaccttcttcattgacatcctgctcgacactatcaggtgcgtagcggggccgggccctgtggagtttggaaagaacttgggcttgagtcggacagctccgagtctgaatctcattccagccattggttgtctgggtaggctaggtgtgtttcttatcctcctagcacctcagctctccttttcagtgaattgggcctggtcatgggattgtggataacggctctcatctcaccacccttggctgttgacatgtgtggccacgtgtgtcaaacctgagcatggaattggttcagcaggcagggattgtgcggcctgtcttagcccatcttccgtcctagatacccatccagtgagtcatgagacttcacctccggccaccaaaactgtggaaccctcagtttctccttctctagaatgggttgaccaaatcccagcagccccttgggttgccgtgtgcacaagtgacatcccacgggcagatggatgtgacatacaaatcccttgaggagtaaaagggtgtcgaagtggtggctgagctgatgcactcgggcagagcaccaaatcagaatgagtttccatgccttaggtgcaaaggcaagcccagaggcattcgagtgaggagtggtagccagtacccactacctaccgcatggcctaagcgatattggaggcactcctccccatcactggcttttccccagagcttaccccctccctcactacagtgacttcatgccttgctctatttctacttcggtgttgttcgtggtgcctcttgatgggtacaaggaaccccctcaggatctatgaagtggggtgcagcaccctggtgatgggtgttatgagaagagatgccctcatgtgagtcccaagctgggtttcagacctgaaatcctgtggctgggagtgggattcagagtgtgggcccaggagtcagagatttcagtggggatcacccgtggcccttgcttgctttgcgagtctggtcaagtttctccccttctgagccttgatgaataaaacagggcccttcacatattcctgccatcagtgctgaactccagggtcagagctgacacatgtcaggtctggggggacaggtcctgggaggttgttgatgctcagtaatgaggagcttctcatcttcccccagggatgagatcgctgggtgcatcgagaaggcctacgagaaaatccttttcactgaggccacccggatcctcttcttcaacacacccaaaaagatgacagactacgccaagaaggtggctggggtacagggcaaggggccgtgggaccaaggggtgaagtcactaacaacagtgtggggtggcttagagggacactggaacaagactgcccaggtttaagttcaactgtgtgactctaggcaagctgccaaagctctctgacatcagtttctctatccacagaatggggctagatacatgggatgagcttagtacctggcagcagctggaggtgggcgctgcacgcatgttggctgctgtctttatcaaaatttcttagaggtggcagctttttctgcaagactttgcttcatttggtctcaggcgtttgagcacgagcaacgcttggtgttgcaggaggagggctgggaccaggctatggaaggtgaaattgggctgggtgcagtggctcccgcgcaccaaggtggatcctcccacctaggctcactctgggaggctgaggtgggaggatcgcctgaggtcaggagttcgagaccagcctggtcaacatggtgaaacctcatctctactaaaaaatacaaaaaaaattagccggatgtggtggcgggtgcctgtaatctcagctactcgggaggctgaggcaggagaattgcttgaacccaggagggtggaggttgcagtgagccgagatcacgccattgcactccagcctgggtgacagagcgagactctgtctggggaaaaaaaaaaaaaaaagaagaaggtgaaattgaattttagtgatggtgacagctggtaactgatctgtcactcaggccaaacactatcctcagtgctttaaagatgttgattcaccaaatcctcacagttgacccagagaggtgtgtaattagggtcccagtctcaacacagagaaactgaggcacagagaggtgaagttacttgtcaagggtcgttgggcagagtacgattggtgagaaaagagagcataggacacgtgggcaagtgctggccccatagggtggggatggagcctttgtgatcactctactcgtctctaatccctcctttcctgcagcgagggtgggtcctgggccccaacaactactacagttttgccagccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaagttcttatatctgaagaacttggaggttttggggcattcaggagttggagatagcctccaactgggtcagcctctgtctggtgggcattgctcagggtctcaaacatggacgcccactgtggggccccagcagcactgtggcctgcaggagggcatggccccaggtagggggactgttctagccagctgtggacacataggaatgctggaccagggtaccagattttttcaacaaagggggtgaagtgtcctactaaaaagaataaatgttggcagtgaattaaacaatttttcaaatg

SEQ ID NO: 35683 - DNA, 3300 bp, Homo sapiens
gcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccttcctcgccggcgtccgcgtccccgcgccgagctgctcgggctccctgagccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcagagggcagggtgagggccgtggcctctcaggggtatctggaaggctcttcgagttgagtgcagacccagcctgggctggaaaatggacaaaggtcatcttgctggggtgaaaagggggagagcagaaccaagaagaagagggtgagggctggggggctccagggcactggttaggaattgtggggaatgaaggctttctttagtctcatccccctgtggtaccatcttgtcctcagaggtggtttgtgctccccctactgcctatatcgacttcgcccggcagaagctagatcccaagattgctgtggctgcgcagaactgctacaaagtgactaatggggcttttactggggagatcaggtgagatcgaggtggagaggggtgtgtgggacccttccctcactttcctcgttgaggggaaagccacagggtgggctccctgctgaaccttggcttcatctcttcctttagccctggcatgatcaaagactgcggagccacgtgggtggtcctggggcactcagagagaaggcatgtctttggggagtcagatgaggttagtagccaagagagaagataagggatgtctttttccaagaaggatgtctcaccaagtctgtttctcaacagctgattgggcagaaagtggcccatgctctggcagagggactcggagtaatcgcctgcattggggagaagctagatgaaagggaagctggcatcactgagaaggttgttttcgagcagacaaaggtcatcgcaggtatctctggagaaagggacctttgagcctatccagggccacagagactcagagggtagggtcaggccctggagcctgtcttggtccccatgctgatccagaaaaggaaaaaggggagggggagtgacaatctttgcttggggcctatgacttctccagccccaaggtagatgccacctggaaatcccccaatgtccactagggggcagtaggccaccgttcttcgtactccggagaacctggctggagagctctttcttgttcacccttccctccatctgtatctctgccctgcagataacgtgaaggactggagcaaggtcgtcctggcctatgagcctgtgtgggccattggtactggcaagactgcaacaccccaacaggtaaccgggcccaggagccctgccctcatcccagcctgcctcaataggtttggacagacacagcccacatggggcaaccccttatttcaaagacacagagaccttgaacccagagacagtgacttgtccaagggcatccagtccagggcctggcttggatcagagccctggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggctttggttcccggctgaggtggagtgggctgaggactagactgagccctcggacatggaggtggggatggggcagactcatcccattcttgaccaagcccttgttctgctcccttcccaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactagg

SEQ ID NO: 35684 - DNA, 2314 bp, Homo sapiens
ttccggcgttgttgaccctatttcccgtgctgcaccgcagcccctttctcttccggttctaggcgcttcgggagccgcggcttatggtgagtgttggccgcgcggcatccgatgccatccgcgacttacgggtggcggcggggcgcgggctgcggagaggactggtgaccgaccgtgtgtctgtcgggagcaaaagctgcggggtgggaatggtgcttctaggtcctaggagggggatggcagggaaagccactttattggggaatgcagctttccgggggtaaggagttgatttcagggcatcattacctgggtttgggaggccaggactggcgtttggtcgtgcagagtaagccgagactcgtggaggctgcacattctctgcctgcaggctcattctgaccagaatggggggggcagaggtggcccagcctggcgagcccttaaccctgatctccacttttgtcttccaggtgcagacatggccaagtccaagaaccacaccacacacaaccagtgtaagttttttgggccctgcctacatcccagaccctggcaaggactggttcaggcaaactgggacagagatgaaggggcacgtttccattgtgggcctgaggctgattgatttcacccagtaataactttagggtttataggtttagagatctacttgagatacagagtgttttgcatttagtagtaagggtttcccatatctcaagtgtagctgctgtaggaagtgttggttctcccagacttgccagctgtgatgttgggtggtcttattagaggaaagttctttgttggcttaattccctttttttctcccacagcccgaaaatggcacagaaatggtatcaagaaaccccgatcacaaagatacgaatctcttaagggggtgagtgcactgaatcacatggaagtgtcttttcttggttccaggtgcacagtcaaggcctctcatgtagtttttctctagctttggcttctgcctgagcacagcctaactggcccacccaaagcctgcaattcctttttctaccctaccagacccataataaagctttccttggtctccacagcctgaagtgtaaccctctggtcagggtgtaacctgcctcctgagggcagtttggctatctcccttgcttggcagtggcacttagggtaaggagtggccttgtctgagtgcgtgcagggcacattcccacactgaccagccttatgacctccatctgacccagtgctggagttggggtcagcttctcttcctgtgtcagggggttctaaggattagctgagaaggctggagggtctaggggagagctgagcatgtccccagtctgttccttccctttacttttgctctctgttccgtggagtgaatcacaaactctgagcctcagtttccccatatcccaccttggctataagtcttttggaccagacttggtatttaattgacaccttcttctaaagaggggagggggtgtccctgaggggatgtcaggaaaaaacttggtcgaacccctgctgtaggaagttgaagccccacaaccttggcagacagggcagcaaagcagcttgtaattttgttcttgaaggaggtctgcacagcattacccaggtggcgtattggctccctggggtggtggtacactttctctggaaatagtttcaagaggttgggtatttccacatttgaggttgacttgatgctgtctttagaatgctgggtacccctatggagaggggcagcagggagagacttggggacccacatgctgccacctgtacctttcctgcttttcaggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 35685 - DNA, 17820 bp, Homo sapiens
ggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatgtgagtttcccagcctggccccgtaccgccgggtcgcaggcgcgggctgggcttccaggggacgggttggtggcagaagagaggggagagctccgcggaggacttggtcatctttttcgagttgtgctgccttccgtgagttgggaatgtggattgtaatttggggacttgagtctccaactttagtttcttaagctttaaagaaaaatccggtcgtgctggtgcttttatgaattatgcgggttttcctttgtcttcgtggggatgtgagtgctttacttctccttcctactgccgcctcccgataggtttcgcgcccctcgtccccctcgccctccgcccctaatgtatctgtacagtttcagggaacttttctccgttgcgtctcggatacaccctaccctcagtgaactacggcgctgcggaagggtccgtactgtccacccttcccccagcgtgattagagagcggagtggccccagctgcctccacgtgtctcttctcctgactctcctcttcctcccccttccagatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggtaagcagcctccctgtcctcctgacctagtcctccaggtactcactgctcttttaataaggtaggatcttacagaggacaccagcccctcccagcctcccggttggggtttttctcaggcatttctctttggttgcttcaggcctagtgggctgggaagaacctgggggtactgagatgcaggactgtcaatgctgggggttgagagctttggaaccttgtgcttgtgggctttgaagtgtgctgtgctggagagtcagctttccctgaaagagcttttctgtttgagtcatttgcttggctgcctgtcccacccctgccagccacaaaagaatcaaacccctctacctgggaggcatgggaacatggtactaaaccattggctttctagggtttgtgttgagcaatcataggctagcacaagggaaactactcagggagagagtttattggaaagggaggagagagctcattggaaagagaggaaaagagaggttgttatccacaaaactattttgacctgaccccttggccagaccaggcttcttcgttacagaggaagatgaagctcccgtgcaacccaagtcacacaggtgtgtgttgctctgttactctacattccagggtgctgcacataccagtcaacaaaatgctcttagaatgaaatcaggctgaagatatgtttcatgttccatcccccgtccagcctgcttcaggcccccctactgatgccatgaagtgccaagaattctgcaccttccaacaccagtcctacccatccctccttgccagggacatcgaggccaggccagaaaagagagcccggtcttgaggctgctgtaatgagggagacagttcccagtttgtccccgacctgcccttagctcagctctttcagggacctgttggtgtggcctgatggcatggccctgccccctggatacacacatgcgctttgcaggctttttcacctctgtcactatgagcctaagttgggaagggaaagcagggagctctgcagatccaggggccctgcactgctactctctaaggggtggtgagccaggacttctggtgtgggaaactttctgacagctcgctcttgaagggtagttatgcagaagggctggtaggccaagttttagctgtttccctcaggacctcttaggtcttctgaagatggtgagatctggttcattgagcttttgtttccagaaatcctccaggtgctacagtgaaatgcaactgagaagagcccctttgtcaggatctcagtttttctaggtaccacctgtgggcaacagtacttttttaggatggggaaggtagcattccttgggttacatatgtgtcacagccgcagagacagaacaggccaggtgcagatcagttcatctgcataccaggaagagctcttgtatttgtgaggggagggcgacatctgttgtctagcccctctgaggatccagcagaacttcagttgcagctgagggatgaggagcagggatagcattccccaggcagtctgtggatgcctctctccaccctttctccccaagaggatagtcttcacaagtagttttctctcctgcaagctccttccagcctcagcaccccctgtaggtttcctgaagcccagagtttgacccgattgcctctgcttggttatcctcagttgctactgcaaggagcagaattccatcccaaagtgaaggctgtgcctgctacatttttttggtgacctgcccatgggtgtgtgctgtgcccttgggcagataaatgtggctcacagagactagatggtaacttattttactgggccctttggtggatggcttagctgaaagaatgaccatgtcgatgtggggatatcagaactcctctgtcttgagaaacaaggagggtgaggggaggagggtcagaggtctcaacttggacatcttctcttcccaccttcagaatttaggagcttcacctttcttgttttaatccctatggacaatgttaaattagcaactggtcgtgattccagcatttcttatgactgagcacttttgagagccttaaatctctttcattttggagtctcccaaagaagcccttaggagaatgcctctggcaacactgagagccagaggcaaaaccattcaagtctctttcttaaggccagagcaatgagatgttgcttaaccatcaatctggacattttcctcccctggggaggagagaaggaataaatctccaactgatttaagcccttctatttgataggcttagaggtgtttctagaaaaggcaccagagtgcctgagttctttccccaatttccctgttaatataggatcttatatacgttctgagtcaacactgccctagggtcttgcagcaaataacaaccctagaagctcccttgctcattagagagagctctggctcaactgatggtttcccgagtaagatgcaggtagatactgtatctggggagatgtcagtcaccacttggcttgagggcagatcacctggggcctcagtccccactctgagggaatgtggagagagctcttgttggggctgactggctctgtggctctcctggagatcttataggaggaatagaagagaagaaaggaggtagggttggggggaaaaggaggttgtttaggaaacagctatcaatggctgcaaaagaacacaggacaatttgttacaatgtgtggtgtctccaactgcaactaagttctgtggccactgaggatctattgtttctagctgtttccctaggaatgaaacattgttaagagtttctatcaaggccacagcttctgcctgctagagctactgaacagaggaagatatggggacgcccagcagcccacttcccagttagagattatatctggcacctcctgagcctgcaggcctccaggaaggtgagggaagacaatggtggggtgcttcactgacagcttgaagaatatcccaccattgtctagagagcgttgcccggtgagagtatgggctgacagggatgtggcaaaggcgagacagaggagttgtgcatgtatcttgggggaggtggatggtatagctggaacgtgaaatctttggtaaagcttaagacactgtacaaattggatttatgcacagggctaatttttccctgatttggccacactgactgcttgaatatttaaatgcttttttgtaccagttgataaatggccatagtctgaatgccctaagagtcccctacaactaagggcttctcaaattggtcagtgcccagattgtactggctgttattttattttttgagataaggtcttgctgtgttgataaggcttgagtgcagtggcgcgatcttggctcaccgcagcctcgacctcctgagctcaagagatcctcccacctcaacctcttgagtagctgagaccacaggcaggtgccaccatgccaagctaatttttaaaattatctgtagaggcaaggtctccctatgttatcccagctggtcttgaactcctgggctcaaggggatcttcctgccttggcctcccaaaatgctgggatgacaaagtggttcatactacacctggccctctgctgttattttaataacaccctggcttatgggttctgagctctgcaggagtagtttgtggcccttaaaaccttagagaaggcctagatagaggtgaaaggagatagctaggccctgggagaatgcctttaagatgaagaatgagtggtaagagcactattctctctcctgcctttctgactccttagttcctgggattctttagcttatctttttttcctgggttgagaggttggggggtgatatttttcaagtggtaaaatctaagggatgtggttatccctagagttcatggtaaagccagttctcacccaaagcctgacgaagacagtttctagcatccagagagtgtctctggcatcctttcccagatggaactcacactgattggtgactcccccactgtcttctcctggcaggggtattctactattttgtcagtgccctgggcataacagcaggagctcatcgtctgtggagccaccgctcttacaaagctcggctgcccctacggctctttctgatcattgccaacacaatggcattccaggtaagaagttgtctctgctcagctgtttgtcctccacactattaatgatccggggacagaaaggagggatcagcaccagagaggagccacacctgacagccatttcactttcctctctcctgtagtcacctcaagttccagttcagtccttaagtccataaagcatgaagagacttctgagtcttggaaaagggaactggaagataattggaaaatactcctgatgtgtaggaatatttttgatcctaaggtccctgtgttgtcacacaatctggccgttgtggctcttcatcataaggggctttggcacataagccagagactgaccttagattcctgggcagacactggacaataaattcactatttaaggtaaatatcttagggaggcagagctgggaggatcactggagcccaggagtttgaagctgcagtgagccatgatatcaccactgcactccagcctgggtgacaagaccccaactttaaaaaaaaaatttcaaaagtgaataacttaggactccaccacagtgggattgaagttgatgttcccagactcgtgaactcttattttgagataatgagagcaaacacttttattgcactgactatgagcctggcactattctaagcatttgatataaagtcctcacaaaaatcttaggaaataggtactattatccccattttacagatgaggaaaccaagttacagagagattagatagaccagcccaacattgtggccctttcttgggctgccatggtggctaagtaaaacattgaggtttgttaaggcaaaaaacaaacctgggcacggtggctcacgcctgtaatctcagaactttgggaggccgaggtgggcagatcacaaggtcaggagatcaagatcatcctggctaacacagtgaaactctgtctctactaaaaatacaaaaaattagccaggcgtggtggcgggcacctgtagtcccagctacgtgggaggctgaggcaggagaatggtgtgaacctgggaggcagagcttgcagtgagctgagatcgcgccactgcactccagcctgggcaacagcaagactccatctcaaaaaaaaaaaaaaaaaagtttatagcaaagacagaatgaagggaaatggggaaagggaatgcatcatagtcattaagctgtagcaatgggcaaatgatagcatgtggcgtttggcttagcttggagcaagaggaagaaaggaaaccaacttagtggtggcaatatcccaagaacttgccacatttgcatgatcatctctgccatagcagcttataccttgaaggcttccaaagttgtcctgtggagcaaaaggaaggaagagagatattggtacattctttaagggatggaaaaagtcatgaagaagcccagaggtcgtttgaaaatgcagtcatgatcacgagttgcatgcctggccttgttattgggttgtatgagctcttttgcaaggcaccagaatggtgcaccctgcagctgcagcttatctactgattgagaccctaggacacaaggctgcctgcctcatgttccccatgcctagggattaggtaccccatgaggatcttttccaacattccttgcttaaagaattgcaatgttctcacttcttgaaactctctgagctctgtatgatttacctccgttccacccaccatataactttcaagaaacagcagttctattgctatggtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctgactatcttaattaaacccattacattcaagagatgtttattgtcctaggacagtcatagattcaaagatgattatagcctagttgcctaggtttgtttgtttgtttttgtgtttgtgtttcaacagtctttctctcttgcccaggctggagtgcagtggcacaatcatggctcactgcagccttgacttcccaggctcaagcaatccttctacctcaacctcctgagtatctgggactacaggcacacaccgccatgcctggctaattttttgtggggacaaggtctcactcactatattgcccaggccggtagcttagttcttaccttcaaaaagtttgtagcctatcggggtggagagataagccaagtatccagataaccatggcataaggcagaatattttctgtactatgagaggtacaaaggggagggagattgctcaatgggcaacaccaaggaagtgatatgaaataaatagtgttggaatccaccaacggatagaaatttttacaactatgtgtggggagagacagtgcaaacagaagaaacagaatgagctaaaacacgaagcatgttccagcaatagagtccttttgcttgaagtatagggtatgggaagaagtaagactggagagactaatgccattcttgtcgagtcctaaaagcagacttaggacttaattcaataagcaataggaagccattacatcttttgaactgcaatgtggcatagttacggacgtgctttaggaaggctgcttttagaacaagtgtaagaaaccactgagccaaagtgagaggtagggacataagttaggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaaaagagtgctgattagaaagagaaaggagcccaaaggcagatgggaaaaccagccaaggatggagagacgtctgttcattagtttgtagtttggacctcacctatcttaccaatgtggtattatgctctagtaaaaagtcagcgatggccgggcatggtggctcatgcccgtaatcccagcactttgggaggctgaggcgggaggattgctggaaagttcaggcattcgagaccagcctgggcaacatagtgagacctcatctctacaaaaaattaaaaactaaatgggcacgatggttcatgcctgtggtcccagctactcaggaggctggggtgggaggatctcttggcccaggagttcaaggctgtggtgaactaaggtcacgccactgcactccagccttggcaacagagtgagaccctgtcaaaaaaaacaaacaaaaataaataaaacaatgaacttagagtcagacaagcaattcaacatggaagaaagacagcccatcccctcccaattagtgtggaagatccatgtaggtgtggagtccccctccattgacctggtgtctggtctgtcaatgtaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtaagtcagctgtccaagtaagactacatccagtggtctgctgattaggggattaggctaggagccagaaaaactagataaatctgttttttatggctactttgtatctcagtttttccactataaaattagggggcagtatactggaaaacgcttttgagagtcaggcaacatgttttatgtaaaaatgaaaggataagaaacaaaacacaaaaaaacactgattttgattccaggttctaaaacaatttccaaatgccatgtatgctccgggcccggcggctcatgcctgtaatcccagcactttgggaggctgaggcgggcaggtcacctgaggtcaggagtttgagaccagtctggccaacacggtgaaaccctgtttctattaaaaagcaaaacaaacaaacaaaaaagaaaaccaaatgccatacatgatgagcaccttagagttttcctttctttcatcaactctgggctggactgcagtcttgcttgaggcaaggaatgcataaatagaacaatgggatcatctgagtggccagtaagcctggtgttttatgaacttcaagtatgcacacaaagtattttttatctttccactctactcagatatgccttgctttaagagtgtgccgtgccttactgtttggtgatgccattatgaagggcatcaaaataactgctggtggccctttactaccacctaccctcttgtctcctcttgtcctctatttttctctcttctacttctattctgggctaggaacatcccttcccccaacatgccttcaggaatctcccaataaagcagtgtgatcacaagttcctgctcaattctctaatgttgatcttatcttttctcttttctttcctttcattttctttcttttcttttcttttcctttcttttctaatgagacagggtctcaccatggtgcccaggctggtcttgaaccctgggctgaagtgatcctcctgcctcagcctcccaaagtatctacatttttttctctgtccctctttccaactgaatatagactttcaccaaggccctgaatgaattttccttaaatagatctggcgacctcttctttccagtaattggtgctattggtcattcaataatatctagacaaccacactactccacacatttaggcaggtcattgcctaacactcattttctttttctctttaaaaatcttcctttatattctcaaccttaaccatctttattatcttttaaattgttgttgagacagtctcactctgttgcccaggtttcagtgcagtggtgtgatcacagctcactgcagctatgacctcctgggctcaagcgatcctcggggttcagcctcccaagtaactgggattacaggtgcatgccaccatgcttggctaatttttctatttttttgtagagacatggttttgccatgttgcacaggctggtctcgaactcctgagctcaagtgatcttcctgccttggcctcccaaagtgctggaattataatagccgtgagccactgcgcctggcctactatgtttattaaaaggatttattgcctgtaatcccagcactttgggaggccgaggcgggtggatcatgaggtcaggagatcgagaccatcctggctaacaaggtgaaaccccgtctctactaaaaatacaaaaaaattagccaggcgcagtggcgggcgcctgtagtcccagctacttgggaggctgaggcaggagaatggcgtgaacccgggaagcggagcttgcagtgagccgagattccgccactgcagtccgcagtccggcctgggcgacagagcgagactccgtctcaaaaaaaaaaaaaaaaaaagatttatttgtctaggcgtggtggctcacacctgtaatcccagcactttgggaagccaaagtgggtggttcacttgaggtcaggagttagagatcagccaggccaatatggtgaacctctgtctctacttaaaaaaaaaaaaaaaaaaaagtacaaaaaacttagccaggcatggtggcacgtgcctgtagtcccagctactcaggaggctgaggcagaagaatcgcttgaacccgggaggcagaggttgcaatgagccgagattgtgccactgcactccagcctgggtgacagagactccatctcaaaaatatataataaaaataaaagcattttttttctctctttttaactttcacatatctcttttcaggcaccttcttaccattgtgcctattcttactttaacccatgattaaaataaatcatatacactgtataaatctgagattatcataggaatggagtttctggcatgagatgtttcctgtatcgcaaatggatctataatgaccttccccacctccagcctctgggtggccatgagttcaaagtggctgccaatatctgacctgttgttgttatcattcactcctccttgcctgctgctttcctcccttatcacctcaccctttgttctcctccagctctgtttcctgccaccctaatctttttgtttcttgaattacctcccccactgtcacatgctcatcttctctgccaaattaaccttctcccttgagcctttcttgggctgtctcttgctgccccagttgcaaagtcctgtcttctttctacccgttgaccctcttctttttttttcctcccttgtctctgtgtgcatctgattccattttaaatctggtaaccaaaggcctggctagtgcttacacacagcccagctgcaaaaccattaatggacattaataatcctcagtacctttattcctggcattctacccccctcctccccagttcacactgcagatcatcaggtgtcacagagagaggacataccttgaaatgccctagatgatgtcatttactttgcaggacttccttgccttgcttctgattaatgtcatgactggtctgtctgagggtactgttatctacaaagagccaaatattagctcttagtagctattctttatccatgcctgattagggtcagtattatttttggctgtggttcagaaagaagagtcctgccaagcgttggcaaactctctatctgtcgagtttccaaagctttacacgttagagaaattgctgtgaatccagaatttgtttgttttcctccctccagcaaagtgaaatgttcatcccaagagtcctcaaaatctcagaggttacagggtatttttcttcctcagagagcttctgttttatcagcacctcccccacaccagggtcaaagctcaaaaaagttggagcagcccctgggaactgcagtggctgaggacattccagcccctgggctggcctttcttctgatctttggctgcagggcccactcttttggaacctcccacccctagaggtggttccagtgtggtggggaaaggtgtgcttctttactcatttttttaagagtcatagccagagtgcttcattctgcaaggacgtgcacatgcacatgcacacagagccttgagggcagggccaagagtgaatttggaattttccaacctgatacccattcccaaaagtaggagcttctctctagtcattttatcctctgagaaactgtcagttctcctcccacaaggctcccagacagccacgggtgaccagggtctccaatcactccttaagatgcctttgactggctgggcgcagtgactcatgactgtaatcctagcactttgggtggtcaacgtgggagggttgcttgcaacatggcaagaccccgtctctacaaaaaaagtaaaataataaaagtaaagatgcctctgaggggatctgtttggttcatattaaaagagactgaattcatccattcaacaatagcgagtttctcccaggtgtgaggtaccctgctagctaactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactg

SEQ ID NO: 35686 - DNA, 238579 bp, Homo sapiens
ccacccgctggtggcccggtccgcgtgtgcgccgactctcgcactctcctcgctccgggcgcccagactctgagagagagcgacggccatcatagaacagcgaaggcagtcgatcggcctgcggtccgcttcggcattcgcaggccgcaggcgggaggctagagcccccaggcgcacctcgccccaaccgcccgcggctcgggcagctctgcagagacgtcgtggcggcagggccagcacccattggtccgccacagccctccgccctccccctcgccacgcttattggccggagcggcggcgctcgccgggtaggcggtggcggcgtccctcccttgcgccggccctcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggtaggtgcagccgcaggcggggtccgattggaggggcggcctcctcactgtcccggggctgcccgagccttgccctgcggcagctgggtaccccacggggcccgcccgaggcgtggaagggcggtggccgccggcctgcgagacgcgggggcgtccgagggagggggccaggcggggggctggcggctttgaccttcggagtctttgaggcgcgatctaggggggtctttggagtgaggggggctgagaggtccagcttttgagggtcggggcggtggggccgagcgacatgccttgggctctggatggggctgagccgcggagcgagggtcggccgcagtctggggccctgggtggggttcggaggtgtaggagaactcaggggtcgttttctgaggctttgtgggggtcagttgatgtgaggctgaggtgagccttagtatgtccagtcagggattatgggtggggctgaggggtggtctggagaaccgggccctaggcggggctcttcccccttgcaaaggccccgacactgtgtggggactaaagcgtgtgtctggcagtgggagtgcgaaagggtcacattagggtgggggtggggagggtacagggactaggagaggcagttggaaacattacccagaacagagattgtgatttagcacatggaacaagttctccgccggtgtgagttagatccctttggtgaaattgtcctgtggaggagttgtgagggttttgctcacttccaggaacgggtaaattaaatgcatttgctgctttggggaagaggcagtgattgattacctttaggtttgtgctttaggacccaagctcggatgaaatacgtgttcctcgcgaaggttagtgttacccagctttctactggaaacccccttttctcctttgccttctctggtcctgttacagtattgctccccagggcctctcgattctctctccctggttgcatagcattgcagtgtttcttgcagtgtgtgtgtgtgtgtgtgtgtgtgtgtgtgtgcgcgtgcgtgtgtgtgcgcgtgcgtgtgtatgtgtgtgtgcgcgcgcgcgcgtctcccgcccatttccctgctgctgtgcttttggcaactgcctctgctctttcccagggatggttgtggcattgcatcaggggatatttgtgcttgtaatttgctcactcagcccaggaggagggtgaatagtatgctgtagagatggggggcgggggcagggtgccgtcagcttggctgggtagacagagaaatgggtgtggtgagggaatacagctgctctaggcctttggggtaacactgcccagtcatcagcccaaagagattcaaagagcaccaccagcagctatttttataaatcaatcctgaatccaagctgagcacatggatttagagtgaacagttgtcatgctctattacaagctgggtgtttggtagacaacattaaagttgctaagcaggagactcccatctgtactgtgcagtgtgtactttacttgcaacttttaaactttgcttttctcaactccaaagattgggacatctctcttcaggctgtgtcttttaaattaacgtagtttgctgatccgtactactacttttcaaatgaaatgttttcacctcagttacacacttcctttcaaatttagcttcaaaataataaagctgtcactttttgagcacttgccatctcccaggcactagctatgtttgttaacagatgaggaaattgagactgatgggaagaagaggtcacacagatagttaagtggcaaaaatggtatccaaccaaaccaaggtctctccaacccccacatagtagttcagaaacttcagaattttggtttacattgggatgattcaagtgcttgagaatttattcatgcaaagtaaacaaactcaccagagactgataaaccagataccagttaatgcatgttggaagtattaagtgccatgtgcacaattggatttaattgtccactgaccaggacacctccattgttctgggctgcctaatcagtaataaaaaggtagttgattatggaattggaaaggcactagatattcttagtgggtattttttaaatttaaattttatttatttatttatttttgagacagggtcttgctctgtcgcccaggctggacagtggcaggatctcggctcactgcagactctacctccggagttcaagcagttctcctgccacagcctccggagtagctgggattataggcatgtgccaccacactcggctgatttttgtatttttagtagagacggggtttcgccacgttggacagactggtctcaaactcctgacctcaagtgatccgcctgctttggcctcccaaagtgccctgggattacaggtgcaagccaccatgcccggccatttatttttattttattctattttattttttaagatggagtctcgctgtgtcatccaggctggagtgcagtggcatgatcttggctcactgcaacctctgcctcccaggttcaagtgattctcctgcctcagcttcctgatagctgggattataggcacccaccaccacacctggctaatttgtgtgtgtgtgtgtgtgtgagtgtgtgtatatacgtgcacacacatacatatatacatacacatatacatatatatacacacatacatacatatacacacacatatatatatatttttttgagatggagtcttactctgttgcccaggctggagtgcagtggcacgatctcagctcactgcaaccttcgcctcctgggttcaagtgattctcctgcctcagcctccctagtggctggaactacaggcacgtgccaccacgcctggctaattttttgtatttttagtagagacagggtttcactgtgttagggtggtctctatctcctgacctcgtgttccgcctgcctcggcctcccaaagtcctgggattacaggcgtgagccaccgcgcctggctaatttttgaatttttagtaaagatggggtttcaccatgttggccaggctggtcttgaactcctgacctcagatgatccacctacctcggcctcccagagtgttgggattacaggcatgagccatcacgcctggccttacgggtattttaatcaaggaacaaaagtctagtgagtctccctttccccagtgtaaaaacacatacagtgctggaggatgtcttaacacattttcctactctgtctcacttgttttttaagtagtctcttcaaatatttgtcattccagcatccctttgttaaaattttcaaatttacaaatacatttatattacctattaaaaagtcattttccattgtttgctgacagtgaaggaagcacctggattttcttatatataggcggcttagctttagtcagagagtagattcttcctaatctcatagtgtcttgttcttcctaatctcatagtgtcttgttctttcctaatcttgtttctgaatttggtgatcaatcctttggctctgtaaacttttgctcttgacagtttttggaatcactttgcttttttttttttttttttttaaagattaagcgtgagtagttgctatgtagcttttagatttccttaagatgtgagaaaatctgagaggaacattttgacccagtggaaggcatcttggcagttcatgtatatagtcaatttgaaaaggaaaccaagtaagtatcagtgatttcactttgtctttctaaacagcacttttagaaccaggttattgtagacttattgctaggagtgagtgggttgagaacaattaaggttaagaagggggattgtagggctgggtggctcatgcctgtaattccagcactttgggagcctgaggcggaggattgcttgaggccagaagtttgataccagcctggataacatagtgagaccctgtctccattaaaaaaaaaacaaaaacaacttagtcggtccccagataattttagtgtacagcaaaacaacaaaaacaacaacaacaaacttagctaggtgtggtggcatgtgtctatagtcccagctactctggaggctggggtgggaggatcactggagcccaggagttcaaggctccagtgatatgattgtgccactgcacttcagccttgctgaaagagccagacctgctcacccctgcaaaaaaaaaaaaaaggggtaataaagcacactgatacatataggggatcatattcatcatactcatctaccattttagagctcctaggccagtctttaaatgcagaccttatggtgaactattttggatgtcattaacattttaaggttgaaagtcaacacaattactttcgtgattctttttccttttttttttttttttttagagatgagatcatgttctgtcagcagtgggggagatcatagctcactgcagccttgaacttctggcctcaagtgatcctcctgcctcagcctccccagtagttcagactgtgtatgtgcaccatcacacctggctaacttttgtgattcttgttcttattcttttttttttttttttgagactgagtctcgctgtattcccaggctggagtacagtggcgcgatctcagctcaccacaacctccacctcccgggttcaagcaattctcctgcctcagcctcctgagtagctgggattacaggcactcccgctgcgaccagctattgtgattatttataggttaaaaaagttaatcttcttggcttgggcatgatggctcatgcctgtaatcccagcactttgggaggccgaggcagggggatcacttgaggtcaggagttcgagaccagcctggccaacatggtgaaaccctgtctctactaaaatacaaaaattagctggcatggtggcaagcgcctgtaatcccagctactcgcgaggctgagacaggagaatcacttgaatctgggaggcacaggttgcagggagccaagatcacgccactgcactccagcctgggcaacaagagtggaactccatctcaaaaaaaaaaagttaatcttactgtaaactaatattttattagtttgcatatatttaaatatgtttaaaaatttatttatgctgggtgcggtggctcatgcctgtaatcccagcactttgggaggctgaggtgggcagatcaagaggtcaggagttcgagaccagcctggccaacatggtaaaaaccccgtctctactaaaaatacaaaaattagctgggcctggtggcgggcgcctgtaatcccagctactcgggaagctgaggcaggagaatcacttgaacccgggaggcagaggttgcagtgagccgagactgcaccattgcactccagcctgggctacagcgagactgtctcaaaaaataaatttttttatttataactttcctcacttctttttatatggaaaatagtttaaaactccttttaaataatttcaggtttacagaagagttgtaaaggtagtacagactttctatatacattctgtattcattccatttctcttagcgttaacattttatataacctgatacccttatcaaaattaagaaattagcattagtggaatattattgagcaaactacagactttcctctgattttcctgtgttttccactgatgtccttttcctgttacaggatccaatccaggataccacattgcatttagatgtcacaattctttagtttcttccaataggtgacagtttcttagtctctccttccctatctttccttgacacctttaaagatgagtggtcatgcatttgtagaatggttctcattttgggttttctggtgctttctcatgattagcccgaggttatgcattttggggaaaaataccatagagatggtttacccttcttgtcacatcatatctgggaatacctgatatcaacatgactcgttactgattaacttttttttttttttttttttttgagacaaagtcttgctctgttgcccaggctggagtgcagtagcatgatcttggctcacggcaacctctgcctacccaattcaagtgatttttgtgccttagcctcccaagtagctgggaccacaggcacgtgccaccacacctaatttttgtatttttagtaaaggcagggttttgccatgttgcccaggctggtcttgaactcctggcctcatgcagtccaccggcctcatcctccgaaaatgctaggatagcaggcatgagccattgtgccttgttaactttgataacttgattaaagtgatgttctgcactgtaaagtgactgttgttctgctttttaattttacttgatagaacctagaaatgagtcaccaagtcatatccatattctgggggaagggaattaagctccaacccctgaagggaggagtatcaaagaatttgtgggcatgttaaaattcctaaagtaattagttaatattttggggaagataactgtgaggttatacagaatctgatttctccttaaaaatttcctctacttattttagcattcattagtgaatcttgcctgcggcagcgttgattatattattctgttggttttctatttttctaattctttctacttttatgatttggaatccttttgtaaggaagatttatgcctcccccatttatttattaaatcatttatgtcaacatggacccatgaatatttttttctttgcttataatccagtactgtattttgttgctcaagttgttccagctttggccattctaacattggcacctatgttcttttgaaatacctttccctacctttctttgtcttttagcacttttgtacttcctggcactgtaagatgccccagtctcatcttgtactttacctgccccaaccctaaaatcagccatttctccaaggtgtcctggttccttctgttggagaagagtatttggaaaccactatctggtttctaaatgagcttgatgcactcattactgctagggtatcactgcttctaggccctctcaggggatagttaggaagtaatatatatatatactgacccacacatatcttcgtttacttccgtatctgtctgtatataaatataaacatgagtttatactgatatctctgatgctgatccagcaccacagagttcattctagcattctcttccttgcttctttctctgaaagtgagaaatttggctgatttaatgaataatacatgctaattttttcaactctaatatatatatgaagtaaaaaatagtcttaattgtcatataaagtaaatttccaaagcattttgcagttgttaactaatttaaattatactcctataatattggtattttaaattactgtttttcagctcaggtagagagatgaaatcatttacccttggccaaacaggaagtgagtgattgtatctagaattgaagatttattatttatttatttatttatttattttatttatttattttttttgagatggagtctcgctgtttcccaggctggagttcagtggcgcaatctcggctcactgcaagctgcgcctccggggttcacaccattctcctgcctcagcctcctgagtagctgggactacaggcgcctgccaccactcccggctaatgttttttctgttttttgagatggagtctcgctctgtcgcctgggctggagtgcagtggcatgatctcggctcactgaaagctctgcctcccgggttcacgccattctcctgcctcagcctctttagtagctgggaatacaggagcccgccaccacgcctggctaattttttgtatttttagtagagacggggtttcaccgtgttagccaggatggtctctatctcctgacttcgtgatctgcccaccttggcctcccaaagtgctcggattacaggcgtgagccagggcgcccggccaactggctaattttttgtatttttttagtagagacagagtttccccatgttagccaggatggtctcgatctcctgacctcgtgatccgcctgcctcagcctcccaaagtgctgggattacaggcttgagccactgcacccggcctatttatttattttttaagagacagagtcttgctatgttgctcaggccggtcttgaattcctggcctcaagcaatcctcctacctcagcctcccaaagttctgggattataggtgtgagccactgttcctggccaaatgacctattctcactcccagtgctatacttgatcctaaggaaagcagtctcattatcttgactaacaaatcaacctttgtcttcttgatgggattgttccttttaattaaagaagttcctggtatttagcttttttaaaaaaaatactttcagcagtattgagagcaaaaacaattctttttctggacttcttcctcctcgtagaatcatagaagagatttagagataatctagacaaatgtttcacataataggtgattcctccagttctctatgcaggtatttcccaagataagtacttcacagctggttgctaccaattccaggtttgcagatttgtcattttagaaagattttccggataatgattgtagatctgcctccctgcagtttctcttcagtggtcctaatttttctgtctacagttattccctgtagctctaatctcaactttgcacctattcaatgacagttattttgtcccacctttttcttttccacactagtggcttttcccccagctacctctcgtgaaatgtgctttctaagccttttattattgtcagaagacaaagttacaacaaatttatttatagatttttttttttttttgagacggagtctcactcttttgcccaggccggagtgtagtggcactatctcggctcactgcaagctccgcctcccgggttcacgccatgctcctgcctcagcctcccgagtagctgggactacaagtacctgccaccgtgcccagctaattttttgtattattagtagagacggtgtttcactttgttagccaggatgctctcgatctcctgacctcttgatccgcccgccttggcctcccaaagtgctgggattacaggtgtgagccaccgcacccggctttttttttctttttaagatggagtcttgctgtgtcacccaggctggaatgcagtggtgtgatctcggctcactgcaacctctgcctcctgggttcaggcgatcctcctgcctcagcctcccaagtagttgggagtacaggtgcacaccaccaggccccagctaatttttgtatttttagtagagatggggttttgccatattgaccaggctggtcttgaactcctgacctcaagtgatgcgcccaccttggcctgccaaagtgctgggattacagacgtgagccactgcacccagctccagccttgaaattcttaatcagatataggttgagtatccattatttgaaatatgagaccagaattgttcatattttggattttttggattttggaatatctgtagtatacagatattccaaaatgctctctagtgagcatttcctttgacatcaaaaagtattagattttggagcatttcagatttcggatttttgtgtgttttttgagacagggtctcgctctgttgccagagtttagtggcataatcacagctcacttcagccttgaacttctgggctcaggtgatcctcctgcctcagcctcttgagtagctggaattataggcacgtgccaccatgcccagccaatttttgtattgtttgtagagacagcgtttcaccatgttgcccaggctggtctcaaactcctaggctcaagtgatcttttcacctcagcctcctaacatgctgaggatttcatgcatgagccactacacccagcccaggattgagatttttggatttgggatgctcagcatataattcacttgggttagcccactttctcttttaggaatagaaatccactagtaggactctggagagctctcagtcattttcttatgggaagaacatatttttattgaaataatttgaatttgggtagtgagtgtgttgctttgggtgacaagtgatttctcagtttaggaaggattgggagcagagaaagtgggggataaggcagatttacaggcttagttctctacatatcagctcaagtttcacctttagaaggtcattcacggcccctttctaccctactctttgatgttttccccaatgtatatctttgggcatatgtcattccacatttaaaaaagttgatacataattcacatatcgtaaaactcaccattttaaagcatacaatttggggtaggcatggtagctcatgcctgtaatcccagcagtttgggaggctgaggtgggaggattgcttgagcccaggagtttgagaccagcatgggcaacatagcatggcaaccctgtctctaccaaaaaaaaaaaaaaaaaaaaaattagccaggcatggtggtgcacacctgtagtcccagactcttgggaggctgaggtgggaggatcattcacttgagccaaagaatttgagattgcagtgagccatgatcgtgcactctagcctgggccacagagcaagaccctgtcaaaacaaaacaaaacaaaatcatagaattcagtggtttttggtgtattcacaatgttgtgcaactaccaccattatctaagtccagaacattttcattacccccaaaagaaacctcatacccgttagcagtctcttccattcccttcattcacccagcctctggcaaccactaatcatcttcctgtctgttctggacattccatattaatggaatcatacaataaatggcctttctgtgtttggcttctttcatttagcataatgcttttaggttcatccatgttgtagcatgtatcatttcattcatttttatggctgaataatattacattacatggatataatgcattttgtttatgcattcatccattgatgaacatttgggttgcattttttagctattatgaataatgctctgtgaagattgatatgcttttatatggacatttatttttgtctaaatacctagaaggagaattgcttggttatgtgttaattatgtttaaccttttaaaaaattatttatcgccaggcgtggtggcacatgcctgtaatcctagcattttgggaggctgaggagggtggactgcttgagcccagcaattcaagaccagcctggggcaggcaatatggtgagaccctgtctctataaaaaaaaaaaaattaaaaccagaaaattatttttttcttctctttctttctttcttttttttttttttgagactgagtttcgttcttgttgcccaggctggagtgcaatggcacgatctcagctcatggcaacctccgcctcccgggttcaagtgattcgattctcctgcctcagcctcctgagtagctgggattacaggcatgtgccaccatgcccggctaattttgtatttttagtagagtggggtttctccatgttggtgaggctgggctcgaactcccaacctcaggtgatctgcccacctccgcctcccaaagtgctgggattacaggcgtgagccaccgtgcctggctttcttttcttttttgagacaagatcttgctctgtcactcaggctagagtgcagtgatgcgatcatgattcactgcagccttgacctccagggctcaggtgattcttccacctcagccttctggatagctggcattgtaggtgtgtgccaccacacctggataattaaaaaaaacaattttaattagagatggggtctccttatattgcccagtgaactcctgggctgaagcaatcctcttgcttggccacccaaagtgctgggattacaggtgtgagccaccatgcctgactgatagtatcttttgaaacacaaaagttttaaattttgatgaagtccagtttatctagttttttcttggttgcttgtgctataggtgtcacatctaagaaacgattgcctaatttaaggtgataaagatttctcttttgtttgtttttttcattcgtttgttctttcgttcgttcgttctttcttctttccgagacagggtctctgtcttttgtccaggctggagtgcagtggcatgatatctgcccactgcagcctccacctctcaggctcaagctatccttccacctcagtctcctgagtaggtaggactacaggtgtgcaccatgatgcttggctaattttggtaacctttttttttttttttttaagatgtagtctcgttctgtcacccaggctggagtgcagtggtgcgatctctgctcactgtaagctccacctcccgggttcatgccattctcctgcctcagcctcccaagtagctgggactacaggtgcccaccaccatgcccggctaattttttttttttgtatttttagtagagatgaagtttcaccatgttagccagaatggtcttgatctcctgacctcatgatctgcccacctcgggctcccaaagtgctaggattacaggcgtgagccactgcgcccggctgagatgtggtcttactatgttgtccaggctgatctcgaactcctgggctcaagtgatccgctttccttgcctcccaaaatgctgggattataggtgtaatttatgtttctttaaataattttatagttttagctgttgtatttagttttttttttatcaatttcaaattaatttttatacatgatgtgtgaggtaggaatccaaaatctttttctttgtttcttttttttttttttttttgagatggagtttcactctgtcgcccaggctgaagtgcaatgacgtgatctcggctcactgcagcctccacctcccgggttcaagcgattctcctgcctcagcctcccaagtagctgggattacaggtgcccgctaccacacccagctaatttttgtatttttagtagagactggggtttcaccatgttggccaggctggtctcgaactcctgacctcgggtgattcacctgctttagcctcccaaagtgctgggattacaggcgtgaaccactgcgcccggcccaaaatctttttcatttgttttttttggtgtgtggatatctagttgtccttgaaccagttgttgaaaagacttctttttccattgaattgtgtatcatcttagcatccatgttttgagtcaattgaccacagaggtgtgggcttatttctggactttctttttttttgagacagtcttgctccgttgcccaggctggagtgcagtggcgtgatcgcagctcactgtaacctctctgccttccaggttcaagcaattctcctgcctctgcgtcttgagtagctgggattacaggcatgcaccaccacacccagctaatttttatatttttggtagagacggggtttcaccattttggtcagacgggtcttgaactcctgacctcaagtgatccgcctgactcggcctcccaaagttctgggattacaggtgtgagccaccgtgcccggcctggactttcaattctattgcattggtgtacgtctatgccagtaccatcatgcttgctttcttgtattttcaccctgtggtactactatctgctactatctgcataaatatgctgtcttgattaatgtacttttgtaatatgttttgaaattaggaagtgtgagttttctaattttgtttttttgaagattgttttggctattctggatccttggcatttccatttgagctttaggattaacttggcaacttttgcagaaaaggcagttggaattttgatagggaatgccttaaatctgtagatcaatttagagagtgctgccatcttaacaatgtcagatcttccacttcatgaacgtgggatgcctttccatttgtttatgtctttaatttctttcaagaatattttttaagctgagtgtggtggtggctgacacctgtaatcccagcactttgggaggctgaggtgagaagattgcttgagcccaggagttcgagaccagtctggccgacatatcacacacacacacacacacacacacacacacacacacacacacacacacaattagctggatgtggtggcttgcccctgtaatcctagctactcatcagggtgaggataaggtgggaggatcccttcagcccaggacgtcgatctgtgatcctgccattgcaatccagcatgggcaacagagtgagcctctgtctcaaaaaaaaaaaaaaaaaaaaaagtgtgtgtatatatatatataatgtattttgtagtttttttttcttttattattatacttacaagttctagggtacatgggcacaatgtgcaggtttgttacatatgtatacatgtgccatgttggtgtgctgcacccattaactcatcatttacattaggtataactcctaatgctttccctcccccctccccccaccccatgacaggccctagtgtgtgacgttccccaccctgtgtccaggtgttctcattgttcaattcccacctatgagtgagaacatgcggtgtttggttttctgtccttgtgatagtttgctcagaatgatggtttccagcttcatccatgtccctacaaaggacatgaactcatccttttttatggctgcatagtgttccatggtgtatatgtgccacattttcttagtccagtctatcattgatggacatttgggttggttccaagtctttgctattgtgaatagtgccgcagtaaacatacatgtgcatgtgtctttaaaagacacatgatttataatcttttgggtatatgcccagtaatgggatcgctgggtcaaatggtatttctagttctagatccttgaggaatcgccacactgtagtccacaatggttgaactagttttacagtcccaccaacagtgtaaaagagttcctatttctccacatcctctccagctattttgtagtttttagtgtacaagtcttttactttaaatttattccttagtattttattccttttgatgctattgaaaatggaattattttcttatttcattttgtgttgttgattgctggtatagagaaataaaagatttttatagatctggtattctgtggccttgctgaactttttttttcttcttttttttttttgaaatggagttttgcttttatcacccaaactggagtgcaatggagcgatctcggctctccgcaacctccgcctcctgggttcaagcgattctcctgcctcagcctcccaagtagctgtgattacaggcatgtgccaccatgcctggctaattttgtatttttagtagagtcggggtttctccatcttggtcaggctgatctcatactcccgacctcaggtgatcccacccgcctcagcttccctaagtgctgggattacaggtgtgagccaccgcacccggctgaacttgtttactaatgctaatttgtgtgtgtgtgtgtgtgtgtgtgtgtgtgtgtgtgtgtgtgtgtgtgtgtgtattcctttggatttccatattgttttaaaattatgattattttttgagatggagcctctctgttgcccaggctggagtgcagtggcacaatctctgctcactgtaacctctgcttcccaggttcaaatgattctcctgcctcagcctcctgagtaggtgggattacgggcatgtgccaccatttttagtagacagggtttcaccatgttggccaggctcgtctccaactcctgacctcaagtgatccaccagcttcagcctcccaaagtgctgggattacaggcgtgagccactgcacttggcctaaaattaaatatatcttgtcactggcctgagagtcccttgaagtcagagaccatacttcatttcttgtttctctttctctactggcaaatgtatgttcaattgatgctgcagtcaggtgctacagtagtgggacttagcggagcataatgccactaatgacttggaaaatggcacagaagggaagtgggatattgtaaaactatttttacctattataaaatgcttcctgaggtccaggaaaggcaattctcacgtttgtctctgctcttctataccttttgcccctaattatcctttgtttctggaactcagaatactaaggatcataaagttaggcatttaagaataggaacattaatttgattttatatattatttccctagggaaatgtgttctggcctcattaaaaaaatagttttttcatgaatttataatttatttttttgggacagagtctcactctgttgcccaggctggagtgcagtggcgccttcttggctcactgcagcctctgcttcctgggttcaagtgattctcctgtctcaccctcccaagtagctgggactacaggcacacgctgccacacccaggtaatttttgtagagacgcagttttgccatgttggccaggctggtcttgtgaatgcctgacctcaagtgatccgcccacctcggcctcccaaagtgctgggattacaggcatgagccagcgtgcctggccaaatttattattagtagtagtagtagtatttttgagatggagtttccatcccaggctggagtgaagtgacatgatcttggctcactgcaacttccgcctcctgggttcaagtgattctcctgcatcagcctcccgagtagctgggattataggcgcatgtcaccatgcctggctaatgtttatgtttttagtagccaggctggtctcgaactcctgacctcaagcgatccacctgcctgggcctcccaaaatgctagggttacagacgtgagccactgctcctggcctcattaatttatttatttttattttttatttttttgagaccaagtctaactctgttgcctaggctggagtgaagtggcgcgatcttggctcgctgcaacctctgcctcctgggttcaagcaattctcctgctttagcctcccgagtatctgggactacaggtacgcaccaccacaccctgctaatggggtttcaccacattagcccagccagtctcgagctcctgacctctagtgatctacctgccttggcctcccaaagtgctggagttacaggtgtgagcgactgcacccggctacttttttcatgaatttagaagtatttatcgtaatgattggctatgttcattgttaattctgtgttcagattttttctcttttctttttttcttgagatgggtctcagtccattgcccaggctctggagtgtggtttggcatcatggctcattgcagccttgaccttctggtttcaggtgatcctcccaacttcagccttatgggtatctgggactgcaggcgtgtgccaccacacctggctgattttttttggtattttttttgtagagacagggtttcactatgttgcccaggctggtctcgaactcctgagctcgagcgatctgcccatcttggcctcccagagttctgggattacagctgtgagccaccgtgcctggccctcagatttcttcttgagtaaactcaagcttacttattttcctttccctcttattcactaagttacagagacatgggggtaacaaaccatttgcagttaaagggcagtatctgacccatttgtttgttatatttttgtctgccctttattacgagacatggagaaatgctttttaaaagcacactgtacttcaaaaaggggtagttcctttttacttcattttatttatttttttgagacaaggtcccactctgtcacccaggctggagtgcagtggtgtgatcactgctccctgtagccttgacctcccaggctccagtgatcctcctgccttagcctaccaagttgataggactacaggcgctcaccaccatatggacctggacctggctaagtttttgcttttttttttttttttcctgtagagacgagatctcactatgttgcccaggctggtctcttaactcctggcctcaagtgatcctcctgtctctgcctcccaaagtgctgggattacaggtgtgagccaccacacctggcccacagttcccttttaataagaaaatactaaaaatttttttaaaagaatgtattggtgggtccacacttccaacctgttctacaaaaacacaaaatagggccaggtacagtggtttacacctggaatcccagcacttcggataccaaggatgggaggattgcttgaggccaggagttcaagaccagcctaagcagcatagtgagaccccatttgtacaaaaagtaaaaaattaaaaaaaactcagaacagataaagaagatgaaattaccacaaagaaagcaaaaaaggccaagagtaaaattaaaattgaagaagatggagaagaaggaaaagtagtagtggtagaagaagaggtctctgtgaagaagaagaaggataaaaagaaaccgtggttgggcatggtggctcacacttgtaatcccagcactttgggaggctgaggtgggaggatcacttgaggccaggagttcaaaacaagcctggttaagtagcacctgaggagggagaaaaaaaaagaaaaaagagactatcctggccaacatagcaagaccccatctctgaaaaaaaaaaagttaaaaaaaattatctagccatggtggtgtctgtagtcccagctactcagcaggctaaggcaggaggcttacttgagcccaggagtttgaggttacagtgagctatgatcgtgccactacattctagcctgggtaatggagtgagaccctgtctcagaaaaaaaattttttttcactaatattgctagtttaataggttaaaaaaagggataatctcacacttttaatcacatctgattttcttaaaacaataacatcagtattgcatggtcatatatctgataattaaaggtaagtttgggtcaccgataatgaggttctctgatatagccagttgctttagtactcaaccaatttagtatgttccattttagcaagttctcttgggctgagtatattttaagagtgtcagtggctacccagacagttgttctttatcaagctaaaataagataacaataatagggacaaaaaaatgtttgaaagatattctgaataactttgtgtgctcagtatagctgagacttgctgagatgcttcagaggcaaaccagtcagcctatttcatcagccagaggtggggtgcctttcaacagtgtgttgtctaaaagtctaaggtagacttgcccaaattaacaaactttgcaattatcagtgacaggcaactatagtatggcagtaatagcactggactgagtgtcaaaagaccaaggttcaggtttcatctgtaccacataataactgtgaggtctggggcagatcagtctatctgtttccttatttataaaatcaaggttgtgagaattaagggcttcgtgactgggatgggtgaccttcagaatgctagtaagacactgtctagtgatacaaatcagaaaataatttttgtgtatatggaattggtgaagcattgatgttttcaatggaaattacattccctgtaagtttcattgggttatatagatggcaaattggctgtgaaatatgaaactcatggacttactggaaccactttgagtcccagaataattctgccttctcctaaggtcatttactaagttgtagctgagtcagaatttgaactttaatctctagcattctttctactgtgttcaatttaataccacggatatttatataccttctaggtgcatacactgtggtaagtgctgtaggtgattttttaaaaagtaaaatagaagaaacaatacacactgactttaaaacactgactttattattaaaagtgtcatgatacacactgtaaatgctatacatattgtgcataggtatgaatgactaagtggatttaaatgaatgtcttaggagcctggcatggtgaactgtacccatagtcccagcttctttgagacggacgctctgttgcccaggctggagtgcagtggtgcgatcttggctcactgcaacctccacttcctgggttcaagcgattctcctgcctctgccttccgagtagctgggattacaggcgcctgccaccacacctggctaattttttgtatttttagtagagatgggatttcaccgtgttggccgggctggtctggaactcctcgtgatccgcccgccttggcctccctaagggctgggattacaggcgtgagccaccacacctggccagtcccagcttcttgagaagcagaggcgggagaatcacttgagccttggagttcaagtacaacctggacaacatagtgagatcctacctctaaaatataaataaataaaataaatgccttaaggagatcatggtgctttgttgaattgactcacagccaaggattcagttaattttcattagtttttaattagtagagctggatgtttattacttaaatattcctttttttttttttttttttgagacagaatcttgctctgttacccaggttggagtgcagtggcacgatcttggctcattgcagcctctgcctcctgggctcaaatgatcttcccacctcagcctcctgagtagctgggattacaggtgtgtggcaccatgcctggctaatttttgtattttttgtatagatggggtttcaccatgttgtccaggctagtcttgaactcctgagctcaagtgatctgcctacctcagcctcccaaagtgctgggattacaggtatgagccatcacacctggtccttaaatattatttaaaatagtttttaaaaaaatgcttctctgggccagttgcagtggctcacgcctgtaatcccagcactttgggaggccaaggcaggtggattgcttgaggccaggagttcaaaaccagccttgccaacagggcaaaaccccatctctactaaaaatacagaaatcagccggccatggtggtgcatgcctataatcccagctactcgggaggctaaggcaggagaatcgcttgaacccaggaagcagaggttgcagtgagccgagattgtgccaccgcactccagcctgggtggcagagtgagactctgtctggggatttaaaaaaaaaaaaaaaaaaggtttctcttgttaactttgagacagtaacggggaggtggtattattcaggtagtcagaagcataaatgcccagaccgcctctatatttttaaacctaagaaagtgaaacccctgtctctacaaaacatgtaaaaattagctgtgcactgtggcttgtgcctgtagtcctagctactctgggaggctcaggtggtagaattacatgagcccagcagatagaggctgcagtaagccatgattgcaccactgcaatccagcttggcgcaatcacgccaaaaaaaatttaaaaatataaatgaaaatacaggggaacataatattccagacctttagtattgtgttgaggtttttttttcccctctactgtaaaatgagagtgttcagttttaagaggcacattttcggagcatggatagagtctttccaggagaaaacagtctgtctggtgatggagtaattaaaatgatttgagacattatttaaggaattagaggctgggcgcggtggctcacgcttgtgatctcagcactttgggaggctaaggtgggcggattaccaggtcagaagatcgagaccatcctggctagcatggtgaaaccccatctctactgaaaatacaaaaaattagccgggcgtggtgatgggcgcttgtggtcccagctgctcaggaggctgaggcaggagaatggtgtgaacctgggaggcggagcttgcagtgagccgagatcgtaccactgctctccagcctgggcgacagagcgagactccgtctcaaaaaaaaaaaaaaaaaaaaaaaaaaaaaaaaaaaaggaattagagatgtttcatttagagaataaagaggtggggacagctattttcaaatacagttgtccctcggtattcatgggagattggttctcagacctcctgcagataagaaaatctgaggatgataaggtcccatatataaaatgatgtacctctgcatgtcctgcgatatacttggcgcacgcctgtaatcccagctacttaggaggttcaggcacgagaatcacttgaacccgggtagcagaggttgcagtgagcggagattgcgcctctgcactccagcctgggaggcagagtgaaactgtgtctcaaaaaataaaataaaataaaaaatatatatatgtgatggctgaatccaaggatgtggaacctgtggctttggagggctaactatatatcaaagatctggcaagtggaataggcattagatttagtattttgttgctttgacaaaagaacaaggaccatcaagtagaagttaaagagaaaaatggaatgtaactttcttataagatagtgagtttcctcatgttaaagtaagatactgagtttaacttatgttaaaacagagccagggtatttagagatactggggaggaagttaagttgaatgacctttaatgtttttgtaaataaatggttcttaatttcatgagtatatatccccttgagaatctaaccaacagcaaagaccctgtccccagaaaacttctacggatatactatataggtatatattttctttcatccttgaaaactacttttttggggggcatagtattgtatgtttgtttgtatgtttattagtattgcattttattttctttcagtttattgaatttatcgtttctttttttgttgtttttgtagagatggggtcttactatgttgcccatgcttgtctcaaactcctggactcaagcaatcctcccacctcagccttccaaagtgctggaattacaggtgtgagccaccctgtccagccttgaacttatcattccattatcttctggcttacattgttgcttgagaagttagccttggtgttaatatctgtcaggtactctgtggcatcactagttttttatttcctcaaactgcatgacttgacagtcattggcttatccagattataagaaactaagatgccagtgcatacagggattcctcgtggctatgatttctcaggaattttttattcttttgatttgctcaacaccaaggcaggcttctatatagtccgctagggatagtgaaaaatttggggcttggtttagattggagaggtatatggtggggtgtcttataaggcttaactttgggagggcccagggccttgatttctgtcccccttgccttgtgtggcctttgaattgaaagctttggattaggccttcatagattttagtgtgcatacaaatcacatgatctttttataaggcagattctgattctgaaggtttagtgtgggacccaagattttgcatttctgatctataaggtgatgctaatcctgttggtctacagatgacactttaagttgtaaggagttagattgctatgtttgagatgtgagtggtattagtaatgttagtcatggttatgaggtggtacagtagtatataaagaatgaagatcattccattgtgcagaggttcttttttaaaattaatagacttttcttttttttaagagacagtgtcttgctttgttacccaagttggagtgcagtggcacgatcataactcactgcagcctggaacttctgggttcaagcagtcctcctgcctcagcctccacagtagatgggactacacgtgcacactaccaaggctggcaattttttttctttttttgtagagatgggtactttctatatagtggagctgaaaatttttcattgcctagtgatgtaatgcttggcataacaccttagtttttctgtttttagatatgtttagatacacagatgcttaccattgtgttacaactgcctgcagtattcagtagttacatgctgtacaggtttgtagcctaggagcaacagattataccatatagcctagatgtgtagcaggctgtaccatctaggtttgtttagtacactctatgacagttgcacaatgatgaagtcacctaacacatttcttagaatgtattcccattgttaagtgatgcatgactgtctaattgtaaccacccaacggggtcaccttgcccgctggctcaacagaacctatttatcaagatgggaattacagtagagaaagagtaattcaagcagaactgactgtgtgggagaccagagttttattattacttaaatcagtctgtccgagaatttgtgaattggagttttaaaggataattttgtgggtaggggaccagtgagtcaggagttctgattgattgggttggagatgaaatcataggtagttgaagctgtcctcttgtgctgagtcagttcctgggtgggggccacaagacaagataggccagtttatatcagtctgggtggtgccagctaatccattgaatatagggtctgcaaaatatctcaaacacgatcttgggttttacaataatgatgttatccccaggagtaatttagggaggtttagaatcttgcagcctctagctgcatgactcctaaaccatgatttctaatcttgttagaatttgttagtcctgcaaaggcagtctagtccccagccaggaagggggtttgttctgggaaaactaacctaaactgtaaactaagttcctcccaaacaaagttagtttgggctaagtctaggaatgaacaaggacagctgggaggttagaagcaggatggagttggttagatcagatctctttcactgtaataattgtctcagttataatttttgcaaagatggtttcataataatatgtatatggaatagtttcactgccctaaaaatcccctgtactccacctatttatccctacttcttccccttaactactgtaaccactaatatctttctgtcttcatagttttgcctttttcacaatgtcgtatagttagaattatacagtatatagcctttcagattggcttttttttcacctagcaatatgcatttgaggtttctcaatgtctttttgtggcttgatggctcatttctttttattgctgaatagtattccattgtctgggtacactacaatttgcttatccattcacctattaaaggcatcctagttggttccaagttttggcaattgtgaataaagctactataaatgtccacatgtaggtttttgtgttgacatgagttttcatctttgggtaaatatcaaggagtgcaattgctggattgtgtggtgagagagtatgtttagtattgtaagaacctcccaaactgggtataactttttttttttttttttaagacacaggtctcgctatgttgttcaggctagactcatctcctgggctcaagcaatcctcttggcttagcgtcctgagtagctgggactataggtgattccagctcaccttgctggctgtaccattttgcatttccactagcaatgaatgagatttcctattgtttgacatccttgtcagcacttggtgttgtgctttggattttggccattctgatacggacacggtggcatctcattgttgtcttttttttttttaatgaatttgaagtctttttttcttattaataatttcttttaaccacggttgtcagaattattgttgtcttaattggcaattctctgatgacatatgttattgaacatcttttcgttcatatgcttatttgccattcgtatatcgttggtgaagtgtctgttcagatcttttgcctatttttaaaatggggttgttcattttctttcttttttttttttttgagacagagtttcactcttgttgcctaggctggagtgcaatggcacgatcttggctcacaacaacctcccgcctcccaggttcaagtgattctccttcctcagcctcccgagtagctgggattacaggcatgtgccaccacgcctggctaattttttgtatttttagtagagatggggtttcttcatgttggtcaggctggtctcgaactcccaacctcaggtgatctgcccgcctcagcctcccaaagtgctgggattacaggcgtgaaccaccacgcccagccacattgttcattttcttttttttaatttatttttaattttttaaatttttttattttttaaacattattttatttttaattgacagataacaattgtacatagtcatggggtacatagtgatgtttttttttttttttttttttttattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgctccgcccttaatccatttaaccctgagtggacacagcacatgtttcagagagcaccgggttgggggtaaggtcatagatcaacagcatcccaaggcagaagaatttttcttagtacagaacaaaatggagtctcctatgcccacttctctccacacagacacagcaacaatctgatttctccatcttctccccacatttcccccctttctactcgacaaaaccgccatcctcatcatggcccgttcccagtgagctgttgggtacacctcccagacggggtggcggtcaggcagaggggctcctcacttcccagaaggggcggctgggcagaggtgccccccacctcccggacggggtggcggccgggcggaggcgccccccacctcccggacggggtggctggccgggcgggggctgccccccacctccctcccggatggggcggctggccgggtgggggctgccccccacctccctcccggacggggcggctggccgggcgggggctgccccccacctcccggactgggcggctgccgggtggagacgctcctcacttcccagacggggcggctgccgggcagaggggctcctcacatcccagacgatgggcggccaggcagagacgctcctcacttcccagacggggtggcggccgggcagaggctgcaatcttggcactttgggaggccaaggcaggcggctgggaggtggaggttgtagctagctgagatcacgccactgcactccagcctgggcaacattgagcactgagtgaacgagactccatctgcaatcccggcacctcaggaggcctaggctggcagatcactcgcagttaggagctggagaccagcccggccaacaggcgaaaccccgtctccaccaaaaaaatacgaaaaccggtcaggcgtggcggcgcgtgcctgcaatcgcaggcactcggcaggctgagggaggagaatcaggcagggaggttgcagtgagcagagatggcagcagtacagtccagcttcggctcggcatcagagggagaccgtggaaagagagggagagggagagggggagggggagggggaggtgttcattttcatattaaattttaagagctctttgggtccaggcgcggtggctcacgcctgtaatcccagcactttggaaggccgaggtgggtggattacgaggtcaggagattgaaaccatcctggctaatgtggtaaaaccccatctctactaaaaatacaaaaaaattagccgggcgtggtggcgggtacctgtagtcccagctacttgggaggctgaggcaggagaatggcgtgtacttgggagacggagcttgcagtgagccgagatcgcaccactgtcctccagcctgggcgacagtgagactccgtctcaaaaataaaaaaagttatttgtatattttgtttcgtttttaattttttatttattttgagattgggttgtaagactggctacattttttttgtattattattatttttttttttgtagagacagggtttcgacacgttgcccaggctggtcttgaactcctgggctcctgtgatccatctccctcggcctcccaaagtgctgggattataggcgtgagccactgcgcctggcctctgtatattttggataccagttctttgtcagagatgtgttttgcaaatattttctcccaatctgttgagtttctattctcttagcagtgtattttgcagatcagaatttttaacttcagtaaagtccagcttatcagttttttctttcctacatcatgtttttggggttgtatctaagaagtcattgccaaaccctaggtcacctagattttcttctatgttatcctctaggagttttatagtttcgtatcttacatttaggtctataatccatttttttttaatgatccatcaatcttttaatcttccacagttttggtgggttctcttggactttattctgtagcagttcatgaccatgtaccatttacaggcatgagtgataaacttcatagtggctgagaaagatcaacagaatgagttgccttgtccaaaggaaatatgtcagtgacatatgagtgactgagtttttactaattgagattacatccaggtaccttttggtgatgaaactgtttattgtttgttgcagagttctactgcagactaacaattcctgaacccatttaataacccatgtatattaaatgtgatatgattgggattttaaaggccagaggtttaagagagagatgttcaaaagtttttttttttttttgagacagagtctcactctgtggcccaggccagagtgcagtggcacaatctcagcccactgcatcctccaggttcaagcaattctcctgcctcagcctcctgagttgctgggattacaggtgtgtaccaccaagccggctaattttttgtattttagtagagatggggtttcaccatgttgcccccagggtggtctcgaactcccgagctcaggcaatccgcctgcctcagcatcccaaagtgctaggattacaggcgtgagccacccgcttcagcctcccaaaatgctaggattacaggtgtgagccactgcacccagcccaaaagttgttgaattctcaaataattaagatttcatgtgttcatatggaccataaaggatcaaaataagtatggcttgccattattgtaatgttgctatcctgagtaggtcttttttttttttttttttttttttttgagatggagtcttgctctgttgcccaagctggagtgcagtggcacgatctcggctcactgtaacctccacctcccaggctcaagtgattctcatgcctcagcctcccaggtagctgggactacaggcgcacgccaccatgcctggctaattttttgtattttagtagaaacggggtttcaccatgttgcccagggtggtctcgaaccactgagctcaggcaatctccccaccttggcctcccaaagtgttgggattaaggtgtgagccactgtgcctggccctgattgggtttttatcattatctgttcagttcatgtagttttggctgttaattctgtacttgaattattcaatcacaaagtgtttttactgactgctgactctactttcactttcattacttaatgatgaaggctgtttaaaataatgttgtaatgccgggcacggtggctcacacctgtaatctcagcactttgggaggccaaggagggcagatcacctgaggtcaggagttcaagagcagcctggcccacatgatgaaacccatctctactaaaaatacaaaaattagccgggcgtggtggtgcacgcctgtaatctcagctactcggaggctgaggcagggagaatcacttgaacccaggaggtggaggttgcagtgagccgagatagtgccattgcactccagcctgggcgacagagcaagacctcatctcaaaaataaataaaataaaataaaataatattgtatctagattttcaaatcaggtgtttatgcaggaaaagacaattgttttattggttttagaaaaccaacaaaccaaagcaacaataaagattcctgtatacatttttttctttaattaatgaattacttgggtcattctggtaaaataagatgctttcttgttaccgaatgccagttttatcagatgaaaaggactgtgttcatagatgatggagataatcaccagttctgatagttactctaaaagataagacataatcctgttcagccagacctagtgaaaatcagaaataccgatgaaacttggacacgtagagtaagatttttggcttaaaacacctttgcaagtgggtgggtatgtgtagtatttatgtgtgctacttggtttctaaagactccctactatatgctaatttttaaattatgtacatggtactttttaagcctcgcaggctggccagccggcctactggcctccctccctctctccgtacaataaattagccaaaataatgaggtaatatctaagtcattgtagtctaggactgagtcatttttctctttgaaaaaattccagaatactttatattttcttgaaggtaacttttttgcacttgttttaaggtattgttactttatttacagccaacgaaatggaactgttaggtttgtaagcatcttatatttttgaagtgctgattgtatgttcaatctaattcaataaatatttattgtctaatatgttctaggctttggtgtaggtgcttgggatataaggatatgtaactcatagttcagccttaagtctaaatatttagtatatttgtgttttttaatttagtttttaaacacagttttttaaaataattttgagataattatagatttacattcaattgtaagaaacaataatacagagatatcccttgtacactttacccagtttcccctggtggaaatttcttgcagaatcatggtacaatatcacaaccagggtattgacattgaaacagttaacagtaaagtggtacagccactctgaaaaatagttcggcagtttgcctaggagtacagttgctaggccatatggtagtcgcatgcttacttttttttttttttcttttttttcttttttatttatttatttatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctggttacttgagattagggattggtgatgactcttaacgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaggaatttttcttagtgcagaacaaaatgaaaagtctcccatgtctacttccttccacacagacacggcaaccatccgatctctcaatcttttccccacctttcccgcctttctattccacaaagccgccattgtcatcctggcccgttctcaatgagctagtgggcacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgaaccccccacctccctcccggacggggcggctggccgggcagaggcgcccctcacctcccggacggggtggctggccgggcaggggggctgaccccccccccacctccctcccggacgggtcggctggccgggcggggggctgacccccccacctccctcccggacggggcggctggccgggcagaggggctcctcacttcccagtaggggcggccgggcagaggcgcccctcacctcccagacggggcggctggccgggcggagggctgacccccccacctccctcccagacagggcggctggccgggcggggggctgacccccccacctccctcccggatggggcggctggcggggctgaggggctcctcacttcccagtaggggcggccgggcagaggcgcccctcacctcccagacggggcggctggccggggggagggctgaccccccccacctccctcccggacggggcggctggccaggcggggggctgacccccccacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggctgacccccccacctccctcccggacggcacggctggccaggcggggggctgacccccccacctccctcccggacggcatggctggcggggcgggggggctgaccccccacctccctcccggatggggcggctggccgggcggggggctgacccccccccacctccctcccggacggggtggctgccgggcggagacgctcctcacttcccagatggggtggctgctgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacgtctcagactatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccaatcaggcgtggcggcgcgggcctgcaatcgcaggcattcggcagactgaggcaggagaatcaggcagggaggttgcagtgagccgagatggcagcagtacagtccagcttcggctccgcatgagagggagaccatggggagacggagacggagacggagacggagacggagacggagacggagagggagagggagagggagactttttaaagaaactgccatttgtattgatataatatggtggaggcccaggttccccacgtggtccccgctgatcttgttactggtctgcagggatgaaattcctggataccctacttggctttctgtctccaccttggaaggggtattgagtgcttaattacagctttgagaggttggaaatctaggctccccacttggcctttgctagaacgggtaggttttaaaccacagtattttcttggtgtttggctggggtagattggttattgtctaaaacttttctgtcttgctagactgctactttcttggtcttttagctaaagaagactgacttttgttggggcttttcttttcttttttttttttggagacagagtcttgctttgtcgcccaggctggagtgcagtggtatgatcttggctcactgcaacctctgctttcaggtttcaagtgattctcgtgtctcagcctcctgagtagctgggattacaggagcccgccaccatggccagctaatttttttttttttttttttttttttttttgagatggagtcttacactgtcgcccaggttggcgtgcagtggcatgatctcggctcactgcaacctctgcctctcgagttcaagtgattctcctgcctcagcctcctgagtagctaggattacaggcgcccgccaccacacctgtaatcctagctactttattgtatttttggtagagacggggtttcactatgttggccaggctggtcttgaacttctgacctcatgatccacccaccttggcctcccaaagtgggattacaggcgtgagccaccgtgcctggcctgctccagctgattttttgtttttgttttttgttttttttgttttttgaggtagagtcttgctctctcgccaggctggagtgcaatggcgcgatctcggctcactgcgatctccgcctcctgggttcaagtgattctccttcctcagcctcctgacttgctgagactacaggtgcgtgccaccacacctaatttttgtatttttagtagagatggggtttcaccatgttggccaggatggtcttggtctcttaacctcatgatctgcctgcctcggccttccaaagttttgggatcacaggtgtgagccaccatgcctggctgggtatgtttttaaaatgacatttattttttctttttgcaaaagttttatttaatgtagataatttagaaacacaaaaattataaaagagaataacattttcatatatattcttctagacatttcctgtgaatatatatacatatttttcttgtgaaaataagaactatatatactactcatgaactttttgctcgatataagcatcattccttgttaataaatgcatgaatatagcaccaatttggtatcaatcaggttgtaatgtgcacattctggagatcatcaatatgtgttactcccctaggtcgagtgcctgagagacagatcatgtacaaataaacgacgtacattttcacatgaatctcatagttcagacatcacttatatactagagagagttagaagtaaatcagatttagtcattagttttagaaacactgggtatttgggtaggtatttagattttaaagtttaaaaataaaaaaaataaaagtgttcatgtggctttacgaatgctattttgattaaaattcttgttcatattttccataatattataagaagggtcattatacttttcagaagaacatttgagataataatggctttcttgtttgttcttggaggaaataggagatactagcagtgttgtttcaatgaaccctagcattagttttctgctggaacttgcaaaacagaaaccagaacgacttaaatcttttccatagtacagttttttctaattgctatgtggtatacttgcagatgttcagatttattgggaaatttagatttcatagcttaggatttttggtattagctattcagattgatgcatcaggtctaattaaaaattatactcaagtttattcttgtactttatgttgtctttttcttatgatgtgagtagctgcagtataactcaaaaccagtaattataaaaccacttaatgaatgaatgtagatgtaaaagcatataatatttggagttgttttagtttctgtttctttaaaggtgaaggtacatatgtcataatttgggaagctatcctttcaacttaacatggagttgaaattgaaatgtgttcttagacataaatttgagatgtgttattgaacatatttaacacgttatcagtttccatatttttccaagcagttaaccattgggtagtgcacagcaagctcattttcctcttagccgttctgtgcatcttgtggtttgagatgttcatcactgtctggctgtgaaccccaaatgtcctcctagtgatcctggaaggtattttagaatagttttggctttctgcttttgattctaatttatgagatctggagtggagtccagaatctgaattttaaaaagaatagctctattgagatacaatttataaaacatacagttcagccacttaaaatgtacagttcagtggttttcagtattttcacagttgtgcatccattaccacaatcagttttagaacattttcattactcaggcaggacgcggtggctcacaccagtaatcccagcactttgggatgctgaggcgggtagatcacttgaggccaggagttcaagaccagcccgaccgatatagcgaaaccctgtctttcctaagaatacaaaaagttagctgggtgtgatagtgcacgcctataatcccagctactcgggaggctgaggcacgagaatagcttgaaccaggacgtggaggttgcagtgagccaagatcgcgccaccgcactccagcctgggcgacagagcgagactctgtctcaaaaaacaaaaacaaaaaaacccaccctgttctccttagctactcttccacctaatccttccatttccctgcactcacaactcctagatttttatggtgtatggctctcagttggcgtaggggtagagttgtgattttgccctttaggggacatttgacagtgtctggaaacattctcatgggtcacaactgggaaggtgctattggcatgctattaaacatcttccagtttagaggacaacctctcataacaattttcttgtccaaaatttcagtagtgaaggtgttaagaaactctggaagagagttagactaaacaaattgcaagatcaaatttttagccctcacattggcagtaggatattatcttacatggtcgatttataatttatgtaaaattgttaaatgtattggggttatacagatgatagaaaaaagagtcttagggacctaagggactcagtttagtctagtctggaatagtatgatgtcctcgctgggagccatgaaccctagtctagagcctgggatgtagttgttgaatgaacatgattatgtggtggtagtttgaactaaaatgattcttagttatttcataattgatggatatctagattggtagacttcacatagctgtatagactattccctcttttaatcctcctatcttgccaaaatcaataaccataaaaaagaatgtgtagaagagtctgatttttatagtttatttcaaagaaatttaagagtctcaatggtgctataaagaaattaaagactggctgtggtttggttgacttgaaaaggatatgtgggtctgagtgtgtgtgtttaattttttaaattttcttttgtttttgttttcagagagagtcttgctctgtctcactgcagcctctgcctcccgggttcaagcagttctcctgcctcagcctcctggtagctgggattacaggtgcacaccaccacacccagctaatttttgtatttttagtagagacggggttttgccatgttgcccaggctggtcttgaactcctgacctcagatgatccatccaccttggcctcccaaagtgctgggattacaggcatgagccaccacagccagcctaagtgtgtgtgtgtgtgtgtgtgtgtgtgtgtgtgtggaaattgaatggttttcaaaggtgatttgattagcatttgcatagactgtgaatccaagatgtttgtgttcccttccctcattcttccattcttttctctgtttgtcaatttttgtaccgcgatatatgagggattaaagaaaaatcttttagaatagttttggctttctgccttttttttttttttgagatggagtttcactcttgttgcccaggctggagtgcaatggcgcgatctcagctcaccgcaacctctgcctcctgggttcaagcgattctcttgcctcagcctcccgagtagctgggattacaggcatgcgccaccatgcccagctaagttttgtagtttcagtagagatggatttcaccatgttggccaggatggtctcgatctcttgacctgtgatccgcctgcctcagcctcccaaagtgttgggattacagttgtgggccaccgcgcacgtcctctatagtttttttttttttttaagtttatgataaattgaaacaacactaagaaaatcagataatacaggaatattaaatgaaaaccgaatctttctgagaaatgaaaaatagtatctcattgtttaatttgtatttctttttagatgaaagaggctgaatttttttttcacatttattatttggatttctatgaagagtttgtgtcctggactcatttttctgttgggttgttgatagttgttctgtttgtttgtgagagcacttagtatattataaaaattaatccattgtgtagtacatgtaacacaaatattttcttctactccgttatttgccttttgactttactattttttttttttttttgagatggagtctcgctcttttgccaggctggagtgcagtagtgtcatctcggctcacttcaatctctggctcccgggttcaagcgattctcctgcctcaacctcccgagtagctgggattacaggtgtgtgccaccacgcccagctactttttgtatttttagtagagacggggtttcaccatgttggccaggctggtctcaaactcttgacctccggtgatccacccgccttggcctcccaaattgctgggattacaggtatgggccactgcacccggccaaaaatttttaatttaatttaattaatttattttttttcccagacgaagtctcactctgttgcccaagctggagtgcagtggtgcgatctcggctcactgcaacctccacctcctgggttcaagcaattctactacctcagcctcccgagtagctgggactacaggcacgcgccaccatgcccagctatttttttgtgtgtgtgtttttagtagagacagggtttcactatgttggccaggctggtctcaaactcctgacgtcgcgatccgcctgccttggcctcccaaagtgctgggattacaggcatgagccaccacacctggccttaatttaatttttactagtcaatttttttagtagacctggtctcactctgttaccctggctggagtgcagtggtgccatcattgctcactgcaacctgaactcctgggctcaagtgatcttcccacttcatcctcccaagtagctgggtctataggtatgcactatcatgcccggctgatttttgcattttttgtagagacagggtacggttatgttactcagactggtctcagactcctaggctcaaacgatcctcctgccttggcctcccaaagtgctaggattacaggtgctggatccagctggcagtttctttaaaaattaaacatgtacttaccatactacccagaaatcactcctttggttatttactccaaataaaataaaatttatgttcacttaaaaacttgtacgtaactgttcatagcagacttattcaaaacagcaaaatgtgaaccaatccaaatgttgtgtcaacaagtgtaaagcaaaacatatgacatccatagcatggaatactactgagtaatcaaaaggaacaagcaagctatagataacctgcaacaccttgaatagactacaagggtaatgtgcttagtggaaaagcttatctcaagaggtcacatattatatagttccatttatatgacattctcaaagtgacaaaactgtaaagatgaagaatagattagtgattgccaggggacaggggggtagtaggtggaggggctataaatacagagaggtagcagaacagttctgtatcttgattgcagttgtggttataaaaatctatacatgagacaaaactgcttagaaatacacacacaaatgcaggttaaaaaaaatagtgaaaactgaataaggtctgtagtctagttaacagttatgtatcagtgtcataatgtttgagaccagcctgggcaacatagtgagatcctgtctctacaaaaaaatttaaaaaattagcccagtgtggcggcatgcacctgtggtctcagctactctggaggctgaggtgggagatcacttgagtcctggaggttgaggatgcagtgagccttggcgctgccactgcactctagcctgagtgacagagtgaagactttgtctcaaaaaaaaaaaaaaaaaaaaaaaaaaaagataattgagatctggatctacctgatgataaagtgtgtgttccttgcacagtaccatccagtcttgcctggtaattcctttcaggcctttacttggttcttaaatactagatgttgccaaataagtgatgctacttttactaggtgtggttaggaggcacagcatccaaagcaaggacatgagattgtaatacaaggaaggtgatgacttgctccattgtctgtggctttcttatgttgtaatgggagcttatcagtgtgcaccatgatcaggttacagcatcaggaggagctctacaacctattttagattcacagttaatattgtctgcttttttctttgttcttgtcattttcttttctcttttgtactttctctttctctctctctttttaaaagatgggagtctagatacattgcccagtacagtggctgttcacaggcataatcatagctcattgcagccttgaactcctggactcaagcaatcctttctgtctcagccttccaagtagatggaactataggctgtgtgtcactgtgccaaacatctctctctgtctctttattttttaagtgatagagaaccacaaatgtgttttttaaagaaccagcattttttcaaataccaaatatttgtgtagctgatgatgaggcatcactaggagtttccttttgttgacaaattcaagagagacatcattccaaatgaaattttattccgaaagtgaattttgtgaaaaccagtgctaagaaaataacaaaatgaacgaacaccaaaacacccatgtgtttacaaggaaacaagaaaacatggagttaaagtaagtaattgtgtctacttgacagatgttgggttttctttccctcttggactattgtgtttcctcaatttgtaggtttcatgtcatctttttaaaatagtagccgtcttttgactccttataagttatgttgggccaggccaccttaccacatgaattccctccccactttgcttggtatttgataccctgctttcagccaccatggcttcctccccacccctaaacgaagactctgattttgctctgcttgctctaccctacctgatggctttaggctaaattgtttatgctgaccggagtcagattttatttttagagagataattctggtgaccatatggagaactgggtgagagactgtcagtgttcagttgagtctagtgcagaatctaggtgaggggtttgaaccaaagtacatggggatggataaggaagactaagcactctacagacgatgatgataatatgataaattatataggttataatttactgaacacttgccatccctcataacaacttcatgattgaaggccttaacatttttatttatttatttatttatttatttatttatttatttttgagacggagtctcactctgttgcccaggctggagtgcagtggtgtggtctcggcttactgcaagctccgcctcctgggttcacgccattctcctgcctcagcctcccgagtagctgggactacaggcgcctgccaccacgcccggctcattttttgtatttttagtagagacggggtttaaccgtgttaaccaggatggtctcgatctcctgacctcgtgatccacccgcctcagcctcccaaagtgctgggattacaggcgtgagccaccgcgcccggctaacatttttattttatagatgagtaaacagtcatggagagattacataccttgcccaaatttacctagctcaacagaggaaaagaaaggataggaattcaggtggtctgattttagaacctgtgcttttgaccattatactagctgggggctttatttttctaactgttagaagtgttcaacaatgaaagagccaccctgtgaagtaatgtgggcatcacttgaaatggtcaggcaggaagtagacgggtcattaatactacatcaagggtccacatacacactgtggctagattactgtgaagaaggcttttaagttctgtgattttgtgatgtgatatacagggagttgttgctttatgtggttctcatatacactttcacttaccatggtttggttaaataataccaattccctaataacatggtttaaattttacacagcatattaactgtgaataatcgtataaagtacaaaattcgctgccagctcttctgtcactacataagtaacaactgtgcaaagcatgggtttgtgttacctccttgtctcccagtgataaatctatgtgatagttaagaaaaatcgataaccgatagagagaattggccgaaaaagatgaaagttcaggaaaaaaccaaaaagtaacaacagtggaagtgaaattcaaattgaactcaaatggagttatagaagaaatagatcactgagggaatgctgatgctctcattcaaaacactctggatatgtagccgaaataacttagtgaaggtgagcttatctacataagtgaagaaagtggtttggtaaaaaaaaaaaaaaaaaaaagaagtgatgcaagaaattttgtagtgaaagaactctcgaaggtattctgtgatattgaaatatgaaacataaagtatttgatgctattccagactcagacaggagtgtgacaattggctaaggcatagaaaagatgtctattgcagccgggcgcggtggcttacgcctgtaatcccagcactttgggaggccgaggcaggcggatcacaaggtcaggagatcgagaccatcctggctaacagggtgaaaccccgtctctattgtatgatgagaagaatgtaagcactatttaaactacccctaataaattttttcaaagaacttaaacattataattttcaatatttctatgttctctagtgcagtggtcctcaacctttttagcactgatttagtggaagacagtttttccatggaaggggacgctgggggaggggatgttttcgggataaaactcttccacctcagaagatcatcaggcattggattctcataaagagtgcacagtctagagccctcgcatgcacagttcacagtagggtttgtgctcttatgagaatctaatgccacgactgatgtgacaggaggcagagatgctcgcctgcccttcgctcacctcctgctttagtgcattaatgattagttttcctgttctttcaattttcctataattataactgacagagtttttaatgtttcaatgaaattttttttttttttttttttgagactgagtctcactcttgtcacccaggctggaacacagtggtgcgatctcggctcactgcaacctccgcctcctgggttcaagcgattctcctgcctcaggctccctagcagctgggattataggcatgcaccaccatgcctgactaattttttgtatttttagtagagatgggttttcaccatgttgtccaggctggtcttgaactcctgacctcaggtgatttgcctgcctcagcttcccaaagtgctgggatctcaggtgtgagacactgtgcctggcctcaacaaaaaaaaaattcttttttttgagataggatcttgctctgttgcccaggctggagtgcagtagtgtgatctcggctcactgcaacctctacctcctggattcaagcaattctcctgcctcagcctcccgagtagctgggattacaggtgctcaccaccacccctgggtaatatttattttattttttaaattattttttgagatggagtctcactgtgtcacttaggctggagtacagtggtgcagtctcagctcacgcaacctctgtagtgaacccgtcctaggttcaaacaattctcctgcctcagcctcccaagtagctgggattacaggcgtgtgccactacccctggctaatttttgtatttttagtagacatgaggtttcgccatgttggccagggtggtctcgaactcctgacctcaagtgatctgcccacctcggcctcccagtgctgggattacaggcatgagccactgtgcctggcccaaaattttttaaaaattacagagtggcggccgggcactgtggcttacgcctgtaatcccagcactttgggaggctgatgcgggtggatcacgaggtcaggagatcgagaccatcctggctaacatggtgaaaccccgtctctactaaaaatacaaaaaaattagccgggcgtggtggcgggtgcctgtagtcccagctactcgggaggctgaggcaggagaatggcatgaacctgggaggtggagcttacagtgaaccgagattgcgccactgcactccagcctgggcaacagagtgagactgtctcaaaaaacaaaaacaaaaaaaaattacagagcggctgggtgcagtggctcacgcctgtactcccagcactttgggaggcttaggtgggcagatcacgaggtcaggagatcgagaccatcctggccaacatggtgaaaccccatctctactaaaaatacaaacattagctgggtgtggtggcacgtgcctgtagtcccagctactcaggaggctgaggcaggagaatcgcttgaccccaggaagtggagattgcagtgagccaaggtcgcgccactgcaccctagactggacacagagcgagactccgtctcaattttaaaaaaaaaaagattacagagcaattgcagtttttctcattaattattatgatcactttgcatggtttcagcgtgcattcttacttttacggttttgcactattgtgtaaaatgaaagctgcctgtttgtaaactgtggaaagtttaatttttcttcttagtttttaggggtaccccctaactagccttttctttgcagagtttgtatatgcatctctaacaaagtatgtttcctttgacaagttttgcttttaaaaaacttggactgactgaaaataatatttgtagaaaatattctaaaagtaatgcaaaaaggaaatatccttaaagctagtattaagaataatctcataggaaggaagtttcatgtgtttggtgttatctctctttttggtaacagttttgttgagatatattttatataccataccattcacccacttaaagtgtagaattcaggccaggcacagtggctcatgcctgtaatcacagcactttggaaggccgaggcaggtagatcacttgaggccaggagttcgagaccagcctgaccaacatggcaaaaccccgtctctactaaacatacaaaaattagccgggcatggcgacacgtgcctgtaatcccggctacttgggaggctgaggcacaagaatcgcttgaactcaggaggcggaggttgcagtgagccaagatcatgccattgtactccagcctgggtgacagagcaagactccatcacaaaaaataaataaataaataaaatgtacaattcattgttttttggtatattcacagacatgtgcaccattagtgcagtaaagtctagaacattttcatgacccccaaaagaaatcccatgttctttatcactccctaatacaataaaccccaagccccaggcaaccatgaatctactttctgtataaatttacctactctggatattttatatacacagattaatatagtaggtggtcttttgtgatgttttcagggttcacccatcttgtagcatgtattaggactttattcccttttatggctgaataatattccattgtatgtatgtacctcattttatttatcatttatttgttgaggaacatttgggttatttctgctttcatatggtaactctgtttaatcttttgaggagctcccagactttttcaaggtggctgcaccattttatgttctcattagcagtatatgagggttccagttcttgccacatctaaaacacttgccattcattacctgtttttttttattttagtcatgctactgggtgtaggatctcattgtggttttgactttcatttttctggtgactaatgtgtttattggccatttgtatattatctttggagaaatgtacagattctttgttcatttttaaattaatttgcctttttattattaagttgccagagtttttggtattttagatacaggtgtgtgtggaaaaaacaaactccgtttctcctactgctgatattcttatagcaccctactgaaagcagatgtgtggggatttctccccaccagcaggcaagcaagcagtcatttctgcagctgacagccactcaattctgacataatcaacctggagatagcatcaagattccacaggttgagggctcagtttccaagactgcctctccccacacttcacatgccagttgtaagctcccgcttattttacctgtgcttctgactgactggctataaattggtgttcccatttatagccatgggcttaacttgctagagcagctcgcacaactcgaaaacacatgtttaccagtttattacaaaggatattttaaaggatacacataaatagccagctgaagagatatataagacaaggtctggaaaggtcctgagagcaggagcatctctcctggtggaattcgggtgtgctaccctcccaggactttgtctgtgcttatactagtaccacattgtcttgactattatagctttctgtagtatgttatgaaagtggaaagtatgtgtccgtcaaccttgtttttatttcagggttgttttagctattctgggtcccttgaatttccatatgaattttaggattgattgtcaatttctacaaagaagcttggtgtgattttcatgtatttttttggacacagggtcgcaccgcatcacccagactgagatggggttttgccatgttgcccaggctggtcttgaactcctgggctcaagtaataatgcccagtttggcctaccaaagtgttgggattacaggagtgagccactgtgcctgaatctgtagatcagtttgggaagcattgccatcttagcaatgttaaatcttctgatccatgaacttaaatgtctttccatttatttaaatcttccttaatttctttcaggaattttttttttttaatttttcagagtataaattgttcacttcagccgggcacggtggcttatgcctgttatctcagcactttgggaggccaaggcaggtggattacctgaggtcaggagtttgagactagcctgaccaacattatgaaaccccatttctactaaaaatacaaaaattagccgggcatggtggcatgtgcctgtaatctctgttactcaggaggctgaggcaggagaatcgcttgaacccgggaggcggaggttgcagtgagccaagattgtgccactgcactccagcctgggcagcaggagcaaaactccatctcaaaataaataaataaattgttcacttcttttaagtatttttttatgctattttaagcagaattgttttcttaatatcatttttggattgttgacgcaggtacttggtgcatttaaaatacaattttattggctgggcatggtggcttatacctgtaatcccagcactttgggaggccaaggcttgcagatacctgaggtcaggggttcaagaccagcctggctaacaacggcaaaaccccgtctctatcaaaaatacaaaaattggctggatgtggtggcgcacgcacgcctttaatcccagcactttgggaggctgaggcgggcagatcataaggtcagcagttcaagaccagcctgaccaattggtgaaaccccgtctctactaaaaatacaaaaattagctgggtgtggtggcgcatgcctatagtcccagctactcaggaggctgaggcaggagaattgcttgaacctgggaggcagaggctgcagtgagccgaggttgcggcactgcactccagctgggtgacagtgagactctgtcttacaaaataaataaataggctgggcgcggtggctcacgcctgtaatcccagcactttgggaggccgaggcgggcggatcacaaggtcaggagatcgagaccgtcctggctaacatggtgaaaccccatctctactaacaataaaaaaaaattagttgggcatggctgcaggcgcctgtagtctcagctactcgggaggctgaggcaggagaatggcctgaacccaggaggcggagcttgcagtgagccgagatcacgccactgaactctagcctgggggacagagcaagatgccgtctcaaaaaaaaataaaaaaataaaaataaataatatgattttgtcaaatttaaaaccttaagatcctattggcttgtaatagcaaggagtagaagcgtggattgtagaatgttcttatgaaggctttatttcatcaatggcttttaagcactttggggtcagactttgagctgttagtgattgtttttgagctgtagtccttagagattccaaactgatgactgcatatgtcacttgtatagtcaatgtgactggttttcaaaagccctttcagttatagagccaatgactgggcaacagaaatgcctttcatttatatcattcttctgttttcttggtgcaaagggctgtagttaagaggaacagttagattttagtggcttaccaagttgctttagaggaagtctatgaaaggactgttgagccaaacaatgttcagattaaaaaccagtctgttagcaggacagaatcctcttgcagatactttgtttaacctttaacttagtgcaagaagagttcaagctatgacttttgagattaaatcttaaattatgtaagcatgtttctgataaggattgttttatcatctgcatcagaaccatttggactgctttaaaatacagatttctggactcctacccagatttactaaatcaaattctgggaatagaacttcataatctcttttaaaccacctttccatgggatgtccacgttaaagtttgaaaactacttttatttatttttggcatccatatgtgtttattgatatagtttcccactcatcttgattcagggttctttcagtgctgtctctatctgaaggagagccttcctgtaggctggcagaggacagcagagcagccagacacacaactactattgtgcatgactgacgaccatggtgattttatagcatcctgggcatttcacgttcaggaagtaagaattggggctctgcaccaggcacttcttgtgcttgctctttttttctggagagggagggagattctttgtgagaggcctgttctcgtgaggggatcgtcagcactggaaaactgaaaaccagttttaatagtacctctttctgttaagagattggtttttaccaggactgaaatttttcaaattatgactcactgccaactattttttctgttgctgtttttgtttgtttgttttttttgagacagagtttccctctgtctcccaggctggagtgcagtggtatgatctcggctcactgcagcctttacctccccaggcttaggtaattctcctatcttagccctcccaaataggtgggactataggcgtgcatcaccatgcctggctaatttttgtattttttgtagagactggatctcaccatgttgcccaggctgatcttgaactcctgggctcgtgtgatctgcctacctcagcctcccaaaatgctgggattacaggcatgagccatcgcccttggcctacagccaactcttaaaagcaaaacaacactagaagataatggaatagaagatttcagtaggccgggcacagtggctcacgcctgtaatcccagcactctgggaggccgaggcgggcggatcacgaggtcaggagctcaagaccatcctggctaacacggtgaaaccccgtccctgctaaaaatacaaaaaattagctgggcgtggtggcaggcgcctgtagtccccgctgcttgggaggctgaggcgggagaatggcatgaacctggaaggcagagcttgcagtgagccaagatcgtgccactgcactccagcctgggcaacagagtgggactccatctcaaaaaaaaaaaaaaaaaaagtttcagtgcattgtacatagtatggatgagtattgatttataaaacttctgtttcatttatatatgtgtatgtgaatatggatcataatataaatttttttttgccatggatggtgataaaaagaaaaaaatgaagacttgagaattagaaaaacacatatttttctttccttcactctttcatacgttcttttgcatctgccatgctcctggaactgggataggtgctgggtgagcatccaaatattccgaaaatcctcactcttttttttttttttttttctttttttggagatggagtcttgctctgatgcccaggctggaatgcaatggcgtgatctcggctcactgcaaactccacctgctgggttgaagcgattctcttgcctcagcctcctgagtagctgggattatagacgcctgccaccaatgcttggctaatttttgtatatttagtagagatggcattttgccatgttggccaggctggtttcaaactcctgacctcaggtgatccacccaccttggcctcccaaagtgctgggattacaggcgtgagccactgtgcctggccgaaaatcctcactcttgagctcacagtttatagagggtaataggcacataaataataaagtggtatagtagaagcacatgtcatacattaactgtgtactagaagtacatatcatatagagtgctcctgaagtcatggcgactttcatagggatggaggtaggttgaggggtaggtactgaaaatattgaagctgggtgctgtggttcacacctgtaatcctagcactttgggaggccaaggtgacaggatcgcttgggcccaggagtttgagaccagcctgggcaacatggagaagccctgtctctacaaaaaatacaaaaattagccaggcatggtggcatgtgcttggagttccagctacttgggaggctgaggtgggaggatcacctgagcctcaggagatcgaggctgcagtaagccaagattgtgtcactgcacgccagcctgagtaacagaatgagaccctgtctcataaataaataaagtgaaaaggtggagaagaagaatagcattttaattattaagcgtgaaagaattattttagtattgaagatggacaataattgatataaatcatttttgatttagtattcttatccactcttattcatatgttactcattctgatgcagcttttgagtatataggatcaatccagcacatgaagagctaaagggaggttctgtacctcttgtgacagcttttcctattcttggagggacccttttttactttcctcagaactttatttactagagtttatttcctttttagattttatttcatgttgatgctagtattcttactgaatgtattctgacccactaagaatcaatgacagggtagggaggtgtagttgagatttggggagagccttatgcatttcataggggtccaaattctgtatctgatttttggcttcagaatacttttcaggctgtaagccagtaacctcattttagtctttatctctcagccttatagtcatcttttgttttatcttactgtaggctaacattcaccattagaaagtcagacagctggtctacacaccagaagatactatattagctttcattgcttatgtttgcctgttgcaggctcttttgtttacatcagccgccttcactcatttggttttcatatgcatactgattgatacatataaacttagggagattcactctaaacagtgctcttgatctattttgtgtttcttaagtgttttagctcagagactggtactgtttacatagaaagaacagcctcgtcaagagtctggaggggcataccctatgtcacagcatttggccatagctctatacatgacgatatcaagaaggcgcccccttggacctacgaagacagaaggcacattcatgtactttgagtacacagaaatatgataaatgatgaataacaactgtttttaagaattaaaaaacaggaggcataaagttaataggagatgaatgcttaatgtgtggcagtttcacgtgttacatttgagggtcaggtcggtagtggtgttggtgaagggagctaactggttacccagcctggatgggattgggtggctgtgggtggaaaaggtgggaggtagcgttataaacaattaaactagtgttcaattgttaaaggctattatcatagcctttgacttttcagtctgttgaatgatcattttgctttgcatagagcttgctataaagattgctgtgagagacaatatttggtagtaaattaagagttgtgccactttactagctgagcaatcttaggcaagttatttaacctctaagtgccctggtgtcctcattttaaatggggttatctatgtcctagagttgttcaacatattaagcaaagtaatttatgtaaagtgattagaatggtctctggaatataagtctgcaataactgctgtttttttttgagagggggggatggagtctcgctctgtcgcccaggctggaatgcagtggtgggatctcggctcactgcaacctccaccacccaggttcaagcaattctcatgcctcagcctcccgagtagctgggattacaggtgtgtgccaccacacctggctaatttttgtaattttagtagaggcggggtttcatcatgttggccaggctgatctcgaactcctgacctcatgtgctcctcctgccttggcctcccaaagtgctgggattacaagtgtgagccacaatgcccagctggctcttcttatttttatttttagtctattgagacaggatctcactctgttgagtgagtgcagtggtgccatcacgactcactgcagcctcaacctcctgggttccagcaatcctcccacctcagcctcctgagtagctgggaccacaggcacataccaccatgcctggctaatttttaaattttttgttgagacgggatctccctatgtttcccaggctgatctggaacacctgtgctgaagcagtcctccctcatcggcctcccaaagtgctgggattgcaggtgtcagccactgcatctggtctagttcttatttttttatatgggttggagtttcttttttttttttcctttttcttcttcaattttaatattttgtcattttattatattgcatctcccactgaagacttgtatatttcttggggtcttattggagagaaatccttttttttttttttttttcatacaaatcagacccaaggtaggtttagtgtttggactgtaatatgaagtttgctttttaattgttaaaataatgatttttttcttgcattaaacaattctgaaagtttttctttttgttcacttgtagtcagacaccaaagaaagggggaaaactgtagaataagttattttttttgacagtgtctcactctctgtctcccaggctggagtgcagtggtgcagtcacagctcactgtagactcaacctcctggtctcaagcaaatctttcacctcagcctcccaaggagctgggattacaggcatgtgccaccatgcctggctaatttttgtatattttgtagagacaaggtctcagtatgttgcctaggctggtcttgaactcctggactcaagcaatcctcccacctcagcctcacaaagtgctgggattacaggtgtgagccactgcacctggcctaagtgaaaaaaaattttttattttttggatacagagtctctctctgtcgcccagggtggagtgtggtggcatgatctcagctcactgcaacctccccctccaggttcaagcgattctcatgcctcatactcccaagtagctgggattacaggtgtgtgccacaatgcttagctctttttttgtatttttagtagagacggggtttcactatgttggccaggctggtctcgaactcctgacctcaagtaattcacctgtcttgggctcccaaagtgctgggattacaggtatgagccactgtgctgggcccctaagtgatttttttaaatggtcaatgtgtgagctgttttttccttatggttttctctgttccttttccttgccataaaagtaaaaatagatctggtttcctgggttatcacagcttttaacaaaaagctttttgataaaattagctgttgggtcagtgggatgagatcattcctttctaagtagtgtgaaatgtcctctaagcatttgtgagacaaaggcatgccagataggctaaccacacaataagcctaactctgtggttatgtttagggcaggagtgtgagttttctgtgaaatagaatactactgatatgtagaaaaaggtgaaaggtacttggcacaatatgtatgcactctggttggccacgtgtagaaagagattagaatgataaaagggctcaggatacacttgatatgagggcataggccatcattatcttcagatgtgattaattaactgaaaattgagtagctcatctacatttggattagtgcatctttaattaaaaattcttggctggacacggtggcttacacctgtaatcccagcactttgggaggttgaggcgggcagatcacctaggatcaggagttcgaaaccagcctggccaacatagtgaaaaaatccgtctttactaaaaatacaaaaactagctggctgtggtggcgtgcacctataatcccagctactctggaggctgaggcaggagaatcacttgaacctcggaggcggaggttgcagtgagctgagatcctaccactgcactcaagcctgggtgacagagcgagactcccgtttcaaaaaaattaaaaataaaaataaaaaaattcttaaggacagtttgaaactggagagaaatcataatgtactttaaaatggttaattgtatgttatgtaaacttcacttcaattaaaaaaattaaggacagctggaaagaaaactaatatacttttctgtttgtacaaaataaaatggtagatttaagaagctttaaccagggcttcaactttcacatcatagatactaactgtagaagcatagtgcgataactgatagttaaatagaagataaaaatccacatgaggagggcatgccattttaaaaaggagagctatgtgatgctatttccaatacatagatatagctggacttaccttctttatccctgagaaacgaaagcattctaagttagcagaggaaatgatgatcagaatgataatacctcctaccttttccccttgcttcctgatttgggatataggacagaaaagaaattctacttttagttgagaactcagggatgactttgaacaaatatatttgttaatctccttggacttttctcacttttaaaataaggaggttggattcaaatgccctttctaaagttttgtgatttggttggaaatattagatgtgcacatcaccaagttactttgttttgtttctgtgtacatgaataagcttttattagacttggtcactgttgtctctctgtgatcaacaagggtaagttagcttctaagagtaccagtggtagaactttaagatttgaagctttaacgagagtcagctagtttgcagtgattagagacttgtaagttaattgatatacacacttttgtctatatttattaagtttctcaggggaattgtagattatttcagagtgcagttttaggtcgtggatcagatttaagttggaagtaaataatggttattactagaattttttgtttttgtttgtttttgagaaggagtctttctctgtcacccaggctggagtgcagtgccacaatctcagctcactgcaacctctgtctcctgggttcaagcgattctcctgcctcagcctcctgagtagctgggattacaggtgcctgccaccacacctggctaatttttttttttttgagacggagtcttgctctcttgcccaggctggagtgtagtggtgcgatcttgggctaactgcaacctccgcctccgagattcaagtaattctcctgcctgagtctccctagtagctgggattacaggcgcacaccaccatgcccatctaatttttttattatttttttttagtagaaatgcagtttcaccatgttggccaggccgctcgcgaactcctgacctcaattttcatacattattattaactaaagttcatagtttatttagatttccttaatttttacctaaatacctttttctgttctaggatctcatctaggataccacattatgtttagttatcatacttagctttctcttggctatgacagtttcttacacctcccttgtttttgatgactttgacagttttgaggagtactggtctgatattttgtagagtgtccttcagttgggagttgtctgatctttttctcatgattagacagaggttatgctttttagaaggaagatcacagaggtaaagtgccactcttatcacattatatcaagggtgcatactatcaaatcatgtcagcatgatttatgtctgtgtgtgtgtgtgtgtgtatgtgtgtgtgtatgtgtgtgttttgctttatcactcaagctggagtacagtgctgtgatcacagttcactggaacctcctggactcgactcaagcttcctctcaactcagcttcccaaatagctgggaccataggcacatgccaccaagcccagctaatttttttttgagaaagagtcttgctctgttgcccaggctgggttgcagtggcacgatcgtggcttaccgcaaccctggcctccagggcccaagtgatcctcccacctcagcctcccgggtagttgggactacaggcacgtaccaccatgcctggctaatttttttgtttttttgtttttttttgagatggagtcttgctctgtcgcccaggctggagtgcagtggcgcgaccttggctcactgtaacttccgtctcctgggttcaagtgattctcctgcctcggcctcccaagtaggtgggactacaggcatgtgccaccacacccagctaactttttgtatttttagtagagacagggtttcaccatgttagccaggatgatctcaatctcctgaccttgagatccccctactttggcttcccaaagtgctgggattacaggtgtgagccaccgcacccagcctaatttttgtatttttcatagagatggggtttcgccatgttgcttgcctaagttggtgtcagaactcctggcctcaagtgaacctcctgccttggcctgccaaagtgctgggattacagatgtaagccattgcacccagctgatttatcactattgatattagtcttgatcacttggcttaggtagtatttgtcatatttctcttacccccccctcccattttcatattgtactctttagaaggaggtcactatgtgctatgcacatgtaaaggatgaagggttatgttctacctcttggaagtggagtatcttgtttggaattcttcactgaagacttgcttattctctctcatttatttattcagtctattgtttatattgttccagctttggtcattgggaacttttttagttgactcctgtgtaattgagttacccctatcttttttttttttttttttttttttttgagatggagtcttactctgtcgcccaggctggagtgcagtggtacaatctcggctcagtgctacctacacttcctgggttcaagcaattctcctgtctcagcctcccgagtagctgggattacaggcacccaccatcatgcctggttaatatttgggttttttatagagacgggttttaatcatgttggtcaggctggtcttgaactcctgacttcaggtgatctgcctgccttggcctcccaaagtgctggcattacaggcctgagccacctcgtccggccaacttacccctatcgttgtttttttttttttatttttatttttagcacttcctaactttctggaaatacaaggtacttcaggctcatcttgaatattttgttctcagtcctagaattagtcatttctccaaagagtcttggtttctttatcagagaatggtattagaaaccagcatctgggtgtgaggtatgctgttgctttactggggtgtcccctgaagattttaattaaacttcatctgagtttgaaaggactggaaatgctgtgtttaaatttttttttattttctaattgagacagggtctcactgtgttgccaagactgaaatcaaattcttagccttagatgatcctcccacctcagcctttcaaagtggtgggattacagacgtgagccaccacacctggccagaaatgccatatatataaaatatataatatatattacatgtgaatatgtaatatataatacataatattacatatgaatatataatacatatattatatatatatatttttttttttgagatggaatcttgctcagttgctctgtgcagtagggatctcggctcactgcaacctctgcctcctgggttcaagcgatttccctacctcagcctcctgagtagctgggactacaggtgcatgccaccacgcccagctaattttttgtattttaatagagacggggtttcaccgtgttagccagaatggccttgatcccctgacctcgtgatcctcccacctcggcctcccaaagtgctgggattacaggcgtaagccaccgtgcccgacctacctctttttactacgattttattactactggaactagatcttaaaatatcatgtaagatctctgccattatactagttgtctgtagctacatgtatggaattttaaaccgttcagattactaccttaggaatcagtatgcattcttgccttttccataaagcagaggtgtcaggaccaagcttttcaggtcattgacaaaactgaaaaaggagttagtgattattgcttcctagggaagtaagacttaaaaaaatatgcatttacttatttatttatttagagacagagtctcgctctgtcacccatgctggagttcagtggcgccatctcggctcactgcagcctccgcctcctgggttttaagcattctcatgccagcctcccgagtagctgggattatgggtgtgcaccaccacgcctggctaatttttgtatttttagtagagacagggttttaccatgtcggccaggctggtcttgaactcctgacctcaagtgatctgcccgctttggcctcacaaagtgctgggattacaggtgtgagccaccccacctggcttatttaattttgagacagagtctcactctgttgcccaggctggagtgcagtggcacaatttcgactcactcatcctcaacttcccagactccagtgatcctcacacctcagcctcccaagtagctgggactacaggtgtgtgccaccacaaccagctaaccttttttgtattttttatcgaggcaggggttcaccatgttgcccaggctggtcttgaactcctgggctcaagcgatctgcccgcctcggcctcccagtatgctgggattacagacctttgccacggtgcctgaccagaagtaagacattttggatgtgtgaatgaagttctgattatgttctaaaggaattaccactagttttgtggtacctttttttttttttgagaaggagtctcactctgttgcctaggctggagtgcagtggcgcaatcttggctcactgccacctccgcctcctgggttcaagcagttctctgcctcagcctcctgagtaattgggactacaggcgccggccaccatgcccagctaattttcgtatttttagtagagacggggtttcaccatcttggccaggctggtctggaactcctgaccttgtgatccacctgcctcaccctcccaaagtgctgggattacaggtgtgagccaccgtgcccagccattttgtggtacttttgttttccatttctctccctctcacacctttcctgtctactgactttgtgatttagttaaaccaagccactaaaacccagccaaaattctactaccaataagaaatgtttagagttgatgttgatttaaatagctttagtgcagctgtgtcgtacttaaactcctgcaaatttccctccccccccagagatggtgtcttgctttgttgcccatgctagagtacagtggtgcgattttggctcgctacaacctccgcctcctgggtttgagtgattctcctgcgtcagcctcccaagtagttgggactataggcgtgtgctaccacacctggctaatttttgtgtttttagtagagatgaggtttcactatgttggccaggctgatctcaaactcctggcctcaggtgatctgcccaccttggcctcccaaagtactgggattacaggcgtgagccacagtgcctggcccctgcaacgttcttgaagttaaagtgagtgaagttggtcttgattaagaacttatgctgcagatattgtgtgaatgggtatctacagaggcagttatttctcagctccagtatattgttgctaagtggaaatacatagtcatggcctgatcttcggattttttatttttttgagacagggtcttacactatcacccaaggctgaggtgcagttccgcaatcatggctcactgcagccttgacctcccgggctcaaacgatcctcccattttagtctcctgagtagctggaaccacaggtgcatgctcggctaattttttttattttttgtagacacggagtttcactgtgctgcccaggctggtctcgagcccctgggcttaagggatcctcccatttcagcctcctaaagttctgggattacaggactgagccaacgcgcctggccctgttttttaaaaaagctgtaaaactgtattttcattcaaagattactgattttggagatattggccatttttcaaaacactatatgggccactgcaccaaggggcctgtttgacctaggtttgcactctgaactggtgcttctcttgtgggttcagtgagtattcattttggggagggaactctgggcttggtgggagttgggagatgtttgtcctaattgtagctttgtctctagttttctagatggcttttggcaaagggaaaccactttggatctctcttttctgagttttaaaatttgagagtaaactggagaatttaaggttctcccttactcttttttattttacatgttcatacatgtatttacttgagctgtgaaacaatgaccatttatgagttggagacttcaggaagtcttactagtcttaagtgctttgggaatagaggagactattatgttttctctagatacacttttttctaggctacagaagattctcacctgctttttggactcttggcatacttgccgcctctaatcattatctggcagatgtgtacatagtaatgggtgatgcatatgtttctgttttttcaagcaaattgattctaatttgatgaaagctgtattgatatgtagggtttttggggggtagtcgtggtgatgggtagaaatagtaaagctgacagtgacagtattttcttagttatggagaacattttaatactttatttcattatttttagtttgaactaattaattgttggtggttctatatggaaataatgatgtaggtgggtgttcatcacttaaaatcaactgcataagataatggcataacttaattactgtaacagcaaaaatgaaatctgagaaacttctgaaatttagtcttttattaatttgagataagatttatttggagataagatttcagacttccttttatcagacaggtggttttataggaagattaagattcttctagaaaaatcttaaagacaagggaaataagtttttcttacactctaaccatatattcacttgacatatagtgtttttgtaaaaatatattcgtttcttacatcttcagaataaagcatcttgatgtaatgtgatttactaagaatcatacctctctgtcctgaaggccaatctaaattgctgttttgtatagattgccaatttttaaaagagaaactgttgtatttgagtgggatgtaataaatatgagcgtttatgatgtagtctcttgtgggaatgtttatttacaagtaatttaagcctctgtgagcctgacaaggcaaactcaatcttaaatccttgattaagtggaagtataaactgatggaataataggcaagcaggatttatgtttacatggtaattgcaacaattttggccaaaacatttggcctaatagtcactaattttgatcctttatgttcattagctgaaattgtatatgtagtagtttctttgtaaggtaatacaaagcagtaaggacacaggagaagagtatatttaaaagaaatttctcttcagatgtatagactttgctttatagttctaatgacaatagtccaggagcctctaagtcagcatattattattattgttattattattattattattattattattattatttttgaggcagagtttcgcacttgtagcccaggctggagtgcagtggtacgatctcggctcactgcaacctccgccttccaggttcaagtaattctcctgcctcagcctcctgagtagctgggattatgggtgtgcaccaccacgcctggctaatttttgtatttttagtagagacagggtttttaccacgtcggccaggctggtcttgaactcctgacctcaggtgagctgcccgccttgaccgcccaaagtgctgggattataggtgtgagccaccacacctggccaagtcagcatattatttcttcttgtaaaaagatgtcatggtggctcatgcctgtaatctcagcactttgggaggctgaggtgtgcagatcacctgaggtcaggagttggagatcagcctgcccggtgtggtgaaaacccgtctctactaataatacaaaaattagctgggcatggtgatgcacgcctgtactgcccgctacttgggaggctgaggcatgagaattacttgaacccaggaggcagaggtggcagtgagccgagatcgcaccattgcactctagcctgcatgacagagactctgtctcaaaaaaaaaaaaaaaaaagtgtgtaggtatgtatacctaataaaattagcgctttctaaaaatgcagtgcttgtcatttactattaagtcaagccatatgaaatcacattttgtcagtaaataaatgttcagatatccacaatcttatacagttctaatagatactcaagaaattttgtcgacatgaagagagtcaaatcataaaatggtagactgaaaaagaacttcgtggagaattcttttctttttgcaaacagaggtgactgggaggtcgaggctgcagtaagtcatggtcatgccactgcactcgagcctggacaccagagtgagaccctgcttcaaaaaaaaaaagaaaaagaaatgattgcactgcctttttttggttttggaacaaatattgtgataataacttttacttataaatgtagcacagaaatcttttactttgtaaaagtccctgaatagaaagtcaggagacctgtttctcctaccaactagtataatttttggaaagctcattgttcatcagtttccttatttgtaaaatgaggatgttagatatgtaagatctctgtattaattaggatagttgatgctaactctttaacataactagcatttcagtgacttaacacaataatggtttatttcttgctcacgtcatagtgtgagtgtttagcctgtggctgtcatgtaattgaggaatttcaactccttccatctggtgtcttggagtctcctgctggattctttgtatttagttggttgatagcaaagagcaccagcaagcagaatttcatcaagtgctttgtagtgaagcataattcttcagctcacattgcactgtctagaacccactcacatggtctcaacttctaactccaagggaaataggaaatgtctttctgagcacccagggagaagaaacagaatccccatctttgccacggtccctttcattttgtacatttttaaaatttttttatttattattttttttaaagacagagtcaaactctgttgcccaggctggagtgcagtggtgtgatctcagctcactgcaacctctgcctcccaggttcaagcgattctcctgcctcagcctcccgagtagctgggactacaggcacgctccaccacgcccagctaatttttgtatttttagtagagacaggatttcaccatgttggcctggatggtctcgatctcttgacctcatgatccacctgcctcggcctccccaagtgctgggattactggcgtgagccactgcacctggcccattttttgattctttattcacacccaaatactttctcctgttgcatattgctttttgtatctttggttactctgaatttacttccaaatttcttggaaggagtttagtattgcaagtcaaagcagccctttggtgcttgctatgtttaggagagggtctccccccaacccctgccatccccagatgagtatatttgttatttttgttagtagtttcatttgtggtgtaagtttgtcttttatattgtcatggcttgcttagttttaaatgattaaaaatacatcaattgcaaaaatctcccagtgcttgtataagaaaaacaatagaatattgaacacagccaacttcagagggaaagtcattgtctaccatgttcagtctagcagcctgctagcagaagggaaaacagacaaaccttatactgtcttttaaaggtcagcacatgcagacttagagaccaatagagaaacacattccagtgagcaggcaaagttctctttgacttctgcccacttaagagtaaactcagagagtcagcaaaagtctttcagttgatttcagctgctgttttggagtcatctccatctttccgaagcctccttctcttttctccttttttgttctttcttgatacattatattgtacatgttcatttgtatgtaaatacaaaatatccttctttatggatccatcttatgttggtaagtttgatgagagtgttctaattctaagccttgtctccttaaaatatataattatctcagaataatgccatagttcagtttgccttatgtttggattagtactttcttgtgtagttctctttcagtaaactgctcccctcccctgtttttaattgcaccttttttcatataccatttgcaccacatgtctaagtcattggtctttttaaattacactatggaaaggttaattttggacagagttgtttctagatcctagtgcattatcgtcatcctaggattgcatttcatttctcttgtaggctaatggtactattttttggatattgcagctttaataggatgctgtgttcatttttcatttcctggagtctgtgctgaagttcattttcagaaagaatgcctggaaaataaatttttttttttcccccctgagatggagtgtcactctgttgcccaggctggagtgccgtggcgcaatcttggctcactgcaacctctgcctcccgggttcaagtgattcttctgcctcagccccctgagtagctgggactataggcgcatgccaccacgcacagctaattttgttgtgtttttcgtagagacggggtttcaccatgttggctaggatggtctccatctcttgaccttgtgatccgctcgcctcagcctcgcaaagtgctgggattacaggcatgagccaccacgcccagccaataattttttttaaattgtgtgtttgaatttcccattttagccttcacttaatggatgagttggctgtaaaaatctagcttcaaaatagtttttctcagttttaaaggcatcacttcattttttaaaaaaaatcatttagtgttacaattagaaataagcccatctgtttcttgtaagttggtaagtactgctgaggggaatttccctccctcccttcttgccaccttgccgaggctgtattcaaattcctgggctcaaatgatcctcccacctcatcatcttctttttgcttttcttttttccttcttttgtccctgtctctctactctctccattgtctgttcgttttcttcatctgcctctgtgatcatgaaaatattcgccatgttattgtttaccgttcacatttagggctgccatccacctggaattactttttgtatatactgtgaggtagagctcaaaatatccagttgacccagcaccacttattgaaaagacagttaattcccccactattttgcagtgtcacatttgtcagatattaagtatccatatgcatgtggttccgtttcaaaaccatttttttgcattggcctcttgttttgttttgttttgtttttccatatgttcagcacaccaagtacattggcctctttcttggtgattgtgcaggtaccacaatgttttcattactatatttatgtatttttagtttcaaacatatgacattgccataggttagaaactcatcagttttcagcattttcacatggttcaatccatcagtaagttttgatatccagtagtttaagttcctctaagtttgttctcaaagattatcttagctgttcttgactttttaaattactatgtaaaacttaggatcaacttttcagtttgatttgaaaagaaaaaacctactggactttgcttggggttatgttaaatctatagattaggccgggcgtggtgtctcacgcctgtaatcccaacactttaggaggccaagacaggtggatcacaaggtcaggagtttgagaacagcctggccaacatggtgaaaccctgtctctactaaaaatacaaaaattagccggatgtggtggcgcacgcctgtggtcccagctattcaggaggctgaggcaggagaattgcttgaacctgggaggcggaggttgcagtgagccaagatcatgtgccactgcactccagcctgggcaacagagtgagactctgtctaaaaaaaaaaacaaaaacaaacaaaaactatagattagtttggggatagttgatacctttaaaatatcataaaaccttaaaataaaataaaaccttataggtttttcctaaaagcactcccttagtaaatcacttgtacaaaaatccgtgcctcagattctacatctagtaaactgattctaaaacaccttcctaacaagggggagtgtgatgtctttctattgttaagttgtattaatcctgtgttgcatttcatttcagtgaattttatcttgaatggattaggtagattgttgattaattcagtgaccctcaattgtgggtgcctctcggactcaactttaatgagatttctctgtgtcatgattacccttactgcaagaaaaccaacaacactgagatttttggtgcagtagcacatgcttctagtctcagctacctgggaggttgaggctggaggatcgcttgagcccaggagcttgaagctgtagtgtacaatgagcacacctgtgactagccaatgcactccagcctgggcaacatagtgtgacttgtctctaaaaaaaacaaaacaacaacaacaaataatactcatattgcttaaccctgtccctgaacaattctgatccagcgtgttttttttgtttttttaatacttttaattcagatttttacttgtatttcaggtaaaatattaaaagttatgttactaataacttgaaagatctcttcaacttttgctgttcaattttcatttaataatgatattccccccctcctttttgaaagcatctgtaagatattaggtcaaagtaaggcctttgccacgactacaaaatgcttgttaagtactcccatagagtttgtatcttctccttcttgctcagaaaagctgagctactctacccttagtcgtgcctagaaccaatacttagaagaactatgagggtgcttccagctgtgcaaacatcaaccccagcaagagaaggctggtatggtatggagcagagcgcacctagcaggacaaatgtgcatttaatgagagcctgtgaggtttcaagtttattatatttagatgtccaggataaaaggtgagaaagatgctatcctagccatcgaggaactcaagcgttaaggggaactctgggtgggacacacattgtaaataaacaattacaagggtgggcatggtggctcacacctgtaatcccaacactttgggaggctgaggcaggcgaatcacttgaggtcaggagttcaagaccagcctgactaacatggtgaaaccctgtctctactaaaaatacaaaaatctccgtctcaaaaaccccacaaaaaacaaaacaaaacaaaaattatagaattggcagcacaaattcctatgtcctcttctaccttccacttttctttattttcactgatataaaatagagtgaaacttcactttgcttaatgggagaagtttttcttttgttatctattattttcaagacagggcctcactctgtagcccaggctggagtgcagtggtgctatcacggctcactgcagccttgaacttcctctgctgaagtgatccgtccacctcagcctcccaagagctgggaccacaggtgtgcaggctaattttaaaatgttttctgtggagacgcagtctcaactgtgttgcccaggctggtcttgtactcttgggctcaagcagttttcctgcctcagccttccagaatgttgggattataggcatgaaccaccatgcccagccaaaagagagttttttctttaataaaatagttctcaaaagctaagagctgatcaagtatgaatattcttcctttcttccaatctcctcagcactaagtcatcctaaagttacatgatatgcttattactttctgacagatatatgagctgataactatagagatttaatattttaataattataaagttttaatatttatatgatcatattaacatgatggtagtggctgatatctttctctctttctctctctgtccctcagagatgtggtctcactttctcgcccagactggagtacagtgttgtaatcatagctcactgcatcctcaagctcctgggctcaaggaatcctactgcctcagcctcctgagaggctggcactacaggcacacaccaccatgcccagctaattaaaaacatttttttttgtagagatggtgtcttgccatcttgcccaggctagtcttgaattcctgggctcaagtggtcttcctgctttggcctcccagagttctgggattacaggtgtgagtcaccatgccaggccagtaactggtcgaccatcttgaatatttgtttttgccacattgcatcatgtcatgcttttctaaaagcagagagagctatttttattgctatgcctaataatgataagatgaccagcatggagagctggttcgtacggttactccttactggctttctttctataattccagacaacatgcttgctcttgtacaaactgtgtttagaaagtggaagaaaataggtgaatattcttttttatttttatttttttgagacagagtctcactctgtcacccaggctggagtgcagtgacacgatcttggctcactgcaacctccacctcccaggttcaagtgattctcctgcctcagcctctcgagtagctgggactacaggtgcacaccaccacgcccggctaatttttgtatttttagtagagaggggtttcaccttgttggccaggatggtctcaatctcttgacctcataatccacccacctcagcctcccaaagtgctgagtgctgggattacaagcatgagccaccacacctagccaaggtgaatatttgtaattggtgataacctttcagccttgaatctgtttattctttttctagttgtgaagagtttttgtaattttggaacttctgattaatttcaaattagattcaatttctaataactttcatcgtgtcattttagaaatgtgtttttagccccttgttttgttggtttttatcattttggcctgtctcctctgtagtctactaggaacagagaaggtgtgcacatcactttgatgtggtcctctcttctgggacccagcagtttacaggagctggtatatacaactaactacagtggggggtccccaaccctcggtctgtagattggtaccagtccatggccagttaggaactgggctgcacggcaggaggtgagcagcaggtgaacagcattacattaactttgcgataagtgtgcctgagttctgccttctgtcagatcagcagtggttttagattatcataggagcgcaaaccctattgtgaactgcacatgcgatggatctaggttgcatgctcctgtgagaatctaatgactgatgatcggaggtggaagagtttcatcccgaaaccatctcctccctctcacccctcctgctatctgtggaaaaattgttttccacgaaacctgtccctggtgccaaaaggtttggggaccactgaactacagtatagatcagactctactgttacaagtacagatgatgtattagttctgaatactactgggagaaagattctaaaaagcagtcacagaaaaggtggtaagacaatttatgtggaccttgatttcaagactttcacaaatgaggagggagagaagataacttcaagtttggagagcaaatgagcatagggtgtacagtgataatgtaagatggtagatggtcccatgtgactaaattgtagggagaccctacatggaaagctgctgatgattatggtgggtgataggactgagtcttgtcagtcagccttgatattacacgtaagagtttggatttacaaaaaaaaaaaaaaagaaaaaagaaaaagacatctaggcattggggtccctttaaagatcaggtggaatgttttcctgatgttcaggattcttcctgcctgcctccctccttgcagaagaaaagataggtaggtataagtagtaggtaggtaaaggtatgtataagcaggtataattcaaaaggtatatgaagtacagcgaagtcattgtgttagataaaagcagaaactacaaaactgtaaggttttgcttattttgtcacgctctgcttctgtttttggtgttctgtggctcttttcgccgatcctttgtctcagcctcatttgtaagtgacttgttttttccatttctcatttttttttccatctattaaagtgaggggattggatcctagatcagttcaactggtgtaagcctttagagccaggcatggtggctcatgcctgtaatcccagcactttgggaggccaagatgggtggatcacttgaggccaggagtttgagaccagtctggccaacatgatgaaacctcgtctctactgaagatacaaaaattagccaggcatggtggtgtgcatgcctgcaatcgcagctactcaggaggctgagttaggagaatcacttgaacccaggaggcggaggttgtagtgagctgagatcatgccactgcattctccagcctgggcaacaggccaagaccctgtctcaaaaaaaaaaaaaatgcctttagaatgtggttagaaataatttttggattggtatagattaactctgaatgttttcctgtgttagaggaaggaagtgggataaatgtaaagtttaaaaaaaatgctcctttttcaaaattttgaggggttaggtattaagaatcttttaaagttttactcatttaaaaaatttagataaaatggaagattcattcttaaggttggtgatatcagaaatgtaagtgctgtgtcattgtcatttcttattttggcctacataaccgtaaccagacttcagacatcatgctgcctgtatcacatggctaacagtgggaggtatctggtgtgttcttcctggagaaatagattgaaattcatttggacagaaatgttgaaggcaggtgcctgatccaaaatgcatttagtcaggactgaacacaagctgcctggatagttcctgtaagtaagcaaggtagccttttaactttgtgatgcaaggttttatgtatgtgagtatgtgtgtgcaagtgtatacagtatttttatatccagagaacagggctcccttaaatggggggtgggggggactctggtaactacatgaaagtaaaatataacttctttaaacctatatcagtgtgttctttcatgtaggaatgtagctgtgtgatggcctcagctattctagtaatcaagggctctctgctgttgctaatcctatgatgaacaggacaaatggtggttacgaacagaaccctgtcaagcctggaaattccatcagtttgtaatagcacagctgttgtccttgaactgtgtagggaggaacctaggggtggacagttaatatattcttcaggggggttgtagtttattgctcaggatagtcaagatcttcctcagttgtctgttgctatctgcaagtctggtttggaggagaagcaggagaaattcagatttgtctgaggaatcatatgtgtctgtgaactgtgtaagttggtagttgattcctgtagacatccttgctaaagatttatttttaagtaaaatatcattttgcttgaaagtataaatcaaggttttgtggttaaataaattaaaaacagcacagctgccagacaaagttcagcttgatgtataacaggcctctgaaagaagttcagtaagaaacaaatctgggtaataaagttaattagtaactaaaaacctgctaggcatactaaaaaaaaatctgatgttgaatattaaattattatgaagcaggctatacctgtatccatcaagattataaatgatctcccacactggcgacgtggggttcctttcaagcctgaggaatgagcactatattttggccacagcattctcactaatgtcctaggatagcagcttagtgttggctttagaattctctgtcatttaaatgtcatgcaaaaacaaacgtataaaagaaaacattaacccagatatctttatggttccttgtcttgtccataaccgcccccgcccccacccacccaaaaaggacaggctatcagttatagagaaaatataagtgagcattataagcagtatcctacctttagtaataattatttaaagtttattaaatgggttgtttggaactcaaaatgatttgcctcaaagtagcctaggtcactgagaagaaagtttatttctttctgctgaaactgacaggaggcgatattttgaaagatagcaagcttgtctttggcatggtattaactccctttcttttgcctcctagggctcctgggcctgtataccctttccctactttgataccatatctatatctgctttattccctgaaagttcccatgttgccataatatttttcttcctttttcacaccagaaccaagaactcagacatcttcaatagaaccatctctgggatgaacaatggtctttccagggatgtacattttcttacccacttttaaattaagaaataggattctatacttttaaaaagagaatgctggctactgcaaatgaatgtcggtagaaatttggctaatgtgacacagtaaaatgaaggtttcctaacacagtggttaggaaaagtgagtatgatggtgggaatcaggcttctgttcttgctttttttttttgagtcagggtttcactctgttgcccacgccggagtgcagtggtgcaatagtggctcactgcagcctcaacctcctgggctcaatcagtcctcccacctcagcctcctgagtagcagggactacaggcatgtgccaccatgcctggctaatttttacatgtttttgtagagatggggttttgccattttgcccaagctctgttctagcttttcatgagttttttccctgcattttagctcccatagtagcacctttcaaggggtgaatagaagaggacagagacagcaacaggccattggtaaaccagattgccaatttctcatcagacagaatgagcacagaccccgagtgagtggctctagatgcgaatgacctaaaattttcaggaggacttcatggagcttaaaaggttcttcagaacttctgtgtaattaagttagatattaacactgtttaatctgtatagacctgtaaaatatttttagtacagtaattaattccagagtttgtgaactatccaaagtaaagcatacaacaaagtactgtggcctcatcatatatccttatttcctgtttatgagcacctagctcttaatagtgagattgtagtcaagagagtattttatcatcatgccatgtagttgcctcttgccttagtttacctattttaaaaaacccggctcactaatagtttcacttcaggcatgtcatcagaatgaaagatcagatatacaaagtgctgtgcttgaaaactgtgtgttcccttagtgcctggttagataatacagggcttattttctggcagagtggtgttgagtctcctttgatgttagccagaactgggtggagtttcttaagctccagtcagattggctcaagcagggcaccatgcagtggtgaatttgttttcagtccctccctttgccaaaaagcttttttttttttttttaataaacctcaacccaattataaatgagaatacttgatatatgaaataatatgaaatgatagttgttcatattcacactgagggtcttagggggtttatttatagctaactgaaatgatgcagctgaattacaagtagctgatagaataatcaacctcagtaaacatttaacataacactctcattttacagattagagaactcagccctgaaaggtgactcattcaaggccacagtgagtgtcagattaaactggtgcttcagtaaagcatacagacttctgtacccagctttcaaattctcttgactcttactcacaaatctatttaaagttaactttattatctgtatggatagaagaggaatagtataaatggtcaattggtcagtgagaggttttttttttagagtaaatgcttctcattcacaagggttcattttttgatcctcctgaacatccagatttgaaaataatagtgtcatatccttttatccataaaatatgtaactaagcatttaaggcataaccgaatagtaagtaacttcaagtgattctgtgtgagatgaaattcatacatgaatttattaaaattaattttggaatacttgaaccagtttaacatctatagagcatttaaagagtgtattgtacttatacatgtttcagaataaaataactataaaattggataatcgctttaatttattgaaaactggggatttctgggaaaaaaaaaacaacagtactttaacttgaaagatgacactagcattacctttctaggatcattttccataagggggtgtgtgtgtgtattttaaaatcatattctatttatgtggtgacaagtaaagaatagcttaactgttgatgaaatacagatgctaagtggctagctagatgtgctcatagcttcatgaccttcccactttccaattgtataattttctatcagttttaccctcttaggctgaatttcagctactgttcatattccatgaaccacatgcagcccaggaagtcatctgagagtgtgtggctgggggcggggtgggggtgctgagggttggataggggaaagattacaatggataaaagctgccctttgataatctgcattctgataaatgatatttaaaatgtattggtgtttttgactgtatttttaccctgtgccttaaatgaggaaaagatttgagtagattgcatcttatgtcattatgtatttctggggaaaattaaattttggatttttatggtatgttgttaaggatggcacagatgtccttttaagttctctttgaccatgaaactgatgcaggatttttgctccttagctcaactaggtccaggttcttatctcaggagcggaagaattaggcacgtggacatcaaagagtgagtggagtagaatctattaatcgaaaggaaagctcttagcaaaaagagagaacatggtaggtggttctactacctgaagacaggaaagttccgtaatatggctgagcctggggctctttattggttcagaatgggagtgtgtggtcattggtttgtgagtatgcaaaaaaggtcaaagcgaagacaccactccaaggtgggcaggacagtgtagaaaaccaattaggaaagggtaggtacaggttaaataggtgaaggatggggatcaatcatgccaaacgggaaggcaggttcttaatccgatctcaggatttacccaggacagtttccggattaaagttcgggtttcactgaggacccgcccctgtctgcctagacatttgtttgcctcttgcctctatcaaaactagttacagacgtcctttttagtttttggttcataacagctcccaaaggataactactaataatagttgtcagagatagaatagggaaatggcataaccgaatagtaaaagcaactgaatagttgcttttcatggaaccctttgacattataatctgttaggcttttaaaagctctttaatgaactcatttctcagcattttccctgtcatgatctggagttacaataatactttatatgtaaagtaggctggacgagcatagaatagggcttcccacccacattcgtctgttgtaaatgggtcacaggtgtgccactactactataggaacttttttttttttttttgagacggagtcttgctctgttacgtaggctggagtgcagtggcgtgatcttggctcactgcagcctccacctcctgggttcaagcaattttcctgcctcagcctcctgagtagctgggattacaggtgcataccatctaaataataaaaatcagtgcccagctagttattctgtttttgtatttttagtagagatagggttttactgtgttggccaggctggtctcaatctcctggcttcaagtgatccacccgccttggcctcccaaagtgctgggagattacaggctgggattaccaagtccagttcctactataggaaccattgaattcctatttatggttccttcagaaaagctgctaaatcctgaattcggcagtggttattcaaatagtggaatttataattccagtagtgtgagatggcatttgctgtggacaacagctctgtcatgccacaggagcccctttggcagcaaagctatcagtttttgtcacgagccccacactacttgttttagtcaggattctcttagagggacagaactaataggatatatctccaaaggagagtttattaagtattgatttacgtgatcacaaggtcccacagtaggctgtctgcaagctgagaagcaaggagagccaatccgagtccccaaaatgaagaacttggagtccgatgttcgagggcaggaagcatccagcacgggagaaagatataggctgggaggctaggcccatctcttcatgtttttcttcctgctctatattcgctggtggctgattagatggtgcccacccagttaagggtgggtctgccttccccagcccactgactcaaatgttaatctcctttggcaacaccctcacagatacacccaggatcaatattgcatccttcagtccaatcaagttgacagtattaacattacaagtccactccttgtcaacttgaacccatatacatctgagatcgtatgtaatcttaaaataaagacaataataaggtcataattacacctaatgtaataaaactatccttcatacaaccagaaacacaccaatccccaacccaaatactattacataaagttaataatacttaaatgctgttatgaaatcaataaatcttatgtcacatgataaaggaaaaggaaatataaagtgaagatattagtacatgtgtatacatacacaaacatgtttttaacaaatgaaggaggaaatactcatggcagttacagtcctcatttctgcagctggtcacgtggtcatagctggtattgatgactaccttcttctacccattctgtattaactttgccttccccaaatacctcagcaggtcatgggtttttttcctggtggagtgatccaaaccttcattcctgaatggtccggatcatttgtagtcctgcctggatttggctgttgtggttttgcattgacagtaatcacagggcatggtaatacgaagagatgccctaatgggtctcatgtattccatgcatactcttccttacttccgttgtgaagttgtagactgatttcatcttgatagtctgggtcagtcaccttagccaacactgtaactccccctctgagcctgttgacttaaagggaggaggagcccaaagtgtccaggtgacaatcttaacttccagtttaatggaatcattgttgtgtctcctggtggcagcattcttccctctggaattaagacctctaggccagcagaacataatgttgcaggagaggaagcaaaaattttgctagtggatcactaggggtgatggtgagtggtgccacttccagttccacccctcgattcctggacctgtgaatcctggctatgggagaaacagtaccttatattggacgctgattcagaggatacacggccttctggaggactttcccacagttctgcaaagtattgtcacctagttggcgttgtaattgtgacttcaataggccattccactgttctgtcaatccagctgctttaggatgatggagagcatggtaagaccagtgaattccatgagcatgagcctactgccgcacttctttagctgtaaagtgagtgccttggtcagaggcaatgctgcgtggcataccatgatggtggataaggcattccatgagtcagctgggtgcggtggctcacgcctgtaatcccagcactttgggaggccgaggcaggcagatcacttgaagtcaggagttcaagaccagcctggccaacatggtgaaaccctgtctctactgaaaatacaaaaattagctgggtgtggtggcgggtgcctgtaatcctagctacttgggaggcggaggcaggagaatcacttgaacccgggaggcggatgttgcaatgagccaagattgtgccactgcactccagcctgggcaacagagtgagaccccttctcaaaacaacaacaacaacaacaacaacaaaccaaaaaaacattccacaaatggtagtcttggtagaagcattgcatacaggataggcgaacccatatccagagtaagtgtctatttgagtgaggacaatcctctgccctttccatgatggaagaggtccaatataatcaatccgccaccaggtagctggctgatcacccaaggaatggtgacatactgagggcttggtgtcggtctctgctgctggcaaattaggcactcagcagtggccgtagccaggtcagccttggtgagtggaagtccatgttgctgagcccaagcattacttccatccctgccaccatggccactttgttggccatgggcgatggcaggggaaagaggctgagtggtgtccacaaaatgggtcatcctatccactagattattaaacccctcctccgctgaggtcacttgttggtgagcactcacatgggatacaaatatcttgtctttgaccactcagagaggtccatccacatacctcttccccaaatttgtcaccaagtttccaatcatgctccttccaagtccctgaccagccaaaccattggctacagcccatgaatgagtatataatcacacatctggccatttctccttccattcaaagtgcacaaccaggtgcactgctcgaagttctgcccactgggaagatttcccttcattgttgtccttcagggatgtcctagaaaggggttgtagtgctgcagctctccactttcgggtgttgtctgcatatgatgcagaaccgtctgtgaagcaggccctaatcttcttttcctctgtcagctgatcatagggaactccccatgaggccatcagtgcaggctgggagagagaaggcagggtggcaggagtggaggccatgggcatttgagccacttcctcatgtaatttacttgtgccttcaggacgtgcttgagcccgatcacgtatataccacttccatttgatgatggaatgctgctgtgcacaatccactgtatggctagatgggtctgaaagcacccagctcatgataggcagggcagttcaggtcgcatggtgacttgatgacccatagtcaaacattcaatttccactaaagcccagtaacaggccaagagctgactctcaaaaggagagtagttagctgtaatcagcactttgggaggctgaggtgggcggatcacaaggtcaagagatcgagaccatcctggccaacatggtgaaaccccatctttactaaaaatacaaaaattagctggatgtggtggcacgcacctgtattcccagctacttgggaggctgaggcaggagaatcgcttgaacctgggaggtggaggttgcattgagccgagatcgcaccactgcactccagtttggcaacagagtgacactgcgtctcaaaaaaaaaaaaaaaggagagtagttatctgtagaagatggcagggccttgctccaaaatcctagaagtctccattgcgattcacctatgggagcctgccaaagactccaaacaacatccccatctgccactgacacattaagcaccattggatctgctgggtcatatggcccaggtggcagagcagcttgcacagcagcctggacctgttgcagagccttctcctgttctggaccccactcaaaactggcagcctttcaggtcactcagtaaatgggccggagtaatacacccaaatgaggaacgtgttgcttccaaaatccaaatatgcccactaggcattgtgcctctttcttggttgtgggagagaccaaacacaacaacttatcctttaacttaaagggaatatctcaacaggtcccacaacactagatccctagaaattttactgagacagaaggtccctgaattttagtcggatttatttctcatcctctggcatgcaaatgtcacaccaataagtccagtgtgtttgctatttcttgatcactggatccagtcagcataatgtcatcaatgtaatggaccagtgtgatatcttgcggaagcgaaaagcgatcaagatctctccaaataagattatgacacaaagccggagagttgatatacccctgaggtaggacagtaaaggtatattgctggccttgccagctgaaggcagattgcttctgatgggccttatggacaggaatagagaaaaaggcatttgcagagtcagtggctgcatagcaggtaccaggagatgtgttaatttgctcaagcaatgaaaccacatctggtaacagcagcagcaattggagtcaccacttggttaagcttatgataatccactatcattctccaggatccatctgtcttctgcacaggccaaatgagagagttaatggggatgtggtgggaatcaccacttctgcatctttcaagtccttgatggtggcactgatctctgcataccttccagggatgtgatattgtttttgatttactatttttttaggtagaggcaactctaagggcttctatttggcctttcccaccatgatagccctcaacctagcagtcagggagccagtgtgggggttttgccagctgctaagtatgtctatgccaattatgcattctggcactggggtaatgaccacaggatgagtccagggacccactgggcccactgtaagtcagacctaagctaaaacttcattaattacctgacttccatgagcccctagtttaactggaagaccacagtgatgttttaagtcccctggagtcatcatcagcccagagccagtgtccagtagtccccaaagtgaaaggttggatggaggtctccttggggaaggatgggagaaagattcactgcataaattgtcagtaaagtagtggggtcctttctcaagggtacctggcctccccttcattcaaggggttctgggtctgtaaactggctgaagtctggaaatggattgagtgaggggccatgattctctttttataattcaaattagtcttttgtccattcgacctagaagttttgtgtttgtataaattaagtgggaatgcagtaggcttcctgtccgtttcacttctaggaataccgtgattaattagccaatgccagagctctacatgagtcagactattctgattgtcactttgcctctgctgtccattacggtagctacgcccaccttgcctttgatggttgagtgctgctacttggcccctgccaccttgggatccagttattcccctcgtatttcaattttgtaattgagtgactgcggttctcaccattaggtctgacatgcagagaagagcaattacagggctcttcaaagattcaagtgctgccctcacaaatctatttcacaaggcattggtcaagggtatatcttctggaccctcccagctgggatgagtaggtctaaagtgagtaatccactccaccacctcaatctccctaagcttttggatgccttcctctacattaaaccaagagatatcaggcatttccagctccctcacagtgggccatcttttaatgcatatttcagctaaccaagcaaataaactattagaaccttattttaactccccgagctgcaacattaaatgcagagtccctacttagtgggcccaaatcaataaattcagcctgatccaactctatgttccttccaccattatcccatacccttaatacccattcccatgcctgttctccagattgctgtttatataaattagagaacagttcttttttttttcttagagggagtctcgttctgttgccaggttagagtgcagtggcacaatctcagctcactgcaacctccgcctcccgggttcatgcaattctcctgcctcagcctgccgagtagctgggattacaggggtgcaccaccacgcccggctaattttttgtatttttagtagagacagggtttcactatgttggccagactggtcttgaactcctgacctcgtgatccgcccacctcggcctcacaaagtattgggattacaggcgtgagccaccgtgcctggccgagaacagttctttttgagtgtagcgcacctcctcctgggtcacactctcaacctcacctctagggacctgtgggacttgagttataggtctagaagcaaatgggtgttgcaggtaccttctaaggagaatcaacattatcttgcctggcaactgcctgagaggaggccatgactcttgcctcaggcagctcagggtttatgtccgtagacaaagatggaaaggttgatggcggggatggggggttatgctgccactatgggggatggggaagctgttccttctggcaaaaaaagttcaccagagtttataaactcagtgttcccagcttcatcagggtcctcccacacatccccattccaagtttctgggtctcattcttttccaatcaatgccctcactttagcagtagacacctcaggtggctgtgcatgcatcttttgttgcaggtcagccactcgcatgataagagcttatgtctgtttttccacaatttcagctctttctcaacaggagctaagactctcactcagggcaatcttagcagatttgagactcagtatctgcttctgaagccaggaaacagaatccctgagttcatcattttctttcatcactttgttcactgaacttaggagcaaccaaccagcttcattatgttcgttggttttccacatatggtcaaaggtattatgtatagagtcactaaagtccttacctttcatgagcagtgaatcaggagtgtcaaatgcatttattttgcataactctctaaatagttcacgccaaggactatgaatgttctccatgctattagaagtagagtcctcagcatttttggatcaatcatattaagcagccaactccagaaacccccaaaccaacaaaagaactccatccttaacattctgttcctctggaaccactcctggtaccagagtctgtgttagtctggggtcagagttttcttagaggaacagaactaataggatatatatgtatgtttataaaaagaggaatttagtaagtattgacttacacaatcacagggtcccacaaaaggctgtctgcaagctgaggagcgaggaaagccagtccaagtcccaaaactgaagaacgtggagtccgatgttcgagggcagaaagtatccagcacaggagaaagatgtagactgggaggctaggcccctcttgcctcttcatatttttctgcctgctttatgttcgctggtggctgattagatggtgcccacccaattaagggtgtgtctgccttccccagcccactgactcaaatgttaatctcctttggcaacaccctcacagacacacccaggatcaatgttgcatcctttattccaatcaagttgatgctcagtgttaaccatcacactaataaaagtgtaattcttgctgaccaaactgagctgtgggctaagatgggagtggaaacagctctagacaaaagggccatagactcttcctggtcttaaccaaagctcaagcagatttcgagaatgcaaagcttctcaacttgtgttctacagtttgttgatgtccagtgctttggaatggctgatcataacagttttgtacaatttaatatgttttttttttttttttttttgagaaggagtctcactctgtcacccaggctggagtgcagtggcgcgatctctgctcactgcaacctccacctcctgggttcaagcgattctcctgcctcagcctcccgagcagctgggattacaggtgcccaccaccatgcttggctaatattttgtatttttagtagagaggaggtttcaccatgttaaccaggatggtctcgatcttctgactttgtgatctgcctacgtcagcctcccaaagtgctgggattacaggtgtgagccattgcgcccggcccatatttacttttttatggagaagattcaacagcttctttatgacatctattattaaactctctcagtgcgtgtctttctttgacataatttgctcttgtcgctatttttcttctaacagactgattaaattggatttaactttattatagttattagatatttctaaatggaattaaatttatttatttatttatttatttatttatttatttatttttggccttaatgttaacagccagagtgtgatttattttttacttatttatttaaaagtttttaaatttaatttttgttttttgagacaaattttctgtcacccaggctggagtacagtggtgcaatctcggctcactgcaacctccacctcccaggttccagtgattctcatgcctcagcctcctaactgggaccacaagtatgtgataccacgcccagctaatttttgtgtttttagtagaaatggggtttcaccgtgttggccaggctggtctcgaactcctggcctcaagtgatccagctgcctcaggctctcaaattgttggggttacaggcatgagcctctgtaccctatttattttttatttttatttttaaaaattttttgagacagggtctcactctgtcacccaggctggagtacagtggtgccatcacaatcatggctcactgcagtcttaaactcccgggttcaagcgattgtgacacttcagcttcctgagtagctaggactataagtgtatgccaccgtacccagctaatttttttttagtttttgtagaggcagggtctcagtatgttgcctagctggtcttgaattcctagtctcaagtaatcctcccacttcagcctctgaaagtgctgggattacaggtgtgaaccaccacgcctggctcagagtgtgattttttttttcttttttttttctttttgagactagagtcttgctctgtcacccaggctagagtgcagtgatgcaatcgtggctccacacctggagttgtggtggctattcacagacgtgatcattgcacactatagcttggaactcctagttacaatctccctgccccagcctcctgaaaggctagaactacaggtgcatgccaccacatctgggtcacacgtatcttttgacattttttgagacctaaatgaacttcatcaaattccaagtagtatgatgacagagtcgcatgaacctgggaggtggaggttccggtgagctgagatggtgccgttgcactccagcctgggcaacaagagtgaaactctgtctgaaaaaaataaaaaataaaaagatatgatttaggaactcattagtatagtcacaggaaatttaaatatcacatttgctttaagaaaagtaagcaggctgggcgcaggggctcacacctgtaatcctggcactttgggaggccgaggtgggtggatcactttgaggtcaggagttcgagaccagcctaaccaacatggtggcaccctgtctctactaaaaatgcaaaaattagctgggtgtggcggtgcgtacctgtaatcccagctactagagaggctgaggcaggaggatcacttgaacctgggaggtggaggttgcagtgaggcaagactctgcctcaaaaagaaaagaaatcagagaaacagctcttttctactacatttttgtataatggtactacctagaatttgaaaagataatcatttaaaattattgatgaggaattaaggttgttatttcaaataggaaaactcataaaattaggcacatggaagaaggcttaaatttatttgaaatttttagattttatttggaagtctatataaatataattgattatttaatatctttccaaatcttggtattgtatttttttcttagataatataaagaatatgtaatgaatgttttcactaagctccatataggtagagacaaactatctccagcattcccagtactgaacacatactatcttttttttctagacacttgcctagaagatgtagatcttgcccctggccttaattatcctgtctgtacttatttgggtatcggatcttgattcttaagcctctgtgccaccactctaatatatagcaacaccctttgcttgttggatttgggaattgggggtacgatgacttctgatttttcagggtctggaagtatttgctttgtacatgttttgtaatcatggtagcctcacagcatgtaagtgggaggagaggagtgtgtgggaacaaagatgaagataaaataagaaggaaggaagataggaccatattccttgctttaattctatttctttttcctaagtacatttgttggagagaggtagacggtggataacagcttgaaaggaaagcctgaaaattaagtggcttgaatcatagtatatttttactttttcaagtttgggttggagaaagactgtgtattagttgagattcttccattgtaaacaacagaaatagattggctaaattaggcaaaagaaagatgaaggccgctcacttagacttgaagtagtcaaccagggcaactaaatagctgtcactcatggacttttcttccagcgtgtagtcaataaatgatcctttccaactgtcttcttcttgacttctgattgacccaactctagtcatgtcccaaaccctataggggtagggattggtttgtattaggggagataggaagaatagatttctggacaaacacaagtagtggccattacattgtgcaactaaggatctgtttgacttgtatttaccttgtcaacaacatagcttatatgtcaacttatcctatggagtctcttggagtttctgttagactttttgaaagcaggcgtagtaccttgcacactttatttcctattatgccctgcatttgaatggtgcccaatttattgcaggcctttggctcttttttttttttttttttttttttttgatgggggagtcggagacttcctctgtcgcccatgctggagtgcagtggcgcaacctcggttcactgtagcctccatctcccgggttcaagcgattctcgtacctcagcctcacaagtagctgggattataggtgtccaccaccatgccttgctaatttttgcatttttagtagagatggggtttcaccatgttggccaggctggtcttgaactcctggtctcaagtgatcctcctgcctcggcctcccaaagtgctgggattacaggtgtgagccactgcacctggcccctttggctctttttactacattatttctgtattttctaggctattcacctatggtttgcttatagatttactttttttttttttttaaactttattttaggttcaagggtatatgtgaaggtttgttgcataggtaaacacatgtcacaagggtttgttgtacagattatttcaattaagtctagtacccaatagttatcttttctgctcctttccctcctcccaccctccaccctccaggagaccccagtgtctgcagtttctttgtattcgtaagttatcatttagcttccacttacaagtaagaacatgtggtatttggttttctgttcctgcgtcagtttgctgcggataatatcctcctgcttcccatctatgttcccacaaaggacatgatctcgttcttttttatggctgccagtagatttacttaactgcagattatgtaattaagaagctggtagtctgtaaaaatggtaatatacgtgactacagagagggaccatctcccttagctaattgagggaaacgtgtctttttttttttatgctggcagggctaagtagtttggttgacaggactatccacaagtgattcatgaagaagcaggtactcactccaagataagatccatactcacagtctttggtcaagaaagttgatttcatttgtccgatagtaatgtaactatgtaaagacctgatttgaatcttactggctatagctttggatatgttgattgtggggtttttttacacctcacttttcttataaatagaaaggacacaattgcaattgctttgtcctgccaccaccacctccctccacccccagaaatgtgagaaaagagtaactagcggtgagttaccttgggtcagactgtccatttcttagctttatttttctcatctttcaaatgagggagcctcttctagctgtaaaatcttagattttgattcttttgtttgtttcaaacaattgacaagagtttctagaaatgtttttccttttgcagtgctcgttacatgaaagatctttttcctcttcaccaggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaaggtaagtatttaaaccagactgcttatatatgttcagaaagcaggttagggattatgcctttggtataatcttggaaactgagaattgagctgagtttttttagtgtaggctagtaactttatgtttctttgttagataccgaggaggtagacttaccaccctttgagtgagcgttcatgagtctgtggatgacttttaaccctaatgtttcttctctaatgtttcaacaaccatataatcttcttcttaatttcctaaattaaactgtctactgtgccttttctctgaaagtagctttgaaaagttaaataaaattctgcggttatatcagaacttcatttagactggaatcagatgccatttgttgtctttggagtcatcccacctcaggattaaagcataattaaagcctttaagagaaatttgccattttcctggatcagatgtgctaataattggctgagtatttttgtatctgtgttcatgagggaattggtctgtagttttctcataatgtcttctgtccagttttagaattgaggtcacgccgacttcataaaatgaattgggaagtgttcccttctttctcttttctagaatagtttgcatagaattgatattttttcttcttttcagtgtttgatagaattcatcaataaagctatctgggcctggaattttctgtcggatttttaaactaggaatttagtttctttcagagatcatagaactattccagttatctgtttcttaagttagctttggtagtttgtatctttcaaggaattccttggtccctttcctggcataaatgttgcagattaatggagatatgcttttaatgtctgtaggatctattatgtcccctttttcatttcttatactagtaatttgtgatgtttctttctttctttctttctttctttctttgataagtctaggtagaggtttatcaattgtattgaaagatccagcttttggtttcattaatttttttctattgtctttctgtttttaatttcttctcatatctttgttttttcctttcttctgtttacttaagttgatttattctttttctggtttcttaaggtgacagcttaaatcaggttttgatctgagacatttcttttctaatgtaattacttaatgttataaattaccctctaatcaccattttagctgtgtcccatggattttgatatgttgtatttttattttcattcatttaaaaatatttaaaaatatttcctttgtgaattcctctttgtgtctgcctttaagattttatctttttttttttttttttttagcagtttaaatatgttgtgtttagatgatattttggaagttttcttcttgggcttttctgagcttcttgatctgtgcttttgaagtggttaagtcagctgggaaatttttggccattatcttttaaaatatttcttctgccccattctttttcttttctcctgggattccaattatatttttgttaaattgttggatagtgtcctgtatctcttggatgcattgttggtttttttctctctttatttctgtttgtgttttactttgggtactttcttttgacctatcttccaattccctgatcttttcatagttgtgttgaatctaatgatgagctttcagtggcattatctactttagcattttttatgtttttaatttctagcatttctgtttgcctctcttataagcttccttatttctgtcaaaatttcccatctgttcacctatgttttccaccttttctactgtagactttaacatattaatcatagttgttttaaatctctgtgtgataatttgaaaatctgggtcatctctcagtctgattgctctgtgtgtgtgtgtgtgtgtgtgtgtgtgtgtgtgtcttagtttttgattgaatgctggatctcacatgtaaaatagtaggctgaggccaaaaggtgttatggttggaaataggcatgtctcttgggtttagtcattttaacaggagctgagctagttttgggttttgtcattaccgtaattgccttcagtgtactactgtcttcaatccctttaattctatgcttagagtggggactgaggccctggaaggtatttctttaatgtgcttgctccactctttcagccttccctgtgtacccgtgcctcagaggggtccttgtccatgctcttttctctcttatcggaagagttctagccaggtggcaggcagagtttgtttttttattgtcccattttgtgcttaatcctgtgcttaatctcacggtttgggtctttctcaacgttattatccttttcacagtagtagcgtcttctcatggtattggtgtaggatcctggatgaggagtttttcttgctcctctctcaggtttataaagtatgtttctattactctttccctagctacagccggtcttcttgtgtgctctggggttgacagggtttgtactccttccccaggagagaaagatcccagtgggaggggttcatgcttttcccttaatggtggtggccttctccaggtctgtaccatggagggaggctctgtctggtccctcaccctgcttccaatctttcctgtgagcatgcggcagacatctgtgaagacaatcctgcaaatgagtgtgaattccctttgtgtctgtggatttgaggggccccatagtctcatgctagccttcatttacctttgacaaatcactacaatttttacttgaatttttcttacctgcttgtagggtacccaatgtctcttctgcacatgctctgatacaggagagctggtgttcacctcccatatttcctggaggggcttgtttttctttggatttcatactactaggtggctttccaattaattcaagttttttgtagttgatatggctgtttcttgttgttagggtgggagtgacgttgcttttggctttctacagccaagtggaagaagaaaacctgcttccttaatatatgtttaatttgtgtgttggggagggggggcagaccacaactcatttaaaaaagtaccgagagttctaattatatccatataaatatttactccagaccaggtgcagtggctcacgcctgtaatcccagcactttgggagaccaaggcaggtggctcacctgaggtcaggagtttgagaccagcctggccaacatggtgaaaccatacctctactaaaaatacaaaaattagccaggggtaatggtgtgcacctgtaatcccaggtactcaggaggctgaggtacaagaatcacttgaacctgggaggcggaggtggcagtgagtggagagcgtgccactgcactccagcctgggcgagagaacgagactctgtctcaaaaaaaaaaaaaaaaaagaaaagaaaaaaagttgctatcattgcttacaaaagtatcttgatgttgcaaaagcttatgttgagaagtaaagttcatattttatttttatcctttaattcaattttccagaaactcatacattttttgaacaggctaaaaaatacacatgtacaaaatccaattggtccaaagggatgtacggtaaaacaaattctcccaatccctacaccctagccagacagttctccttcctggagtaaccactcgccaatttctggagtagtctttctgagttaatgaactttttttttttttttttgagatggagtcccgctctattgcacaggctggagtgcagtggcacgatctctgctcactgcatcctccgcctcccaggttcaagcgatcctcctgcctcaacaccccagtagctgggattacaggcctgcaccaccatgcctggctaatttttgtatttttagtagagatggggtttcgccctgttggccaggctggtctcaaactcctgacctcaggtgatccacttgccttggcctcccaaagtgctgggattacaggcatgagccaccatttacatatcaaaagtagcagggaggatttaattttttataaataaaataatgtcttaaaaactttcctcctcttgggccaagttaatgttacatggatcaaataactcaagatgaagcacaagaaaatctactgctaccacctcactgtccttatccacctaggctcattcccagatgatggaaacaatgcacagttaaaggaaattagaaaacgaaaagcagctagcttctttcacctatgactgatgagggtaagttaatattaggatgggaagagcatctcaaccatgactagttgctaccatatttacatcttatcattcctttcttcatactaggttttctttgtttatgttagtcagtcaaagaacaaatgtctccaccgtgcattatggattaagagagaatagattttcccgttttccattaaggaatccaaattttttggagtaaatatttgtttttcttttgtgctgggattataggtgtgagccactgtgcctggcttttttacattattaaatgaagaaaaatgaagaaatgaagaaaaatggatgccctttaaagttttttttggtttaagtttttaattttttgttgctaccaaagatttttttaaagattaggaaacaaaaaagaaggaaccaaatcaggactgttgtaaggtggttgcctaatgatttctcatcaaaactgtcacaaattatctttgttgatgaaaggaatgaacaggagcattgtcctggtggagaaggactctctgatgaagctttcctggctgtttttctgctaaagcattggctgactttctcaaaacaccctcataataagatgttgtcattctttggctctccagaaagtcaacagacaaagtgctttgagcatcctaaaaaactcttgtgtttgctcttgactgatccacttttgctttgactacagcacttacgcctcttggtagccattgctttgattgtgctttgtctttaggattatactggtaaaaccatatttcatctcctgttacaattcttcaaagaaatgcttcaggatcttgatcccacttgtttaaaatttacatcgaaagctctgctctttgcagctcatctggatgcaaccattttggcaccagttgagtggaaagtttgctcaattttaatttatcagccaaaattgtataaactgaaccaattgagatgtctgtggtattggctattgtttctgctaattgtcaatcctcttcaattagatcattcttttttcctctcaaattgatattggtggtctgccacggtgggcttcatcttcaacatcatctcctcctttattttttttctttttttgagacagagtcttactacattgcccaaattagagtatagtgactatttacaggtgtaaccatagcacactacagccttgaactcctgggctcaagtgatcctcctgtctcagccttccaagtagctgggactataggtgcggaccactgcatctggctgatgtcttaaaacaagttattcatgtgtaaactactgatttgtttggggcattgtccccataaactttacacaaagcatcagtgatttcaccattctttcatccaagcttcaccataaatttaccatttgcttttgcttcaattttagcagaattcatgttgctttattaggggctcttttcaaactgatgttttatcctttttagtgcttcaaactagatcctgttcagacgtgttataacaagttagtatgagctttttttttttttttttaagatggagtgtctctctgtcacccaggctggagtgcggtggcacagtctcggctcactgcaacctctacctcctgtgttcaagagattctcctgcctcagcctcctgagtagctgggcttataggcacatgctaccatgcccagctaatttttgtatttttagtagagatggggtttcgccatattggtcaggctggagtatgagttattttgatacaaaaaaactcccttgaaatccatgaataattttttcatagaatgcattttccacgaacttgttgaagataccatgtttaaagtttataattatagctgggcgtggtagtgtgcgcctgtagtccgagctacacaggaagctgaggtaggaggcaatcacttgagccccagaggtcgaggctgcagtgagccataaaagcaccactgtgctgcagcctgggtgacagagagagaccccgtctctaaaaataataataataataaagtttataattatgataggttgtaaattactacattttttccataccagcttcctaaaagttgtagaagtcttaacttaaaggaaggggtgatggctgtttggagacatcaaataagaaaaacgaaggaagccgccttatttagtcttgtagaaatctggtgcaattagtgagttctttatgaatggagacttctctgctgtgggtctgatttttatacattatcggactgatggtttttgccataatgacaggtttcatatttgtgtttttcctggagaacattctaaacaagatgttcttctgaatacatctttagaagtgatggaagggccctagacttcattaatgttttattatacatctaactttaagtttgattttgttcttagatgaggttcagtaaactactgctgattgctgacactttttttttttttgaagacagggtcttactgggcgcggtggttcacgcctataatcccagcactttgggaggctgaggcgggtggatcacctgaggtcaggagttcgagaccagcctggctaacatggtgaaaccctgtctctactaaaaacacaaaaaaattagctgggcgtggtggtgggcacctgtaatcccagctactcaggaggctgaggcaagagtaatcacttgaacccgggaggcagaggttgccgtgagccgagatcgtgccattgttgcactccagcctgggcaacaagagcgaaattccgtctcaaaaaaaaaaaagaaaagacagattctttccatgtcacctaggctggagtgcagtggcacaatcatagcttactgcaacatctaacgtaactcctgggctcaaacgttcctcctgcctcaggctcctgaatagcttggactacaggtgcgcgtgccttgcttatccttttatttttatagcgacagtcagactgtgttcctctggctggtctggaactcatggcctcaagcgatcctcctgccttagcctcccaaagcactgggattacaggtgtgagccaccacacccagcctagtgctctcgatatgttcttacaacaggcttagttaggccaaccagtggaagtttatcaaccattttcttgcctctagatatagaagggacggttgagtaggttacacataatagaactctttgaacaatggtgttttatttcctttaattcttacatgtccaccctaattgtcttcaacttataaaatgagaagtaagaaagcagggttgcttttatggcatttatgacaaagtaggaaaattgcttttttctctaagtatgatttctgccttcatgcctggcaacacaagaaccccccgacctttattccttttctttggatctactatactcatttccttttgcacttcaacttattcttgcttctacaagtattttatcttagcattgcctgtgtaaaccatctaaataccaatacctagaaataaaattggtgtcaaactcttcttctaaaatgcctatcaccttgggaaacaattctcaaatactttttcaggatatgtgtactacttgttttgcaccacggctgtaataagaaaaaaataaaaagaaaattatgtacttcctgacttttttccttaaaaaatggtgttttccttaattgttcattatcagcattatatggccctattttctaggtgagggagacaaaagatagaaccctttctcttagatgtgaatgacgaagcaaacatctgtgactcttgttctttcagatgatcatctagcacagtattgaccctcagacacaaatagcacatttatggaacaagtcacttaatttttctgttctctgtgtgattaaatagttcttcttctgaagtcgagaaaatgctttctcctcaacattccataaggcctttgaagctaaaagcttattcccatagaataagaagttaacacagggcaatggcctggctaagttttttgcatttttagtaaagacaaggtctcactgtgttgcctggactggactggttttgaactgctgggctcaagtgatcctcctgccttgacttcccatagtgctgggattacaggtgggagacaccgtaccctgccacacaccagcagtctgttttaacaagccataataggtgactcggatacacatgcatgattgagaaacactaatccatggaaaagggcctaagtgacaactattaatagatactgcagaatttctccttaatacactggtatttcttttgcagaaaattgcaaccagcttaattggccagtagagggcagtgttggcatgggtctgacagcaccagagggttcccttgcattgagacctggctgttttgcccaaggctgactcacagcacacatgccttctcaggttcttgctacttctctgccaagctgatttgcctgctgtgggaatctgacatctcctggggagagggaatcaacaaaataaagtaaatttgaatatctttatatctcagagaatgtgattagtttctaaaaaaaaaaagtgtgctattttcgatgctgtgtgtatttcactgagaaagttttcatttcatgaaatgggggttctctggggaagtcagtcagtgagaaaacacattatagcatcttttgaattaggacttttccagtaatgtgcagtatgattagggtccagtatgtcttatctggcagggaaatatacaagccttttttctacttgtcaaccttattgtttttagtgttgttacgttgtttttattctctcctgggcttatatttttagattgtgaggtgttgtatgtatagtagaatccagcttctcttcttcctttctaacctcttcttgctttcattttattttattctagtaaagtttcttgatcagcctacagttattctataggtggttgatagataaatttacagttggtcaacatatagttaataacagtgagaataacaatagctaataacagtgagaataacaattactatttagcactgtacagttgacatcctgtattactgcatttagtcccacttcccaggtgaagcttaagtattagaaatgagaaggttgcatttgatcatttagttaataatgacagcacaacctgaacccagatcttctaatctcacttttatttttattaaacaattaaaacaatattttttaaatagagatgtggtcttgctatattgcccaggttggtctcaaactcctggcctcaagcagcccttccgcctaggcctcccaaagtgctgggattacagacatgagctactggatcttctcattttaaacccctgttctggctgggcatggtggctcatgcctgtaatccccagcactttgagaggctgaagcaggcagatcacgaagtcaggagttcgagaccagcctgatcaacatggtgaaatctcatctctactaaaaatacaaaaaattagccaggcgtggtggtgctcaccagtaatcccagctactcagggggctggggcaagagagtcttgaacccagaaggtggaggttgcagtgagccaagatcgtgccactgcattcaagcctgggcgacagcgagactccgtctcaaaaaataaataaataaaataaacccctgttctttctgtgaaactatacctttttcatgaacacatactttctacttgatctagtatctcactgatagtttttaaaaactaaaaatccattttttaaattcaaatagaattattagatgtatgttcaggaaatgtaaaagaatcttgcttcatttcaatacagagcacaaactgagggactctgccactaattcacatgagtttgtaaaatatttcactttcctagacaactgtttcacatctactctctgaaacttctggcacttgctctcctgttcatattcataagtcatattcataaattaattggcttaatcagaacagaacttccacatggtcccaccacatatttcctcctcacctatgttcatctatgcccttattgtctgctctttttctgttatgggtgaactgttcatgctgtcactcaggccactgctgtcacagttacctcttctgtctcctgcatcatcagttcttttctttcaattgggtcattcaccagcatcaaacatactataatttttttatcattaaaaaaaaaatcctgtctgaatctcacatccatctcatctatctttttgctttgctttctttttttttttttttgagacggagtcttgctatgtcacccaggctggagtgcagtggcgcgatcttggctcactgcaagctccgcctcccgggttcacgccattctcctgcctcagcctcctgagtagctgggactacaggcgtgtgccgccacgcccggctaattttttgtatttttagtagagacggggtttcaccgtgttagccaggatggtctcaatctcctgacctcgtgatccgcccaccgtagcctcccaaagtgctgggattacaggcgtgagccaccgtgcccggcctgccttcttttaaagagacgtttctactacctgtcaccaattcctttccttccatttcctcttgaattcactctcatcagactttaacatatgcatgaccccaaaacttctcttacctaaagtataaggccttgatgttgccaaggacaaatccagtattactccaggggttttgcctgagcaactgaaaggaaagaattgccatcatctgagatggggaaagctacagaaggagtaggatttgaagggaagagaagaaatttagcttgggatatgttcacatttagttacctgctagtcatcgaaatggagaagatggatacacagataaggagtccggagtttggaggacggttctgggctggaggttgatgttatataaagcttttgctagagttgttgttctaaaatcctttaagattggatttagatgtaactttccagaacattccctgacttctgttccctttcccttctagacctcccactacccccacaccctgccagcctttcttttcatcttcctcttggtaagtgcttttcttccctgaactttcctctttcctctgtggtacttgtaagatcataattaagctatttgttatcttacacttattaacatgctctagcacaggaataatattttgtttactgccatatttcatggagaatgacacatttagcgaaagcaggatggcacagcataatcaaagtttactagcgacctcaagtttctcagggttaagaaatcaaaggttacagtgacaagtgaccggagagaatcatggagaagcagatcaagtgaaattatgaagaatctcatggtttgtgagaaactgagggcgcaggggtactgagaaacctggccagatctgcattagagaccactgctcttggcacatgatagatgtgtaatcattgcttattacactgaattgaaatggtttttgtttgtcagtttattcaggtttgggttgtgttaatgtacagactaacaaacaattgtgtctccaaaatggtagatatttatttagggtaggtgtacttggtctaatcctaaaccctcttaatagtctcatgatcatatttagggaagtttatatatatgcataaaaaattagtgtgacatttttgcaaaaatagttattttctgactttgatttgaaaacagacttttatctcataactaatagttctttttggggaaaaaaaatatcgtaccaaaatgtatagttcataataatagtaccctagtctgaaagaagagcaggggaccgggacccgggggctcaagcctgtaatctcagcacttgggaggccgaggcagatggatcacctgaggtcaggagtttgagaccagcctggccaacatggcaaaaccccgcctctactaaaaatacaaaaattagccaggtgtggtggcatgcgcctgtaatcccggctgctcaggaggctgagaaacgagaattgcttgaacccaggaggtggaggttgcagtgagctgagattgtgccactgcactccagcctgggcgacagagtgactccatctcaaaaaaaatacaaaaaaaccccccaaaaaacaaaaaacaaagcaacaaaaaaaccacttcattgctaaaaatattctgcaagcaagccaggatggtggtatgtacctgtagccctgcccgagctacttaataggaaggaggattgcttaagcctaggagtttgagtccagcctgggtaacatagcaagaccccaaagaccccacctcttaaataatattctgcaagcaaatgactttgttaaacttcacactgcaagaacagagccaagaacctaccatgtaccctttacttggatttatcattactgttttgcacatttgctttatcattcttgttatatttacatatagttccttccccttggattatttgagaacaaactgcagaactcacacctctttccccgaagaactaggcattagcacattacaagaatacgatgatagagatcagaagttaaatgctgatgagatattcctgtctaatccacgaaccttatttcattgtcatcagttgtcccaacagattcaacacattcctttctcatttttttcttcttgtctgcaattaaatctggaatcacgttagttttcatgtctcttcagtcttctttaattggaacagttcctcaactcttctttgtctttcatgaccttaatattttgaatagtatgggcaagttattttttagaagtcccctaatttgggtttgcctggcatttcctcataattagattcaagttccacatttttggcagtagtactatgtaaatatgatgtgtcctaagtgcaccacatcaggaagcacatgatgtcactaaatcacattattggtgataataactttcatcacttgttagtgtctgcctgttttctttactgtaatttttttccaattaaaaaaaagcatttatttatttagagacagggccttactctgtcaccctagctggagtgcagtggcacaatcttggctccctgcagccttgacctccccaggctcaagcagtcttccagcctcagcctcccaagtagctgggactgcaggcatgcaccaccatgcctggttaatttttttttttgacaaagtcttgctctgttgcccagactggagtgcagtggcaccatcttggctcactgcaacctccgcctcccaggttcaggtgatcctcctgcctcagcctcccgagtagctgggattacaggcatgcaccaccatgcctggctaatttttgtatttttggtagagatggggtttcaccacgttggccaggctggtctcaaactcctgacctcaggtgattcacccacctctgcctcccaaagtgctgggattacaggcatgagccaccccccagcctaatttttatttttattttttaattttttttaagacggggtctcactttgtctcccagtctggagggcagtggcatgatctcggctcactgcaacctccgccttctgggttcaagtgattctcctgcctcagcctcctgagtagctgggattacaggtgcgtgccaccacacctggctaatttttgtatctttattagagacaggttttcaccatattggccaggctagtctcgaactcctgacctcatgtgatctgcctgcctcggtctcccaaagtgctgagccaccacccctggccacctggttaatttgtgtatttttttttttttaatagagacagggttttgtgatgttacccaggctggtcttgaactcctgggctcaagccatctgctctccccaccctcccaaagtgctaggattacaggcatgagccaccacgcccagcctctttactgtaaaatttatatttttctccttgtaatgaataagtaatttgtgaggagatattttgaggctatgtatgtatcctgtatctaatccaactttcacctactattttagtatctaagcaaatagcttttgaataattttctggtttccaagccagttgaaatgtgttctgctgcatcttatatgaaagtcacattttatgaatcagaaattcccttttgcacattttaggtcaaaaataccagggaggccgggcatggtgactcacacttgtaatcctagctctttgggaggcagaggcgggaagagtacttgaagccaggagtttgataccagccccagcaacacagcaagactgcatctctacaaagaaaaaaaaaataaaaaattaactgggtgtggtggtagtcttaactactcaggaggctgaggcaggaggaaaggcagggagaaagtaaacagatatgtgcaaatgagacttccattatgcatattattcgcaattaaatctcattatttatgcccttcactggaaaaaaaaattacctttaattgcacagatcatttataaaaagactgttggagttatgctccaaagcccacaatgacagagatagtgtgtcagagggacacaggagtcaactgaaagagttcccaatagccaacactggaaaaatttgagcaacaaaataaataaagtagcattgaattaaagctcagtggacgaggctgatcatggtggctcacgcctgtagtcccagctacttgggagactgaggcaggagtaccacttgagcccaggagtttgagaccagcctgagcaacttagtgagaccctgtctttatacaaatagaattgtctgggcgtggtggctcactcctgtaatcccagcactttgggaggccgaagcaggtggatcacctgaggtcaggagttagagaccagcctggccaacacggtgaaatcctgtttctactaaaaatacaaaaaattagccgggcatggtggcacatgcctgtagccccagctactcaggaggctgaggcatgagaatcgcttgaacctgggaggcagaggttgcagtgagctgagattgtgccactgcactccagcctgggtgacagagggagactcagtctcaaattaaataaataaataaataaataaataagccaactgtggcggtgcacacctgttgtcaccatatacttgggaggctgagggaggaggatcatttgaacccagcattttgaggttacagtgaggtgtgattataccactgcattccagcctgggcaacagagcaaaaccctctctcttaaaaattaagtcaaaatctttgccgggtgccatggctcatgcctgtaattctatcactttgggaggctgaggcaggcagatcacttgaggtcgggagtttgacatcagcctggccaatatggtgaaaacctgtctctaatgaagataaaaaaattagctgagagtggtggcgcacgcctgtagtcccagctaccagctacttgggatgttgagacaggagaattgcttgaacccgggagacagaggttgcagtgagccaagattgcgccactgcactccagtcttggcgatagagctagactctgtctcaaacaaaaaacaaagaaaactcccttcattttcatgtaatcttatttatttcctcaagaagggtagatcttttaagactttattctttgcagttacaaacatacaataaaaaatttagtggctttactttcatttgattccattttacaaatggaatcaaatcgtatgaattttaacttgctttttttagtttattatcttagaaaactttctgtcagtatatatcaagctttctttttaacttggtctaaagtagtggtcttaacttttggtcacatactcagaattctgataaattctgtctctttgtacattaagtttacatctaaaattttgtagcaaaagtttagttgtaaaacatgtaattttgagaatgttttacttttgccacataaaaataagttacctcattctgctaaatgtatccaaatgcttctaaatatatagcattttggtttccatcatctagtttaaaaatatacgaacaagctgttctttatcattggaaatttaaattcttcttttgagtccttgaacttttatttccataacatgtctcagacttttatcctaatgtaatatatttttatgcttaaaagttttttcttgattgtgctaatatgtttctgctactaaatatgtatgtaaacttaaattttaatttttaaagttcctgtgacaaaggttctgtgttttaacttggtccagaggaaatttatcagtctattgcatgtattatgttttttttaaatctcccttcattttcacttaatcctatttgtttcctcaagaagagtagagatgggctttactgtgttgaccaggctggtctcgaattcctggcctcaagtgatctgctcaccttggcttcccaaattgctgggattacaggcatgagccactgtgcccggccaacataggttgtaatttttgatgttattactatacaagttgaattttattggaaatgcttttcttatgagatgatggggtctgttatttttctcaattaaatcatgggtctgtggatcaatatttctttctctgatgaaataggattggcaatttttcctgtttttgtagctatcatagtgaagaaaccctaatcacataggtaaatatatgggaataaagcttttttttttttttgggagatggagtcttgctctgtcgcccagactggagtgcagtggcacgatctcagctcactgcaacctctgcctcccaggttcaagctattcttgtgcttcagcctctagagtagttgtgattcacacgccactatgcctggctaattttttgtattttagtagatatggggtttcaccgcattggccaggcaggtctcgaactcctgacctcaagtgatccacctgcctcagcctcccaaagtgctgggattataggcttgagccactgcacctggccaggttcttttttattattattattttttattacgagataaggactataggcgtgtgccaccacacccagctaatttatttatttatttatttatttttagagatggggtcacactatgttgcccaggctggtctcaaattcctggactcaagacacccctctgccttagcctccctaatagctgggactataggcataccctagggtgtcttggcctttatctatatttagctattagatacctgttatcttcctgtatcggtaacacgaagtgctctcatttcttttattactgtgtactattttacaatattataatctgttggtggacatttgttgtttttaagcagtgccatcataaacattctgtttatattcacttttttatacttttatgtctctttttgaactaaatacctaaaactgattgttgagttgagtattgcagaatttgataggctgccaaattgtctcataaaaaggttattcctatttacattcccccaaatgatgtaatgaaattacccttgtcaatgctggttatcaaattttaaaaggttttatcactgtaatagctgctcttataccactcgctggatatcagtttttgtaatttccattttcttataatatgcattctttaatgaagcaagtttttaaaaatatgcattctttcttgagcgaggaagaataaatcttataagcttattgtgtgaatgtgaaagggaatttacttatgccaaatgtgggatggagcatatttatggcatctctctggataagtaaaatgcagtttgtgaagacttagcagggtatatgttacatagcggctatttaatagaattctgttgtctttccttccttatttctttcttttatttaaattatattctggttttggactgccttgttcttttagattgttctctttggctgttcctcttaagtaacagaatgaatgatcttttcaacaagaagcttgtgtgaaagatttctgccttgtatttatgaggactaaggggttggacagcatgtttgtggtcttccaaagtaaaatcttgcattttttattttagtagcatatattgtagatattcacttattgtcttaggaataatatctctgaattcttcggtcagcaaggtgactgcagagctaggctggttgctaaaatgttagatatagtcagagactttcagaaaaagttgtacatccccaaattgatctatatagtcaatccccaaattgatctatatagtcttatatgcaattgcatataagatcccatcaagaattttagtataaatcaaaaactgattctaaaatttatatggaaaagcaaagaaacaaaacaaggccaggcgcagtgactcacacctgtaataccaacactttgggaggccaaggtgggaggattgcttgaggtcaggagtttgagagcagtctgggaaacatagggagaccccgtttttccaaaaaataataataatgaaaaattaggcaggcgtggtagcatgcacctgtggtcccagctacttgggaggctgaggcgggaggattgcttgagcctgagcagtcgaggctccagtgagccacgattgcactactgcactccagcctgagtgacagaatgagaccctgtctcgaaaaaacaaaacaaaacaaacaaaaacatttttggaaaagactcaagttggagggctcatattaccttatttaagacttatggctgggcacagtggctcatgcctgtaatcccagcactttgggaggccgaagcaggcggatcacctgaggtcaagagtttgagaccagcttggccaacatagtgaaacctcgtctctactaaaaatacaaaaaaaaattagctggacgtggtggcacgtgcctgtagtcccagctacttggggaggctgagcctggagaatctcttgaacccaggaggtggaggttgcagagcgtcaagattgcgccactgcactccagcctgggcgacagagagagactccctgtcaagaagacttactgtacaaatacagtaatcaagacaggatggtattggcaaaatggatagccttacaaattgatggaacataacagcccagaaataaacccaatgtaatatggtcagttgatttttttacaaaggtgcaaaggcaattcaatagaatgcagatgactttttccacaaatgactctgtaataattacctaattacctaattattaggtgattaggtaactacctaatcacctaattattaggtacaggaatagaaacttaggaatgtacaggaatagaaacttagacccacatcattacaccatatacaaaatttaactcaaaatgtaccgtaggcctcaatatgaaatgtaaatatgaaaactataagacttctagaagaaaacatggggaaaaaaatcctgtgacctacttcataaaaattaaaaactatttgaaaggcacagttaagtaaatgaaaatacagtataagttagaaacagggaagaaatttttacaaaatttatctgataaaggagtgatatttggaatacataaagaattttcaaaactcaataataagaaaataaacagttcagttttaaaatagtcaaaaaatttgaccattcaagtcaccaaagaagacaaagggatggcagagaaacacatgaaaagatgctcaacatccttagtcattagggaataagatacaactaatttccttaaaaaaaaaaaaaagagggaaaaaaaaaaaggagtcctctgcttccagaaatacagctggttacctccatgcaatcttcatccagaagcaatgatggtaccctggatttcctgtgtgggaattaataagtaattaataaatggcctccgctgggcatggtggctcacatctgtaatctcagcactttgggaggccaaggcggtgaatcacctgaggtcaggagtttgagcccgcctggccaacatggtgaaatcccatttctactaaaaatacaaaaattagctggtcatgggggcgggtgcctgcaatcccaactactcgggaggctgaggcaggagaatcactcgaacccagaaggcggaggttgcagtgagccgaggttgcaccatggcactccagtctgggtgacaagagcaaaaccccatctcaaaaataataataataataaaacaaatgccctcgtgttcttggagcgtttgatttggatttgaattgctgataccaaacctgtgttgctccatgatggttttactgaatttaatggtaatctttgataatttacagaatgaaaaagatttagacttgctattatgaggggctctcctatggaactggtactttacagagcttgggtgccctaggaattaatgattctgttcagttctgtttctgggtttccttttgttaaatgtttaaattttgaacagtttttaattgctttaacctaatgctacaaagagtgagaaaaactccattaataagacagtggttggatctgtttttcatttttctgtctgtcacaatgggtaattatttgtcattgttgcagatactccatcttctaaaccaacactcctagccaatggtggtcatggagtagaagggagcgatactacaggtaagtgattcccaggattccccaaatgtgtaggtgatgcacttacaatgaacaccttgataatctcctttgaagagcattattaatggaagcatatgaattatttctgagggtggtagtgttcttgttggaggtatttaaacccaggacattgccatgtaaaatctccaacaatggaaggagaataatgagtttgctttgatattttttgaatatttattggagctgtaccacacaagaactggatcaaccttaaaatacttttgtagatgcagaataatgatcaccaaaatatgttacatgggaggaatttggccactacaactcttaaaacagcaggtctgttccctgaatcacattgcgtttagctttctacagttcaatgttaggaagccagtgaacaacaaattaggagttatttattttgcccccagtgtgtttcctttatctttcccttaactgttgcttttgaaatttacttctaattaaactcttagctctttactagggttttgatattctttcagttagcattgagtttctgtgggttcctgtctcataaccagcaccaaccccctgccccaatgtctttgtagtgagcaaaattctcaaagcagtagcaggagtcccagggatatactatataaatattttcttaagtagctgatgtgagagttgcgtgttttattttcataaatacctgcatttactttgcagttgtgatcaggccaacactgctaacccaaatgagttgacttctaatgatcaatcccattgtttcctgcaagtgtgctcttaactgggccatacatttgattcatattattgcagtggaggtagttactagatttgtcatatttctgtatttctcttatatgcatacctcagctatgagaagcccttctgtgaggcaccacagtatttctctttttctaaggcttccagaaagccttctgttagcaatagcagctattctaggatttattctttattctatgaccataggaaagttgtatatatctttatacatcagattttttgatgaccaagttctttttgttgtgaatgtttaccaagtgacatatacatccttattagcaacttaataaattaggaactctttactttagaagctagaaacaaccagaaatgccactttatcttccagttttgtgaattgatgtttttgtatttctttgataatctcagtcaaatgtagtattgactttctgtgtctgctttgaaagcagtcatctatgtgatgtggtttttaagaaaacatttatgcaaatatccctgtgattaaaggagaagtttgaacatgaacttttaaaaaatgagtaaattcagctttctttaagcaggaaccagttaaccagggtaaggaaaggctggaggggattgacttgattaggcagttgaaagagtggatgccattttcatccaggaaggaaacaactacaaaaacgagtagatttcttctccagtaggaagtcatgcctgaccagaagagactcaaactctgtgtagcaggtgcttaccgctgccaggccttagtagtacagaatagaagggtaaaaactgtatcctggccctcactgtttcaggattcccttgtgacaaaaaagaacctggctctttatgaactacccagtggcattatgagagtaggtcgttctgttcttggatacctctctgcccttaggtagcatatagtttgcacacctggattgagttttgaattgaaccacttaactgtattaaaatagatactaggccgggcgcggtggctcacgcctgtaatcccagcactttgggagaccgaggcgggcggatcacctgaggttgggagtttgagaccagcctagccaatatggtgaaaccccatctctgctaaaaatacaaaaattagctggacgtggtggcacgtgcctgtagtcccagctacttgggaggctgaggcagaagaatcgcttgaacccaggaggcggaggtttcagtgagccgagatcgcaccactgcactccagcctggtcaacagagcaagactccgtctcaaaaaaaaaaaaaaagatactttactgaaaatatgcatgttttatttggggagggaaggtggagggaggggatggcagtgcatgtttttggagcatgtggtgacttcattctaatttggccatcactacctggagcatctaactcaatgccattttgaaaattcccatttctgtttccttcagaatgttatctatagtcccgagagcaaaccagcttcattaatagctttggtttatgagcatcttgtgatattgaacttgctgtttactaatgacctgtgcttttccacccttttcttccccttcctacttcttcctccctctctatttttctcctcctagaagcctagcgtgtctctcaacactggggctgctgcaacaccagaccagtgatctttcctaagcatcgttatacttctaaaaccttcagcattttgcagagctttgcttttcattcctggacatgatgtagaagaaactgagggtagttcttcggggcctatttctgctgatgcctgagcaaacaacctgcttcctcttgtgctctgcagggtttgatggagcctcatttccctttgtgaacacaaagtgcaaaatgaattctttttaattttagtaatttttacaaaggttatctaatgtcttttatttcttgttttctttatgattttatcatttgattcattctcacatttttttcctttaaatatttttagttgacctttttcctttggttttcaaatgttcaacatgaatcagaatagtgtaacaccaaatgagaacatgtgttttcataaaggggttgaggccaccagtactgcagcgaatttccttttcttctccctcctccttccttctctgagcttgcttttagggaaggttaatcttacaggctacctatgtttctctccaccttactaaaatctaaataatgatagatattttaagtttttaaattgagtagttctgagtaatcctagaatatttttccaaattaaataatcctttattatttgcaagttgggccaaatttttttttttttggagacggactcttaacaatctaagattgtttcaacaggactttcttattcccattcctaattttttcaaactaattgcttaaatctagaaccagttgagattagtactgtacaatggtatgctttgattgtatttatagaaatataacataaaacatggaccatgttttgaaatcttagaggaattctggtttaaaatctgaaatactttaaagttttctatccttttactgattatgcagcttcttataacccccaaggtacagattatttcagcttaaaagaaataattggcaccatgttctgagaaagattttgagatatacattgttttttgtttttgagacagggtctcactcttgcctaggctggagtgcggtggcgcgatcttggcttactgcaccctctgcctcccaggttcaagtggttctcctgcctcagcctcccaagtagctgggattataggtgtgcgccaccacaccagctaatttttgtatttttagtagagacggggttttactttgttggccaggctggtctcgaactcctgatctcaagtgatccacccgccttggccacccaaagtgctgggattacaggtgtgagacactgtgcctggccagatatacattgttttagatcccctgatacagaactacttttgagatggtaagattagaatatcatgaaagtttaaactgaatccttgcagcgacttccggaatttaggaagcattccctcttctacaggggtctggtcacaagggctggattctctgacaaaaatttcttctatggattctggacagaagacacttgagggtgatatgttttaaaggaaagaggttatgcttatcttcttagcagttgataaaatattaaaactctcttgccatagagaatacaccatcaaagaaaacacaaccctttccctttggtgtacagttatttattaagttgattttggggtttctttcgccagggatcttttcaaaactggtagtagttatttttaaaaatcatgtttgacatctttctattgctcgtaaccagtccctgtagctgtctaagttatgggtggagaagcctgggtatgactttccgttgtgtacactcacacttcatgattgacatttatttattcttttatttccatttggttatgcttatttttgtttgaaatttgtttttttcaaatatgtttcctttttgaacttacagaattgttgaaattttctactaacagccagctaaaatttggtatatgttagctctatctgtttcacttggacgtttcattttgaaagaaagaaattttatgtttcacatatagttttatacaaagtagccagtcccataatgaaatgctgtattgccatagtggtcacacccaagtggtccagtatctcaatggtgaggcagccagactggtcagggctgctttgttgaaatgtgatgattttcatatgccttctttctctttctctctctctttttttttccttttttggcccaatgttgaagatgtagaactttgtttttaaataatgtttttataatttcattcgtatacctaagtttgtattttttgtgactttggacttcaacagtttgtatattgggacttctaatgtgattactgtactaaataaattccactaataaacatcttacattaacaccttatggactggatttggttggggtcataattgttgaaatataatgttactaaaacacaagttgggtaaagacttgaggcccaagttctaggtctaatatagcttctaatcccacccggattaattgtatggacttttaagtttttgtcaagcattttcacttatgaatttttttttcttttttcttttttttttttgagacggagtctcgctctgtcgcccaggctggagtgcagtggcatgatctcggctcattgcaagctccgcttcccgggttcacgccattctcctgcctcagcctcctgagtagctgggactacaggcgcccgccaccacgcccagctaattttttgtatttttagtagaggcggggtttcaccatgttagccaggatggtctcgatctcctgacctcatgatccggccaccttagcctcccaaagtgctgggattacaggcgtgagccaccgcgcccagcccacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcagataaaatttactacattcagtaacatttaatttgataactttgttatttgataacccagtatgcagtatctgggaagaattcaacaaaatgcgcagttccctagccattctgggttagtgtttgtttacagtagggttgcaagtacaatatgttgactgaattaagacattaaaaatattttatatctaagtaatttgcatagcataaggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactggtccagcaggcacagaatgttagtttcattcctaaatcatgtgtaatactgtattatcctcaattttatgttgatgccgtttccattacagtgaaggtttaacaagacttaactacaaattatttgtgggataaagctctgtgcgaccatggaggtaaattactcttatttatagtgtttggggctagacacattgcactaagtgctgtacaaatggcagtgttactggttgtttccatcgtaattagagtaggtaaacagtttactattgtgataactgtttgcatgtgtaaagtcatgccagcagtgaaacagtaaatctacttttttagaatatcatgacacagaaggtattctgtgtgcttcatcactatctcatctggtaggatgcaaaggatttagcatcagaaaaatgcaaaagcaccaaaaatgtgaaatattaacagataaataaatctgtggtgtgttagagtttctgaacagctattggagccacgctgtaaattggcatcataactcacaagtggagcccagacataagctgcacattatgttgctatgtatagacagcaagacatccatccgaactccaccaaattcctggaacaaagttttatttcttttctttcattttccagttaatgagttgcatgctggagacacatcagcaaattaacagcacgtaatgtttcttaaagtttttttggttcatggttttctaataaaaatacagaatttctcttcagaaaagtccacatatacccatatacaagatgttacatttacgtttagagtgtttaggactccattgaaaccagctcatggactacaatccttttctaagccaagcatttaattaatactctaagccacgttatttcagtttcttttggggctttgtattgaataagacaaaatagcttcttcttgagctttaagtgaaaatataattctgatttttttttgtttgtttttgtttttgagacgaagtttcgcccttgttgcccaggcttgaatgcaatggcacgatcttaggtcactgcaacctccgtctcccaggttcgagcgattctcctgcctcagcctcccaagttgctgtagctgggattacaggtgcccgccaccatgcccagctaattttttgtatttttagtacagatggagtttcaccatgttggccaggctggtctcgaactcctgacctcaggtgatccacctgcctctgcctcccaaagtgctgggattgtaggtgtgagccaccacgcccagccttctgatgttttttgggtttttttgttcttgttttttgagatggagttttgctcttgttccccaggctggagcgcagtgcaatggcacaatctcagctcaccacaacctccacctcctgggttcaagcaattctcctgcctcagcctcccaagtagctgggattacaggcacacgccaccatacctggctaattttgtatttttagtagagacggggtttctccatgttggtcaggctggtctcgaactcccaacctcaggtgatccacccacctcggcctcccaaagtgctgggattacaggcatgagccaccatgcccagcttttaaagactttttaaaaaacctatcttaagttctagttactgagagaaaatccatattgaggcaagggctttgcatgtaggtagtttattttgggaagtggccccagggcacaagagtgggatactgggaaaagtgaaattagaggaaaagaatacagtgaagtatgactactgacctagtcactgctgtgggcaaagtgggcttaagtcttttggggtcttttgaggacctgtatagaatgcctctcagtgttcactacctgagtatcttggttatagaagtggataacatttattcaccatttaccatctctcattgcttaagactcttttttttttttttgagacagagtcttgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtagggcagaaaactctggtttggttgatacaaagtgctgtcaaatcacacctatgtgcagctggatgctgtagcaatagctagaataaatagtgaacttaacagagtgtgaggtgggggcacaagaagtgtctaaccaagaggttacttcaaagcaagattctcttaacataagatttgtctgcttatgccttaccatagaggatgagatccttcaactctgtagaggaaatttgaaggaactccatctattatggtactaatccttttttttttttctctccccgcgccccgcgagacagagttttgctcttattgcccaggctggagtgcaatggcgtgatcttggctcactgcaacctctgcctccagggcttgtgattctcttgcctcagcctcccgagtagctggggttacaggctcccaccaccatgtctggctaatttttgtgtttttagtagagatggggtttcagcatgttggccaggctgttcttgagctcctgacctcaggtgatccacccatgttcgcctcccaaagtgctgggattacaggcgtgagccactgcacctagccaggtgctaattcttgagctgcattgttagaaactatagagatagccacagatgttagttttggaattttccacccaaacgtttttttctttagttagttttagtagtttttatgtttctagaaatttgttcatttcatctaggttatataatttgtttgcctacagttcttagtattcccttataaaccttttttattcctgtaagattcatagtgatatctccttttcatttctggttttagtagtttgaatcctctctccttttttcttcataaatgtagttaaaagtttgtcaatttttttcatcttttgaaagaaccaactttcagttttggtgagttttctctattttctctcctctgtttcctttatttccactttaatcttttttatttccttccttctgcctcatttgagtttagtttgctatttttctagtttcttttggtagaaggttatgttagtgattggtgatttttattttattttattcttttaatataggtgtttatggctataaatttccctcttaccactgttttagctgtacctcttaagatttgatatgttgtgttttcattttcattcatctgaaagtattttctaatttcttttgggatttctttgacgtgttgattatttaggagtgtgttaatttctgcatatttgtgcattccccaatcttctgtttactttctaatttcatcccattgtggttggagaacataattggtattctttcaatccctttcaatatatggaggcttgttttctggcctaacatatggtctgtcctgaagaagaatgtatattcggctcttgatgcgggtggaatgttctgtaagatgtccattagatgtagttggtgtatagtgttatataggtcttctctttcctcgttggtattctgtcttgttgttctatccattagtgaaagtgaggtattgcagtatccaacaattattattgagtagtctattgtttgctcaagttctgttagctttaaattttacatgctttttacatttctcaaggataaattccttgtgaaaaatgctacggttgtggataagaaagatacacacaaatgatcgctacaactatgagcctcagaagcagcagttgaaatgtcggtcgctggtaggacgatttaaagtgtttttttgttttgaggcagggtcttactctgtcacccaggctggagtgcagtggtgtgatcatagcagcctggaactctgggttcaagtaatcctcccgcctcagtttcccaagtagctaggactacaggtgcacaccaccatgcctggctaatttttaaaatcttttgtagagacagggtcttgcttttttgcacaggatgggcttgaactctttgcttcaagtgttcttcccacctcggcctcccaaagtactgggattacaggtgtgagtcactgtgcccggcctaaatgtgtattttattttattatttttgagaaggagtcttgctttgttgcacaggctggaatgcagtggcatgatcttggctcactgcagcctccaccttccaggttcaggtgattctcttgcctcaccctgccgagtagccgagattacaggcgcctgccgccatgcccagctaatttttgtattttcagtagaaacagcattttaccatgttggccaggctggtctcaaactcctgacctcagtgatctgcccatctcagcctcccaaagtgttgggattgcaggcgtaagccactgcacccagcctaaatgtgttttttgttttgttttgttttgttttttgtgacggagtctcgctctgtcgcccaggctggagtgcagtgacccgttcatggctcactgcaacctccgcctccgggttcaagcaattctcctgcctcagccttccaagtagatgggattacaggcatgtgccaccacgcccagctaattttgtatttttagtagagatggggtttctccatgttggtcaggctggtctcaaactcctgacctcaggtcatctgcccgcctcggcctcccaaagtgctgggattacaggcatgagccactgcacccggccctaaatgtgtttttaaaagatgatattttttcctcaaaatctgaacaatgttttttgcagaaatagaaaaatccattcggaatctcaaggagccctcctgaatagacaaaacaatcttgaaaaagaacaaagttggaagtctcatttgttgattttcaaaacttactgaaatgctataataatcaaaactgtgtggtattgacttaaagggagacatatagatcaaggaacggaatggaaagcccagaaataaactcttttatacatggtaagatgattttagacaacggtaccaggaccattcaatgggaaaggatggtgttttcaataaatgatgaggggaaaactggatatccacataaaaaagttggatcctgctgggaacagtggtttatgccaataatcccagcgctttgggaggccaagtgagaggattgcttgaggcaaggagttcaagaccagcctaggcactataggaagacctcatctcttaaaagaaaaaaaaattggccaggtgcggtggctcacacctgtaatcccaacactttgggagtcccaggagggcagatcatgaggtcaggagatcgagaccatcctggctaacatggtgaaaccccgtctctactaaaaaatacaaaaaattagccgggcatggtggcaggcgcctgtagtcccagctactcaggaggctgaggcaggagaatggcatgaacctaggaggcagagcttacataagccaagattgcgccactgcacttcagcctgggcaacagagcaagactctgtctcaaaaaaaaaaaaaaaaaaaaaaaaaaaaaaaaaaaaaggtagtgtgggcctgtagtcccagctactcaggaaactgaggcaggaggatcctttgagctgaggagttcaaggctgcagtgagctatggtaaagtacaccgctgcattcaccctgggagacagagagaaatcctgtctctccctctcttttttttaagttgggaccattatcttatattcaaaaattaacttaaaatggatcaaagacctaaacaaagcaccaaggctatacatttcttagaagaaaacatagagggaaatcttcatgacattggatttggcagtgttttcttggatatacaccaaaaacacagacgacaaaagaaaaaacagataaattaggctatatgaaaattgaaaatttttgtctatctctgtagagtgaaaaggcaacccatggaggcaaaatatttgcaaatcttatatcttctcaggagttaatatccagaatatgtaaataacttctagagctcaacaaaaaaaaattaaaaatatgggcaaaggacttgaagaaacatttcttcataaaagatacaaaaattgccaagaaatacatgaaaagatgctcagcatcattaatcattagagaaatgcaaatcaaaaccacaatgaaatatcacttcatactcattaggatggctagtatgaaaacaagaacagaaattaacaagtgtttacgaggatgtggaaaaattagaacccttgtgtactgctgataggaatgtaaaatgaaagtgctatggaaaatagtatggtggctcctcaaaaaattaaaaacagaattattgtaagatccagcaacccaacttctggatatatgcccaaaggaattggaatcagggacttgaacagatatttgtacactcatgtttgtagcagcattattcacagtggccaaaagatggaagcaacccagatgtcccatcaacacatggaatgaataaacaaaaatgtggtacattcatataatggaacgttatttagccttaaaaaggaaggaaattctgatatggtacaacatgaataaaccttgaagacactatgctaagtgaaaaaagccagtcacaaaaatacaaatttatatgcggtacctaaagtagtcaaatttacagaaacaaatataaatatactccatttatataaattaccttaagtagtcaaatttacagaaacaaagtagaatggtggttcccaggggctgggagaggcggggaatggatgtgtttggtgttgcttaatgggtacaaagtttctgatttgcaagatgaaaaagttctggagatggatggtggtgatgattgcacaacagtgtgaatgtacttaataccactgaactgtacacttaaaaatcgttaaaatcgtagaaataaacaaatgcagctcatatttaaagggaaaaaaatttcaaattaaccatcatatcacagatctcttcagaattaaagggatgctttatatgttaggtattttgtacgtttgttctggtttgtccagttgcagagagaaatacacaaatatgtcaacattgcttaaatgctaagcagttatggggaacattttgtaagaacagatacaatattggttaaattccatgagggggttgagtgagaactaaggaaatttgaaattcgagcttgaaatctccatttggatgtagaattgatatctcaaatttgaaatgttctaaactgaattcatgattgccccaccccaaaatcaaaacagagaagaaaaagaagaaaaaaaccacctgcctccccatctccttaaatggaaattctgtcctggttgttaaggctaaacatttggtttccctatcctcttctgctcctctcacaccccacacccagtttgtcagaaaaagatatttggaacctgaccacatctcaccacctccactgctctctccctgattggaccaccatcattaaccttggctactgtaataacttcccaaattagtctctctgcttccatttgcttgctccctgcagcatattcttaaaaacatctacagtggtcctgtacattgatcatgctgttcttttgcacagaaccctccagtggttgcccatctcaaagtaaaagccaaagtccttatgaaataccacaaggccctatgatgtcgttgtcatctttctgaccagatcttttcttagttacccctttacttactttgcttcatggtgttcttgctactgttccttgaacaagccaggtgggcatctgccttgagctctgagcactagcagttttctctgcctggaatgttcttccctttgatatattcatgattgactcttcactttctcaatgagtacttctcgactatctttttaaaaattgcaccccttctattttttcgtcccactgttctacttgaattttcttcgtggcttttgtcatgtcactttctaataatttgtatagtttacttatctcatctgcctttccccaccagaagaagatattatagaaacaaattttatgagagggacagggcttttgttttggtcactgctgtggcccagcacctagaacactgtctggtggatagtagatcctctgtagctattgaatgaataatctttaatatctatttgtttctggcctcacatgggaaaagaaacttaaaaacaagaccagatacaatcgtaataattcttgccaggttattggtacgcatctttctggaaatatgttatctgtcatgaatttgtttaaattttgaggaagctgtggatagagcacctactagctttgatttcttaggcaagttgtttgccctctttgaggctaagattcctgctgtgtaaaaggagagctctataaaaatagttgtttgcctgaagtgacagaaattattttcagtgctttgaaacctcgttgaaggggttaatatttaaatgtaagatgatattagaatgatgattaatgtccacatagaaagttcttacagttcaacccattatatacttttgttaaatcattctgtttgaccatcagccccttttcctacttaattggttgtgtaacagtattttaatcggatgtaactggagcatattggtccattgtgaagcagaaatgctctgtttctagaggacaaaactggaggtgaaacttcaaaagtgagctccaggcagactgaaagaagagtttttttgttttgtttcttgtgaaaaaattaacttaggactctcactgcaaaaaactggcaagcctggccctccagtgggttttcagcaatttaaaatgaaatgagaagatgcaaaactatgtcaactgtaaacttaagtattaacattagactccttagaggtcttcattgaaggattttgctttctatttaacaaattaatatttctggtcttcagtttttctgtgtaaaacgaacaggcattctgctgtttctgctgctgctgttagtgctgagcaacagagatacagtatgttctgcggtaggtgatagctttttagacatttagagattaacatttgccttctgatttattttctttgggttaaacatctttcattttttcttccactctttcctattatgtagatttatgctgtttttaatggccaatatttggatcagagtctattcaggagacagaagctacaccataaattgaacagagaatttactataggggtaaagagaactctaaagaatacaggaatgacagatatagggaatagtcactacccttagggctggggcagagtacacaaagaaataacaaatttggaaaagtatgcgcccctcccccaccctgcccccaaagctgattgcatatcttggaggaagtctccatttggtagtaaagatgtttgctgagttgctgcaggtcagggtgatgtggggcaaacaagcccccagactggggcttaacccaggagggttcttggctttgccaggaaagaatttaagggtgagccagtagtgagagaaagaaacttttattgaaccagtgctgcttcttgctgagcagggctaacccataggcagtgtgcccagaatcggtgtctgtgagctgctagctagctgtttatatctgttattaattacatgctaattaagaggcaggttatttagaactttctggaaaaggggctggaagtttctgggaatcagataaggtaacttctaggctgttgccatggcatttgtaaactgccatggcactggtaggagtgtctttatgctaataaaccctgagggcaactcgaggttacttttgtcagcatctgctggtttcagccagatcttgttccaatcagcagggtgcgacaggaaattaagtcctgctggtcttctacctcaaaggtagttaagcaggaagctgtacttgggggtgctgcggcatcaccagcaagcctgtttgaggcactggtggaacttgcctgggaagatgtccatgagaatgcccactaaagcttgttgggatgagcaccatggggtgttctgcacaccagcagagcaccatggaagtaagaagatgcaaaagcacactagaaccaggaagagaaaccctttccttccatgccctctactaagcttagtgtcatcatgcccgctctctaggaagaaatgtttacattattacaggcagggcaatgaaaggtagatttggaattgagaggcaatatattgattacttgcatagcctattattttggctacttagcttccatatgcactttacacacatttgagctcccatataacaatgaaactcttatgtttctacctaacaagatacagctatgtcagagggtgaaactctcacccttgttctaaaatgaggaatgaggacatgctcagccccatagtcattgtatccattgctggctatatttttgtttgtttgtttgttttaatagaatcagggttttgctgtgttgcccaggctagtctcaaactcctgagctcaagcaatcctccggcctcagcctcccaatgtcctgggattataggtgtgagccactgtgcttggcctgctggctgtttatcagtcctcaaatagaagttccagcttcagagggccaaggtcatgtgatgggagccaggggcttggagttctgagggaagaggagtgaagtattgggggatgtggcagtatcactgacagtgaggttttttggaggcttttttggtctgatttgtgagattgatattgtccttaatgataaggaaacaaagaaaatggcagaagtgaaaactgaaaatggcgaagtagaaaaacaccatctcctctatgatggagaatctgtttcaggaaaggtgaaagagtctagaaagagctagagcaccacaacattagaattgaatttgtacgtcaaattgaacttttctatgataagagtaatattcaagagtttgtaaacctagtgaaagaactagccttacctggagagctgactcagaagttgtcatttggaatttatacatgttgaaaagtcatgagaatcttacattggtgctaatgtcctcttgatgtattgaagtgttagtagtaagaagactgacagacttggtaaaaagaatgtgatcttactgttcaccaacttgccagctatcctgatggaagtgggcattgaagattgtctacatatagaatttgaatataatgaagtatcatttaaaggatgtgactgttacaaaaatttacctcttataagtaagaataaaaacacaacatatggggttacaactgatcaataagactgttgttagcaggatatgacctaactccaacaatgaaagttatgaacaaaaaagtttcagtaaggtactttttgaatttagcgcctgttgatgaggaagacagagggtactttaggcagcagatcatttaatggagaaaagctcctgaaaaactgaggaaacagaataaacttttaccagtgatttgaacctccagaatcacaagcatctgctgaatagcctgaaatatactgaataagatgaaaaaagaaaaacaaaactataatcattaagttaaacaggttaaagatggctgcagcatgtggaggggcaaaatgggcataactctgcccgggcatggtggctcacacctgtaatcccagcactttgggaggcgaggcaggcggatcacttgagatcccaagttcaagaccagcccggccaacatgatgaaaccctgtctctactaaaaatacaaaaagttagctgggcatggtggtgagtgcctgtaatcccagttacttgggaggctgaggcaggagaattgcttgaacccaggaggcagaggtttcattgaaccaagattgcaccactgcactccagcctgggcaacagaacaagacttcatctcaaaaaaaaataaaaatggccaaaactccatttatattcatcttcctttatcttacagcgctacatttatttcatgatatagcaaaatgttcttcatgtatatacatttttttttttttttttgagatggagtctcgctctgtcgcccagggtggagtgcagcggcgcgatcttggctcactgcatgctccacctcccgggttcacgccatgctcctgcctcagcctcctgagtagctgggactacaggctcccgccaccacgtccggctaatttctttttgtatttttagtagagacggggtttcaccgtgttagccaggatggtctcgatctcctgaccttgtgatctgcccacctcggcctcccaaagtgctgggattacagacgtgagccactgcgcccagccacatttttttttttttcccttgaaaatcgctcttttgcccaggctggagtgcagtggcacaatcttggctcactgcaaccaccgcctcccagattcaagcgattctcctgcctctcagcctcccaagtagctgggaccacaggtgtgtgctaccacgctcggctgatttttatatttttagtagagacgggggttctccaggctagtctcgaactcctgacctcaggtgatccacccgcttggcctccaaaagtgctgggattacaggtgtgtgagttaccacacccggccaccttcatgtatatacatttttaaaagtgctttctttgaaatgctcaaattttcttaaactgccttttttttttttactgcacactttgatgacaagcattcagatatgcgtcagcataagctttaaagattttcatgtggcagaaaacaaagttccactgactagtttgttaccaaaagttgtattataaatctaatttcaaggcgggtgcggtggctcatgcctgtaatttcagcactttgggaggccgagttgggtggatcacgaggtcaagagatcaagaccatcctggccaacatggtgaaaccccgtctctactaaaaatacaaaaattagccaggtgtggtggtgcacgcctatagacccagctacttgggaggctgaggcaggagaattgcttgaacctgggaggcggaggttgcagtgagccgagatcttgccgctgcactccatcctgatgacagagtgagacttggtctcaaaaaaaaaaaaaaaaaaaattagccgggtgtggtgcacacccctggaatcccagctactcaggaggctgaggcaagagaatcacttgaagctgggaggcggaggttgcagtgagtcaagatcgcaccactgcactccagcctgggcaacagagtgagactcggtctcaaaaaaacaaaactaaactgaactaattccaacttataataatgggaagaaggaaagaagaaaatggttagaatatacaaacaaataccaaatataacaaagagaaagttcatcctcatttctgtgattagtaatgaggccacagttgatatctaggcttctttcttcagttacctatttcatgtttcccttgccttcagcacgaacctcagctggttgaggttctttacctggtgaaatgactcaaacatttattccctcattagtccagtccttttttggttgctgtagttttccattaatctttatttttggcatggaagtattaagaggtgccttagataatcccttgggtttcagacatagtcctccttgctttcactgtgtagcagcaaccgtttccccttgacaattgggctcaatctttcccaaccagtaggttcagcctgttggttcagtggtgtaaggagtcccaagtagccaagtggcagtctcatcttctaatgcaattgaaccattgttgtgtatgctagtagatatatttcctgcttagggactagcacttccaagccagcagaactcagttgttaggagtgaaagcaaaaattcagtgattgctagatataatagtgagtggagccgcacatacttctaccctttgattcccagacctgtatattctgattgagggaggagacagcaccatgtaaggtgtctctgattgaaatcattaccccatcctttcagggtgttgtctccctgaaactgtaacttagtcttcagtaatcaattccctattttaattaggccaaccattctgtgtgataggatgtgacaacaccagttaagtccatggacatgagcccatttctgcatttctttactatgaaatgactttcttggtcaggagcaatgctgtgtgggcttggcatggtggcatatgcctgtaaccccagcattttgggaggccaaggcaggaggatcacttgagccaaggagtttgagaccagcctgggtaacatagtgagaccttgtctctattttaaaaatacatctttttttttggccaagcatggtggctcacacctgtaatcccagcactttgggaggctgaggcgggcagattgcctgaggttaggagttcgagaccagcctggctaacatggtgaaaccccatctctactaaaaattcaaaaaaaattagccgggcatggtggcacatgcctgtagtcccagctacttgggaggctgaggcgggagaatcacttgaacccagaaggcagaggtttcagtgagacaagatcgtgccactgcactccagactgggcgacagagggagacctcatctcaaaaaaagaagcagccgcaacactgtgtggaatgtcatggtggtagattgggcacttatatataagttcatgggtggtggaactgccaaaaacattataggcagagaaggcaaatctgtatccagaatacatgtctattctagtgaggacaaatctcttccctcacccctgcccttattccccataatagaagtccagcgtaatcaacttgccaccaggtggttagctagtttttgggaaatggtgcatattcagggctcagagttagtctgtgccattaacagattagacatttagcagtagctttagtcaggtcagccctgtttaggggaagatcatgttgttgagtccatgcacagccttcatgatgattttttccatgggttttattgagcaagcactcttgtagctatggaaagtgtctaacatttatattcatgaagtacgtcattttgtcaacttgcttattaagagcctcctctacagtgaatgcaaatgattattcacatgggacacaaatatcttcacagtctgtgcctgttctgagagtttcatctgcatatctttcccccagatttccttgtcaccatttccttccaagttcctaactagccaacaaaatccttaataattgttcataaatgagtataaatctctgcttctggccatgtcttacctcaggcaaaagggaaaaccaaatgtacccctcaacgttctgccctctgaaggaaagatttttcttcatcactgcccttcagtcctacctctttaaatggggctgtagtgctgcagctccccacttttgggtgatactggcatgttgtgcagagctatgtgtaaaccagacttgagttttttctttccccagtcagctggtcatatggagctctcaggaggccattgacttggattgagggagaggaagcaatgcaacagaactcaatgctgaagtctgagctacctcctatgtaacttactcatatttctggacctgcttgaatttttttttttacgtgtttttcacttgatgatagatcgtgctgcacatgccaagctagactacataggttggataacatctagttcctgatgagaagctcaggacacgtggttgcattatgtcccatggttaggcatttggtctctgccaagacccaatagcaagcctgaaactattttttgaaaggtgaataattttctgcaaaagagggcatagattttctcaaaattctagaagtctgggcagtgattctcttattcttgcttgctaaaggctccattcagcatccctatttgccatggacacttcaagtatcattggatctgccagatcataaggcccaaatggcagagcagcttgaaccacagcttgaacttgctatagaatcttttcttgctctgaaacccactctaaactgtcaaccttgtaggtaactttgtagctgggttgaagcctaccaaacattgtaccctctttttcattgttggtgatgttaattagagcaacttaatcaccttggaagggaaattttgacatgttttgagcaattgaatcctgacatttcattgctgcagtgggtctctgaatttttgtagggtttatctcgcatcaactactttgtatatgtcttactaaagcatctaacgtatttgctacttgctatttatcagacccaattagcataatgtcagtatagttgactagtgtgtgtgtgtgtgtgtgtgtgtgtgtgtgtgtgtgtgtgtgtgtacgtgcttatttatttatttttttggaatgtcacgcgatcaagatctctgtgggctacattatggtaggagaatggcatagccctgaggctagattcataggcacgtaaaaggcaggtaaaagcaatgtgcttctggtggttcttgcagatttgtatgaagaaaaaggcattattcaggttaatagcagtataccaagtgccgtgacccatgttgatttgctccagtaaagatgctatatctggggcatcagctgcaattggaatcatcaccagattaagtttatgatagtccacgagtttatgatagtcactaagatccatctgacttctgcacaggacaaactggcgagttaaatcaagatataataggtatcactaccctgtttctttcaagtcttttgatggtgacattaagctctttaattcttgagatgtggtattgcttctggcttaatatcttagtagggagggtaagttctaggggcttccatttagcccttactattaaaatgactcttatcagttgggtcagaaagccaatatgggagctctgccaatagtcaagtatgtctgttccaagtatttattcaggaactgaggagataacaacaaagtaggcccattgtactatggggtccactgtgaggtggacttgagctaagcatttcatctattacctgaccactgtcagcactcactttgactgataggccacagtagcattttgagtccccaggaattagtaatccctgaaaggtctgggtatttccttttctctaatccgtagtcactctagtaaatggcctttggggaagcttggatgaggatttacagtatgtacttgtacttgtgggaacactacaggtttttcctcaggggacctgggcttgttaattgacttgggtctagaaattagatgagaggtcaaaacttttctagtcaggtttttactaccagagctggagtttttttcagttgtacagatgaatctgttttggtaggctgcttgtggaatactgtgtgatcaattactgccaaagatcctggtgggccaaggtgttctgattaccagtacaactttactgtatttatagtagatttcccaccttgtctttggtgattacatgctgctacttggcctctgttattttaggatcccgttacccctttaaatcagggaacccacttagtggtggcatttcccatggccatacctaggggttgtgacagagaccttagggactgtaaaacctaaaatgtttatctgtggccctttataaataaagtttgccaacccatgtctaggggaacagggacacactgcaaaggggagcaaccacagagcttttcaaggatgaaggtgatcccctcactaatgcatttctttttttgttgttgtttgtttttttttttgtttttttgagacagagtctcactctgtcacccaggctggagtacagtggcacgatcttggctaactgcaacctctgcctcctgggttcaagcaattctcatgcctcagcctcccaagtagctgggattacagttgtgcaccaccacacctggctaatttttgtatttttagtacagtcggggtttcaccatgttggccaggctggtcttgaactcctggcctcaagtgatccacctggctcggcctcccaaagtactgggattacaggtgtgaaccaccatgcccacctcactaatggatttctcaatgcctgagtgaaaggattatcttccgagcttttttttgcaacataggttacacatgaaaaatccattccaacatttctatctccctaagtttttgaattgcctcttctacatcttgctagggaaactttggcatctccacctcattaaacatagtggactcttttttaaagaaagttttatttatttatttagagacaggctctcactcggtcactcaggctggagtgcagtggcgtgatcatagctcactgtaatttcgaactcctaggctcaagtagtcctccttcctcagcctcctgagtagctgggattacaggcatgtgacactgtgcctggttaattttttattttttgtggagatggggtctctgtgtgttgctcattctaggcttgaactcctgggctcaagcctcctaccttggcccccctgctgagattacaggtgtgaactgcacccagtccttttgttgttgttttgtgtttttttttgtaagtttttaaagtcctgtttattgaagcatgaatttacattcagtaaagttcaccctaagatttgacaaatgcatagtcataccatactcaagatgcagaaccattgtaaaatcactctatcaattccctcctgcccctttgcaatcaacccctttttgatcccaaggaactaattgacctgtttttctgtcaaaagtgtcaaatttaatcactaaaatgacctacagtaccatggaaaaatatgtaagcatataaaatacacaaaccaattttttttttgtattttatttattttttgagatggagtcttgctctgtcactcaggctagagtgtaatggtgcgatctcggctcactacaacctctgcctccaaagttcaagcaatttttctgcctcagcctcccgagtagttgggactacaggctcatgccaccacacccgaccaatttttgtattttttagtagagacagagtttcaccatattggccaggctggtctcgaactcctgatctcgcgatctgaccaattttttatttttatttttatttttattttttttttaatttatttatttattttttccatttaaccctgagtggacacagcacatgtttcagagagcacagggttgggggtaaggtcatagatcaacaggatcccaaggcagaagaatttttcttagtacagaacaaaatgaagtctcccatgtctacttctttctacacagacacagcaaccatccgatttctcaatcttttccccacctttcccccttttctattccacaaaaccgccattgtcatcatggcccgttctcaatgagctgttgggtacacctcccagactgggtggtggccgggcagaggggctcctcacttcccagtaggggcggccgggcagaggcgcccctcacctccctcccggatggggcggctggccgggcgggggggctgacccccccacctccctcccggacggggcggctgccgggtggagatgctcctcacttcccagacggggtggctgctgggcggaggggctcctcacttcccagacggggtggctgccgggcggaggggctcctcacttctcagacggggcagctgccgggcggagggtctcctcacttctcagacggggcggccgggcagagacgctcctcacctcccagacggggtcgcggccgggcagaggcgctcctcacatcccagacggggtggcggggcagaggcgctccccacatctcagacagtgggcggccgggcagagacgctccacacttcctagttgggatggcggccgggaagaggcgctcctcacttcctagatgggatggcgggcgggcagagacgctcctcactttccagactgggcagccaggcagaggggctcctcacatcccagacgatgggcggccaggcagagacgctcctcacttcccagacggggtggctgccgggcagaggctgcaatctcggcactttgggaggccaaggcaggtggctgggaggtggaggttgtagcgagccgagatcacgccactgcactccagcctgggcaacattgagcactgagtgaacgagactccgtctgcaatcccggcacctcgggaggccaaggctggcggatcactcgcggttaggagctggagaccagcccggccaacacagcgaaaccctgtctccaccaaaaaaatacgaaaaccagtcaggcgtggcggcgcgcgtctgcaatcgcaggcactaggcaggctgagacaggagaatcaggcagggaggttgcagtgagccgagatggcagcagtacagcccagcttcggctcggcatcagagggagaccgtggaaagagagggagagggagaccgtggggagagggagaggagggagaggagggagagggagagggtctgaccaattttttaaaaagtgagatactttaaaaagtttcttcagcataccaacaaaaaaatgaaggtagcattgcattttactacagatgtgcagatattcattaaagttcaccattgtcatatatatggctcaacagtagtatttaagaatatgctgtaaaacaacaatctttagagtcaaaagaatgtaattttaaaacctttataaattaaagcagtttataaagttgtcttaattgtaaaatagctaatctagttacaattaatgtgttccaaaactgacctacttgaaaaactagtcttatatatttgttgagtatgtgaaccatgattaggtcttgctatttggtattaacactgtcaagttacagaccacagctggttcatagaaaagctactttaaataatggaattgaattccgtagaaattttctacaagaccaactcagctatggggagaaacacgaaactgtcaggtgaatattcctacagatgattggggccacctcagaattcacccctgctacccctatgaaagggaccaaaaaaacaaaaaaagcaacctctattctgtagttactaaaggttacatattcaaatatatctcatctacttgaaaagcttcactgattctttcaagcgccagaccttaaattcatcagcatcttgaaactccaccaagcccagtcatgtgccacagctgaaatttgtttttggtttttttttttaaacataatttactcgagtctaaaatttcagtcaaccaatgaggtgaactgttagagccacctccagctatatgatctactcctacacatgttctgaaggtttttgccagtatattattgccacgatcttgcatgtcctggattactagcatcccctttcccattggcaaggtgcttagcactgcacttaaacccaagagtgccaccaaaccaatttctaaatcccatgtttttaagtccgtcctctgagatcaccctactttttgtaccagttctggatcagggttcagtctggaaacagaaatattgcaatttgaacaagggaaagttaacataaagaattattaactagtaatagattaaccattaaagggtaaagagaactctgaaagatgtaggtgtatcagctataggagcagctactccctctgtgcctgaggcagagtatgaaagaaagagacagattggagagagagcctacccaaggcggagattcagaccttttgaggaggtaaagctgtagtctgttgcagttttaagttcctgaggatggcaccagccgagggttaaaagcaagagtattgtttgctggagtgccaacaaaactgtctaggaagctgctctgggtggtgctgtcgaaaatcactgggaagttagctggggtgactggaactcacctgaagccactcattgtggtatccctaaaactggtgggtgagcaccgctgggtgtcccacgcatcacatgaggccacgggagaaagaagaggaaaacacagtggaaccaggaggaaatcctcttcctcctgtagtattcctccagtgcttgctattggcataagaaaaacatttgaagagtccagcttcattattgcaaagcagagcagtaaagtatagatttggaactgaaaggcaataaattgataactaatatatcatacctcttaacctatgcctagaatggaatacaatttccagatgtagtttagccagcataagtagagcaggatacctaccccactccgcatcattcctggtactatgttgttgatgttgcttgccaagaatgtaagctctctatgggtggtgattcttttttttttttttttttttttttgggacgcagtcttgctctgttgcccaggttggagtgcagtgggacaatctcggctcactgcaacccccgcctcctgggttcaagcaattctcctgtctcagccttctgagtagctgggactacagatgcacaccaccacactgggctagtttttgtattcttagtagagacggggtttcaccatgttggccaggctggtgttgaactcctgacctcaggtgatctgcccgcctcaggctcccaaagtgctgggattacaggcgtgagccaccgtgcccagctgggtggtgattttttattgctttatccctagaacctaaatggaacctggcacgtagtatatgtacttaagggatagttgaatgaataagtgattacagctcaagatagcgttaaattgttgtcttttttatgttagattcatccaaattagtgaaagaaaaactgcagtttgacctagtcaaccaactgaaatggattaatgtagaattctgagtggctgagttaaaggacaccttatttgatttggtttaagaaaattgatcggccgggcgcagtggctcacgcctataatctcagcactttgggaggccaaggcaggtggataatgaggtcaggagttcaagaccagcctggccaacatggtgaaaccctgtctctactaaaaatacaaaaaaattagttgggtatggtggcgggcacctgtaatcccaggtactagggaggctgaggcagagaactgattgaacctgggaggcgggggttgcagtgagccgagattgcgccactgcactccagcctgggcaacagagcgagactctgtctcaaaaaaaagaaaattgatcacctgccagagcatggattgacccctcttctgatgacttggtatgtgtttgtacacactgttaacacccctttctatagaataggtcacaattatgggttgggcgtggtgactcaacgcttgtaatcccaagactttgggaggctgaggcagaaagattgcttgagcccaggagttcgagaccagcctgggcaacatagtgagacctgtctctacaaaaattagcctggcatggtggcacatgcccacagtcccagctactccatatgttgaggcaggaggatcgcttgagcccaggaggttgagactgcagtgaattatgatcacaacactgcactccatcctgggcaacagagctgagaccctacctatctcaagaaaaaaaaaaaaaaaaaagaataggtcaaccagccttcccaacatggcgaaatcccatctctactaaaaatacaaaaaattagccgggcgtggtggcgggcacctgtagtcccagctacttgggagcctgagtcaggagaatcgcttgaacccaggaggcagaggttgcagtgagccaagattgtgccactgcactccagcctgggcaacaagagtgaaactccatgacaaaaaaaaaaagaaagaataggtcatggttatgaccagtgggtacaaaagacatagacttgtgtatttattgcatgtttcaaggtagaaagcaaattgctgcatcaagtattgttgtcatagcctttaattacctattagtaatgcaaagaagcagagatttttgttttcttttctttttttcttttttcttttctttttttttttttttgagactctctctgtcgcccaggctggagtgcagtggtgcgatcttggctcactgcaacctctgcctcccgggttcaagcaattctcttgcctcagcctcccgagtaactgggactacaggcgcccaccaccacgcctggctaacttttttgtattttagtagaaatgcagtttcattgtgcccaggctggtctcgaactcgtgagctcaggcagtttgccctcctcggcctcccaaagtggtgggattacaggcatgagccaccacacccggcttgagatttctctcttctaggagagttctggcagatgatttggcctttcctcccttgttgtacactaagaggaaatgaggcagagtaggaaagaaaggtacccaaggttgagtgttgaatgagaggaccagggattaaaatcaaaatccctacctggctgaatgtggctctgctgccttggggtaggagattgggccacaagtccagctgggtgccaggaggaggaaggggtaaaaagggagtggaaaacccctccaaggacccactgaccctgctggcagacttcttattcaagtgtgaagaaatctgtcagaatctgagggaaccaaagacaagaaaaaagtacaatgtttggacataaatttccttaattcttgtaatgttttaggattctaataatcttctataaggaggatattaaatatccttaaataatttgctgtacttgggaaagtggtttttcttcttcagtttagagctagaatctcagttacctatagttgcctggagtcaattggtagaatgggtttgaagccattgaaaattgagcgtggatatgaatacagtttaatgtttacatgtgatttctgccacagttgattttgattatggctacttgtaaatcatttttctggctttaaaccaaaaacttttaaatttctggcataatttaaatactttcataaatataacctgcttaacctgtttaacagaatgtgaaaatagaaatagggttcattataagttattgacatttaaagggaattcctgttttgtatatcacatcatagatatatgatagccctggtttattatgtctattatcctgacataattgttaatagttgcttctttttttttttttttttttttttttgagacggagtttcacctttgtcacccagacaggagtgcaatggcacaatcttggctcactgcaacctctgcctcctgggttcaagcgattctcctgtctcagcctcatgagtagctgggattataggtttgtgccacaacacccggctaatttttgtatttttagtagagatggggtttcaccatgttggccaggctggtcttgaactcctgacctcaggtgatctgcccacctcagcctcccaaaatgctgggattacaggcgtgagccatcatgcccagccaatagttgtttattttactcttgttttggcctactctgaccaggcaaatttatttcttagaatgtgttgatttagtttagtataaattaaactaaattagtgtaatagtcctgagcatttaagttatggggccgggtgtggtggctcacacctgtaatcccagcactttgggaggcagaggtgggcagatgacaaggtcagtagatcgagaccatcctggctaacatggtgaaaccccatctctactaaaactacaaaaaaaaaaaaaaattagccaagcatggtggcgggcgcctgtagtcccagctactcaggaggctgaggcaggagaatggcatgaacctgggaggcagagcttgcagtgagccgaaattgtgccactgcactccagcctgggcgacagagcaagactccatctcaaaaaaaataaaataaaataaaaccagtcttggcaacacggcgaagccctgtctctacagaaaaatacaaaaaattagctgggtgtggtgatgtgtgcctgtagtcccagatacttgggagactgaggtcacttgagcccaggaggttgaggctgcagtgagccaagatcgctccactgcactccagcctgggtgacagagtgagaccctgcctccaaaaaaataaaaaatattaaattataatattttaatattcagcaaaaaaagtaaataaaattcagtagaacaaaggtgttgcaaaaagaagaatcttaatttgtagattgcatcttttaagaaaaactcataagaataccagccagtatttttatctccagatgaattttttcccctccaaattacaatcatttctccattcaacatcctttattaggcaccacctaggtatcaggccagatacatggtgctgggaatagtgaagagaaagacacagtccttgttctcaaaggactaaacagagaatggaggaaccgtatcttgtattcagatgtttaaatgtatgcataggttgcttatgcatacattatgagaacctatgctacatgttttaaatgtatgcataggttctcatgacatacatttatgagatctcagctcactgcaacctctgcttcctggattcaagcaattctcctgtctcagcctcccgagtagctgggactgcagtcgcatgccaccatgcctggctaatttttgtatttttagtagagaggggtttcaccctgtgggtcaggctggtctcgaactcctgacctcaggtgattcacccgcctcagcctcccaaagtgctaggattacaggtgtgagccaccgcgcctggccagcaatctgatttcatctgttcccaatcactccctccatttaaccctaggtgttttttggaagcaaaccccagatcatttgatctttatattagcatgtatctcaaaaaaaaaaaaaaaaaggttcctttttagagcataattgcaataccattaacaaacacacaccggttccctagtaccaaatatccagtcagtattcaattcaccagttatctcataattaaaaaaaaaaaactagctcgttagaattagaatctaaatttattttaatccatagattcttctataggggatatatatataaacagtttggattttacttgtgttttaaagatgccagagatttaactgtgctcatagccagagggggagaaatgaggagagaaggaatgaaaaattaagtctagaaggttggaggactgggtggcaagaaggtgataaagggcatatttgctgtccttggaaaggagaatcacgtgtattttgcatattctctggtttagcattttccccaaattaaaaagaaataaaaatgggggattatatttttctcataaataggaaggaaagaagtaatgatggactctgatgtagataaatttatggtagaggaaacagcagtcatataatatcattttctataaagtaaaatactatattttggatggagtgagctggaaaagaaagtatgtataacagactgtggagaatgagaaaggaagttgcatggggacacattttgtttttgtttttgtttttgagacagagttttgctctctcgcccaggctggagtgcagtgacgtgatcttggctcactgcaacctccgcctcccaggttcaagccattcttctgcctcagcctcctgattagctgggattacaggcgtgtgccaccacacccagctaatttttgtatttttagtagagacagggtttcaccatgttgatcaggctgttcttgatctcctgaccttgtgatccacctgcctcagcctcccaaagtgctgagattacaggcgtgagccaccacgccttgccagggacacatgtttttataggaagttgtgtagagaggtgtgtttataggaacaagtacattcagtatgataataaatcaagtgttgtaggaggtagaatactgaaactattcagtattctgagttgacagctcagctactgccaacttagcctgtattgtggtctcagggtagcatccttcacctgtggccactctgagacacatccagcagaatttctggttgaagcaaaacaagtgtgctatgtgatcttaaagttatctccttcctgctggagatttccttcaaatgccttggtgttttcaaatattgctagagggctaaactcagagtcttccaaccattgtagggatgtcaaatatcattaatttatttttgtttttttaattgagatgggtttgaagccttttttggggagagtgggggaaagagtcctgttttgtcacctaggctggaatgcagtacgggatctgggctcactgcaccctctgcctcccgagttcaagcaattcttctgcctcagtctcagtggctgtgattacagacatgcaccatcacgcctggctaatttttgtatttttagtagagatggggtttcaccacatgggtcagactggtcttgaactcttgacctcatgtcatctgtgggcctcagcctcccaaagtgctgggattacaggcatgagccaccgcatctggcctaaaatattattttaaatcaagaaaggttagtgggctttttgctagtttaatacagtggagaaggacgctaatatagttggatatgaacatttggatctatttaattataaaaaatggagtcggctgaaaatctgagaaaggagtaggctttctcctgtcactttttttattgaaatacttttatttttattttgaaagttttttttcttttgtgtttttggagacagggtcttggtctgttgcccaggaatacagtggttctatcatagctcactgcaatcttgaaatcctggctcaagcaatcctcccacctcagcctccaaagtaactgggacgacaggtgtgcactaccgtgcctggctaattttttaaattttttttgtagaggttggggtcttgctacattgcccaagctggtctccaatgcctgggctcaggcgatcctcctgcctccacctcccaaattgcgatgattacaggtgtgagccgccatgcccagcttattttgaaataatttcaaatttatagaaaagttgaaagaactttatacatttttccagattcaacaatcaatacgattttaccacaactattttagcattctgtaagatatgtatgtatatgaatatacacgtattttccttgtcacctttgtttgatctaataatctaagatgttctcacatgtgttacttacaatgtcaacagtaactggtatccctgtgtgcatgaaaaaagcaaaaaacaaaaaacaaaaacagtggtgattgtcagggcacagtggcatgtacctgtagtccctgctacatgggaagctgatgtgggagaatcacttggggccaggagctcagtcaaggctgcagtgagctataattatgcctgtgaatagctactgcactccagcctaggcaacaaagtgagaccccatctctaaaaataaatagaaaaaaaagtttttaatttaaaaaaaactgtcagtagtaaatgaaaataccacattcagacattttcccctttcttttctgtgaagcacctttgccagcattaatttttcttaatttttattgttatgccattttaacgtctttatgattaagtttagctcttaatgagatactgtgttgtgtattttttcatttctcacatggctaagcttctatcccaaaagcataatgaagcctgaactttgtcttggatttcttgactttctgcagggaatggggagagggaagaacggggctgtaggaggctagaagtgtgagcttgcactggagtatatagggatttggactaacagacttctaaaactgtaaaggagtttagagaccaaatactagcacagcccttagtaaagacccccaaagagcttgtgtttgtgagggttatatctatttatcaaactaaaactggagaaacctgaaaaatacttatctcattttaaaaagtaataataaacaatatttttattgagaagtatagtttcaaaaatgaaggagattagtaagaacagtggtagcgttttcgcctttttttttttttttttgagacggagtcttgccctgttgcccaggctggagtgcaatggcacgatctcagctcattgcaacctctgcctcccgggttcaaacagtcctcctgcctcaacctcctgagtagctgggattacaggcacacgccaccatgcccagttttttttttttttgtttttgtttttttagtagagactgtgttttactatgttagccaggctggtctcgaactcctgacctcttgatccgcccacctcggcctcccaaagtgctgggattacaggcgtgagccaccgagcccagccatggtttcgcttttaaaaatctttttaatgtctgtcttaatagaacacagctgtatttttatatctgcctctgcattcagtctgtcacaatatgttgtttgggttgcagtatatgaagaaaatccatttcacacaaatatgtagttaggaggaggaatattttgacagttttttttccaggtaactatgggtatttgatttgacatcaaaacttcacaaatggtagtttcttttcttcttcttcttcctttttttttttttttttttttttttttggtagagatagggtctcattatgttgcccaggctgatctcaaattcctgggctctggccaggcgctgtaatcccaggactttgggaggccgaggtgggtggatcacctgagatcaggagtttgagaccagcttggccagcatggtaaaaccccgtctctactaaaaatacaaaaaattagccaagtgtggtggtggctgcctgtaatcccagctacctgggaggctgaggcaggagagttgcttgaacccgggaggtagaggttacagtgagccgagattgcaccattgcactccagcctgggcagcaagagcaaaactctgtctccaaaaatgaaaaaaatattcctggtctcaagcagttctcccacctcagcctcccaaagtgctgtggtttacaggggtgaactactgcacctagccaagtggtagtttcttaaaggttgtttgcaatggggaatctgaaaccatatcaatgaactttttgtactgttatttaaaatccattagtctatcttgcacttggaatggatcatatgtgacagaattagtctagttttgatatgtagatatgctacttgtttaattagtactttaagtgtttagccatatgccttttctgttaaatgccttcaatttcacagagatagaaaactgtcccctgtccttccccattctacttttataggagaatcaaagtctctagggatggccagtggtagtggtaagtattttttctactgcattatgtaaattgcttcttgtttagaatttcattttccatagttttactgaaatagactctctgagtagattgcaagtatgctaaaaaatttattctgaaggctgttgtttctacaggggagtttgcctgcttctgctgtgtagttttaagaacaaaatctaggtcagcagtattgaataaagatgtgggagtgagcctctggtcaaacatgctccttaataataatggtggcgggggactggtgattctgaactttgctgttgagatagctgctccaggctgtgctgcaccctgtggaagggaataaccagcaaaattctgcatcttaaaaccagatttgggccaggtgtggtggctcacacctataattgcagcattttgggaggccaaggcgggtggctcacctgaggtcaggagtttgagaccagcctgaccaacatggtgaaacctcgtctccactaaaagtacaaaaattagccaggcatggtggtgcacatctgtaatcccagctactcgagaggctgaggcaggagaattgcttgaacctgggaggttgcagtgagtggagatcatgccactgcactccagcctaggcaacagagtgagactccacctcaaaaaaatttttaaaaaaatgaaaaaaacaacaacaacaaaaaacagactttcatgctccttctccaggaggggtgaggaaaatgtacccatttctctgattaaaaacttattttttgatcaagaggtggttgtttaaaaaaaaaaaaaaaactatttctttacagtttcttaccatgagtaagaaatataagcagaatcagagtttttaatgtctatcttagaaatgataggctattgtttaaattattttggaattccttatgcttttttaaaaaaaaacattatgtcaccaaccttatgctctttataataaatgcaaatcactttccaagaagtttggtgtataatgtgaatttaacttacatcatttagcccaaataatgatcttgtgataatttgatagcaacttatttattgaatactattctgtctcatgcagttagctaggcattgtgaggaaataaaagtagtaaaagcacagtattttctttttaaacattaatgagttcacttactaacatgtaaaataatgaaaattttaatgataaatagaatacttaaaggctttttaattttttaaaaaaagactaacaggaaaacatgtgcttaaggactaaattctttcctagtaacagtgaatggtaaaagagctaagtagtggaaaatgagcattaaagtcatcagagaggttctgtggaagctatgaggcccaagtggtggctttggaattggatcagggaggagacatttcaagcaggggatcagtgatctcatgagcaaaggcacaggggcagagtggagcacaggctctagcaggagccatgaggggacagcatacttactgcatgactttcctgttggagtagtagggaacaagcctgggatgggttcatttgatgggtaaggaaggctttagattagcatctaacatttgccgtaataatgttttgtgttgttgaagccctaaacacatcgtctttataagctttgaaatagatggataggtgcaccttctctaaataggatgtgacttgaagaatgttttttacttaaccataattttagaactgaacaagtatccttagaggtcattactgtgactaagagagatgaaagggctgtcccaaatttacatggttagcctgtggcaaagccagggttaagaactcaaatatgggcctggtatagaggctcatgcatgtaatcctagcactttgggaggtcaaatccggaggattgcttgagcccagttgttcaacgccagcctgggcaatgtatggagaccctgtctctacccccaaaataataacaataataaattagaagggcatagtggcacacatctgtgtccttagctactggagaagctgagaggggaggattgcttgagcccaggaagttgaggccgcagtgagctgtgattgcgccactatacctgggagacagtcagaccttgtctcaattaacaattcccttttttctttttttcctttgagacagaatctcgctctgtcgcccaggctgggtgcagtggcacagtctcggttcactgcaacctccacctcccaggttcaaacaattctcctgtctcagcctcccgagtaggattacaggtgtgcgccaccatgcgtggctaatttttgtatttttagtagagacagcgtttcatcatgttggccaggctggtctctaactcctgacctcaagtgatctgcctgcctctgccttcccaaagtgctgggattacaggcatgagccaccacacccagcagagatcttgtctcaataaaataaaagtaagaactcaaatatgtctgctggtgcccagctgttctctccctcctttccctctatagattttttagaatatttaataataataataaaagaagaaaaatggctgggtgcagtggttcatgcctgtaatcccagcactttgggagactgaggcgggcggatcacctgaggtcaggagttcgagaccatcctggccaacatggtgaaacctcgtctctactaaaaatacaaaaattagccgggcatggtggcaggcgcctgtaatcccagctactcaggaggctgaggcaggagaatcgcttgaacccgggaggcagaggttgcagtgagctgagattgtgctatcgcgctccagcctgggggacaagagtgagacttcgtctcaaaaaaaaaaaaaaaaaaaaaagaagaagaaaaaggaaaagctgttcttgaaggtagccaaaggttctgagattgattcctaccttcaacctgagaacatcagaaacatctttctcctataattttctgattaatttcactgcagtaatccagaatggggttgttttattacatttgtgttttgtgattcaagaactaagacaaatatattaatcctatgaaaaaacatattgcttttaatatttttactaatttaaaaaggcgtttatccaagtttcatcaccttttcttcccctctgctcagtgtatatgccacttgtgaaccttcccgaggatgctgtggtttgttctttaattcatcgtcatttttctggcttagacaagtaatgagtactttcatctacttaaatgaccaagtatttcatctgtctaataactgctgagtcttatttgtaagttatgttttaccagatttttgagaattataaagatgaatggataagtcaaaagtctcagaattaattttaaaattaaaatgggcttcagaaattatgtagcacaatttttttttttaattctggatgagtagtgtagctctaacagtcttaaggtcacacccaaagttaagtggcagagtcaagattagaacctgggtctcctgattctgttttctttcttttctttttttttttttttttgagacggagtttcgctcttgtcacccaagccggagtgcagtggcgcgatcttggctcactgcaacctccacctcccgggttcaagcagttctcttgcctcagcctcccgagtagctgggattacaggagcccgctaccatgcctggctaattttatatttttagttgagacggggtttctccatgttggccaggctggtcttgaactcttgacctcaggtgatctgcctaccttggcttcccaaagtgttgggattacaggcgccagccaccgtgcctgggctcctgattctgttttctagttctgttttccttctttagcatatctctttttggtttagattgcttttctgtcctgtgaagaagctttgtttttagagatttcctcaatgttacgtgtgccattataagaactaggcattgtatatttgtatattttgttgcgtgcttgtagctagattttttttttttaacatataagggttttagaataatacctgatccataagtctctcctttctcctcccccttttttcttttctttttttttaagacagagttttgctctgttgcccaggctagagtacagtgatgtgatctcgggtcactgcaacctctgcctcccaggttcaagcaattctgcctcagcctcccgagtagctgggattacaggtgcctaccaccacacccggctaattttttgttttcttagtagagacgggttttcaccacgttggtcgggctggtgccaaacttctggcctcaagtgatccaccacctcagcctctcaaagtgctaggattacaggtgtgagccaccatgcctggcctctttctctccttcttctccttctttgtctctctcccaccctcctctttctccccttctttcctccctacaccttctttggcttcattcttaggcagtgtctttcagggttgagaaagatggccactggcagctatattcttaattttatattcttatataaaattcttaatttttttgaggtatattcctaatattttttttttttttttttggagactaagtctcactacgtcactgcagctggagtgcagttgtgtgatctcggctcactgcagcctctgcctcccgggttcaagcaattctcctgtctcagcctcctgagtagctgggactacagacatacgtcaccacacccccggctaatttttgtatttttagtagagatggggtttcaccatattgatcaggctggtctcgaactcctgaccttaggtgatccacccgtctcagcctctcaaagtgctgggattacaggtgtgagccaccacgcctggccagctcaggtatattattatggttcaatatcttaaaatgtctgtatatcaggtttctccaaaagggctttgggcctgcttgaatcacaagtctacttcttcggtggggaaagcaaaacaccaggaccaaatagaggaatgggatggttcctaggggtgggtttccctttagaaggcattcaggcagacaaatcttaagtttctatttggcctttgaaactctagctgccgtttatgaagaactgctgtccttcataaatgtgtttcatccaaagtgatatgctcttggttttcccattcttgcccatggccctaacttctattttgcttgctgtgtgtcttccccactttgtctctttctctgtttcccagcttcatttaattacatccttctatcttcctagattcaattaagttctagtctcctacaggaagatcctagatcatcccacgactgtgttatgtgactgttctttaaactcctataagtagcacttactgcattgtagacacttgtcctacataaaccataatggttattataggattagcaataatttagcatgtttctcataattttctaagcacttcacatatcttagccttatgaagtaggtattagttatgaaaactaaagcttgcagaggtttgcatcattgggcatgtcttaaactctcaactaggctaatacttgcttctgtgttttcgtagtgcctaagcatagggtggtgatggtggtgatctaagttccatgagagcaggacatttcaccatttggtttactgctgaatcactaatgcctggagtagcgattgacagtatgtgcttaaattggtaaatgaattatctggacaaatgtggcatggtttaaacttcagaggtttggattaggtgatcctctaggttcctttcactttaaagttctgaggttaccactgggggaaaaaaacaaaaaaacaaggaaagagctgagggtgtgaaatagaaggagtcactgattcgtttgttagtaatatgtaaattatgagccgcactaatattgtttataagaaagcagactgggccaggcacggtggcctgtaatcccagcactttgggaggccaagatgggtggactccttgagcccagaagttcaagaccagcctaggtaacatggtgaaatcctgtctctaccaaaaatacaataattagccgagcgtgatggcacgtgcttgtagtcccagtactcaagaagctgaggtgagaggataatttgagcctgggagacggagtttagggtgagctgagatcaagtcactggattccagcctgggagacaaaaggagacgctgtctcaaaactatgccatcagtatacagcagatactaaaaggtattgaaagggtagaaatttgactggggaaaagtagggttcaaaaccctaatcacttttttaaaaaaattatttaatatgttgtggtgctgttgattcagtgctgcctggtcaccaccagtagattagctcttgatgtcctgtccctctctttacccagtgcctgagtctgttgcttcggtcagccttgagatttcttctccagcagtgtttaaaaacaagtatgtgtgacctatgtaaaattggccttacatatctactgaaatggtgatgaatacatacatagagtacagaaaattaaactacataattaacccaatttcaccacattcagctctggggaacctacttgtgttgaaatgccatttaaagttggcttttggggccaggtgcagtgacacatgcctgtcatcccagcactttgggaggctgaggcaggcagatcacttgggttgaggagtttgagaccagcctggccaacatggtgaaaccctgtctctactaaaaatacaaaaaattagccgggcgtggtggcaggcgcctgtagtcccagctgcttgggaggctgaggcaggagaatggcgtgaatctgggaggcggatcttgcagtgagcccagatcgcgccactgcactccagcctgggtgacagagcaagactctgtctcaaaaaaaaaaaaaaaaagctgggcaggatggcatatgccagtagtcccagctacttggcaggctgaggtgagaggattgcttgagtcagggaggtcgaggctgcagtgagctatgatcgtactaccgcactccagcttgggtgacagagtgagaccctgtctcaaaaaaaagaaagaaaaaaactttattgaggtgtaatttacatacccaaaaatttacctgttgtaagtgtggaagtaaatgattcttagtaaaattacggagtcgaaatgattcttagtaatattatggagttgtgcaaccatcagtgtaatccatcgttagaacatttttttattaccctaaaagttcccttgagcccatttacaaagccagtcccttttctgacctacagtttcaggtgaccattgatctgcttcctgttatagttctgtatgttctagaaatttcatataaatggaatcatacaatatatattctttggtatcttgatttcctcacttagcataatgcttttgagattcttctctacaaaaattaaaaaaaaattagccaggtgtggtggcatgcacctgtagtcccagctactcttgaggctgaggcaggaagatctcttgagcccaggagtttaaggttgcagtgagctgtgatcgtgccactgcactccagcctgagcaacagagcaggactgtctcaaaaataaaaacaaaaaaagatagccaagcatggtggtgtacacctgtggtctcagctgtaggtgtctcttgcagaggcaagaggattacttgagcccaggagtttgaggctgcaaggcagtatgattgcacctgtgaacagccgctgcacccgaatagtctgggcaacataatgagaccccactcatttcacgtctccaaagaaaacatacaaatgccagatgaacacatgaaaaaatgctcaacatcattagtcattagagcagtccaaatcaaaaccacaataagatgctacttcttaccacatctagggtgactacgataaaaaaagataacaacatgttggtgaagatgtgaagaaactggagtcctcatgtattgttattgggattgtaaaatgacgcagccattttggaaacagtttggcagtgtctcaaaatattaaacataaagttgctttatgacccagcagttctactcctagggatatatcaaagataattgaaacacgttcccacaaaaacctgtacgtgaatgttcatagcagcattattcacaatatccaaaaagtagaaacaaccaaatgtcagctgattaatggataaacaaagtgtggtggatctacacagtggaatgttatttggctataaaaaggaataaagttcagttaccatactacagcatggatgaaccttgaaaacattgtgctaaatgaaagaggtcagtcacaaaagatgacatattgtgtgacttcatttatatgaaatatctagattaggcaaatccttaggaacaaaaagtagacgagtggttaccgaggggtaggggaaagtgggaaaggagaaaagatatgggatttcttttttggagtgaagaaaatgttctgaagttagatagtggtgatggttgtataactgtgtatatgctaaaaaacctttgaactcgactttaaaagagtgaattttgtgaattatactcgataaaactgttatttaaaaaataaaaagaggctggtccaaaggtagtgagttatctcaattgttcagtcagttacagattgaactccacgttccactctttccctgcttctcactgttgtacttgactagtctttaaaaatacagatggagccaggcacagtggctcaaacctgtaatcctaggacttgaggaggttgagatcagagaactgcttgagcccagaagttggagaccagcttgggcaacataatgagaccctgtctctacaaaaaaaaaaaaaaaaaaattttgtttaaattaggcaggtgtggtggcaagtgcctatatttgtagctacttgggaggccgaggtgagaggattgcttgagcttgggaagttgaggctgcagtcagccatgatccacaccgctgcattccagcctggatgacagagcaagaccctgtctcaacaacaaaaaaagagcaactttgagaaaaacaaaaataagtaaataaaaggaaaccaccaaactaccattttacacattctcaaaattgctcctgtcagtctttttgtacagccttttttaaaaaatagggcctttttctgtcaccaaggcagtagtgtgatcacaggtgactgcagcctcgacttcccaggctcaagcaatcttcctgctttagcatcctgagtagctgaaactaaaggcactcgtcaccatgcttggctaattttttttttgtatgtttttgtagagacagggtctcactatgttgcccaggctggtctcaaactcctgggctcaggtgaccttcttgcctcagcttcccgaagtactgggattacaggcatgaaccattgtgcctggcctgataacagccattttagtggttttgtagtaggagttcattgtagttttaatttgcatttccctaaggactgatgagcttcattcatgtgcatattacgcattatatattttctttggtaaaatgtctattgaaatatttagccaatttttttttttttttttttagacagagtctcgctctgtcacccaggccggagtgcagtggcgtgatctccgctcactgcaagctctgcctaccaggttcacgccattctcctgcctcagcctcctgagtagctgggactacaggcatcctccaccatgcccggctaatttttttttgtatttgtagtagacagggtttcactgtgttagccaggatggtctcgatttcctgaccttgtgatccgcccaccttggcctcccaaagtgctgggattacaggcatgagccgctgcagctggccatcaagttttaaattgagttgtttatcttataattgtattgtaagagattataatctcttctacatacaaatcttttatcagatttatgatttgcagatatttctcgaagtctatgacttctcttttcattttctttaatagtacctttgttgttgtcttttgttttttttgtttgtttgtttgtttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgtcttttgtttttttgtttggttttgttttttgagacgcagtctcactctgttgccccaggctgcagtacagtggcacaatgtcagctcactgcaaccttcgcctcccaggctcaggtgattatcctgcctcagcctcctgagtagctgggactgcaggcacaggccaccaggcccagctaatttttgtattttttagtagagatggggtgtcacccagttggccaggctggtcttgaattcctaacttcaggtgatccgcctgcctcggcctcccaaagtgcagggattacaggcatgagccaccatgcctggccgtttaatagcatctttgaaaagcaaaagttttaaattttcatggtgtcccatttatatattttgtctcttacagatagtgcttttggtgacatgtctaagaaatctttgcctaatccaaagtcacaaagattttttcctgtttataagtttttttagttttaactcttacattaggtctttgtcttgtcttttttttttttttttttttttttttttttgcataataagttagcaagtgagctacgttaggtctttgatctgtttggagttaacttttgcatatggtatgtggtcagtgtccaattgtttctgtatcatttgttgaaaaaaaatttgtttctgggttgaatataattatgttgaattatattatgtttgtagatagccagttgaccctaactttgtatgtttctttctgaacctgttctgttccagtaccacgttctgaacctgttctgttccaataccacgttgtcaataccatgctgagttggtacagtcttgctctgtcacccaggctgtagtgcagtggcgcaatcttggctcactgcaaccttcccactcccaggttcaagtgattctcgtgcctcagcctcctgagtagccagaattacaggcatgcatcaccatgcccagctaatttttgtatttttgctagagacagggtttcaccatgttggtcaggctggtctcgaactcctgacctcaaagtgagctgcctgcctcagcctcccaaagtgttgggattacaggtggtgagccacttctcccagcctgagttggtacatttataataacttttgaaatcaggttatgtaagcccttcaactgtttttcttcaaaattgttttggcttttctaggttttttgcatttttatataaattatggaatgagcttattttgtactttcttcaatatattggtcattttcaggattgccatcttaacagtattgaatctttcattcctgagcatgttatacctttccacttatttaggctggctttttttttttttaattccagctccctgaaattgttgcttttgacagttttatccttgttctttcatgtggagaaatcactaccctcttcgtgcctgcataacctagaagtcactctgtagtgtttttttaaccttaatgacctactttatttccttctatctaaaattttttttagtgacagagtcttgctatgttgcccaggttggagtgcagtagctgttcacaggtgtgatcatagtgcactacagcctcaaactcctgggttcaggtaatcctctctcagtctcccaagtaaatggggctacagacgcaccattgcacccagctccttttatctttcaattaaaagaaaaaagttttcttgtaagacactagctagataggattttttatattgtactagctgtaatactttgtagaaattccactgtagtggaggagaaaactgtaatatcttgtaacttttgttttgtgtctctattttaagggtctccaactgaattccttgaagagaaaatggcctaccaggaatacccaaatagccagaactggccagaagataccaacttttgtttccaacctgagcaagtggtcgatcctatccagactggtaagtgttggcttgctcgtgactactaaatgtgtgctatgacataaatgtgaaaaagctacaaccaccattcagatgaaaatgctttagcttaagtatagatcacaaagtacaaccttagcattggtttgtccctttctcttcttcatttatcctttcctttgagacacttaatgccctctagttccctgctcttcaaaacctattttaaatacattatgtgaaattcatatacactgaagattagaggatccatagtaccttagaaccttaattcttccagaaggaattattatggtaatgttaaaccagtgctgttctgtgccaggcacagtgctagagcctttatatacacattatcggtatttcttacctaactctgccaaatatatgtatcctcttttgacagaagagaaagctgattcatacccactttctataaaattaaaaacagaccaggtgcggtgggttatgcctgtaatcccagcactttgggaggccaaagtgggcggatcacctgagttcgagagttcgagacaagcctgaccaacatggagaaacgctgtctctactaaaaatacaaaattaggcaggtgtagtggcatatgtctgtaatcccagctactcgggaggctgaggcaggagaattgcttgaacctgcgaggcggaggttgcagtgagccgagatcgcgccactgcaccccagcctgggcaacaagagcgaaactccatctcaaaaacaaacaaacaaacaaacaaacaaacaaaagcctatctgtagtagcccagagctagagttggtaggaagaatgagttccaaaagagccttaaaggaatagctttggtacttccctgttagccagattgagagctcaagttatgtttccacttaaatatggcttcttttttgacatctaacttataagatgctcatcgtttgtttcaaataacctagtatgtgatgttctgtaccatttgtcagttatcggctttcctaggtacaaagtaattatggggggagggtgaagaaaaagctgtattgagatacaattcttttttttttttttttgagacagagtcttgctctgtcaccctggctggagtgcagtggcgcaatctcagcttactgcaacctctgcctcctgagttcaagcgattctcctgcctcagcctcccatatagctggaattacaggtgcccactacacccaactaattgtatttttagtagagaccaggtttcaccatgttggccaggctgatctcaaactcctgacctcagatgatctgcccacctcagcctcccaaagtgctgggattacaggtgtgagccactgcgcctggccaataattcacagtaccatacagtttacccatttaaagtatatagttcggccagattcagtgacttgtgcctgtaatcccagcactttgtgaggcataggtgggatgatcacttgaggccaagagtttgagaccagcctgaacaacataatgggattctgtctctacaaaacattttaaaagttagctggttgtggcagcacatgcctgtagtcctagctactcgggaggctggggtgggggaatcacttgagtctgccacttcaaagctgcagttacctaggatcgtgcttctgtactctagcgtgggcaatacagcaagaccctgtccctgatagatgtgtagacagacagacagacagataggtagagtagatagagtagataaatggagtaacttaggccaggcgtggtggctcacacttgtaatcccagcactttgggaggccgaggcaggcggatcacctgaggtcaggagttcgaggccagcccagccaacatggtgaaacctcgtctctactaaaaataaaaaaatcagccgggcatggtggcgggcgcctgtaatgccagctacttgggaggctgaggttggaggatcgtttgagcccgggaggcagaggttgcagtgagccgagactgtcccactgaactccagcttgggtgacagagccagaccctgtctcaataaaataaaataaataaaatagagtaacttaattccactgaattggccgggcgtggtggctcacgcctgtaatcccagcactttgggaggctgaggtgggcagatcacctgaggtcaggagttcgagaccagcctggccaacatggtgaaaccccatctctactaaaaatataaaaaaatagccaggcatggtggtgcacgcctgtaattccagctacttgggaggctgaggcaggagaatcacttgagcccgggaggcagaggttgcagtgagccaagatcgtgccattgtactccagcttgggcaacgagcgaaactctgtctccaaaaaaattccgctgaattgtactctatctacttacctatctatttatctatttatggttataaccataaccagattcaattttagaacacttttattaccacaaaaagaaactctgtaccttttaaatatcacccccatctccctatccactgcaaccctaagcaactaccaatttgctttttgtctctataaatttgcttagattggacattttatataaagggaatcatataaagtggtttctttgtgactgctttttttcacttagcatactgttttgaggagtcctgcattttgtggcatgtatcagtactttctttatggacacgtaatactccattatatggctataccatattttgttcattattttatttttttgagacagaatctccctctgtcgcccaggctggagtgcagtggcacagtctgggctcactgcagccttgaccgcccaagctcaaatgataagtacataaataatttaaatcaggaagaagaggagccagcaagggtaacaaaggaatgaccaattttgagtaggaaaaaaaattcagtggagtttaatttcctcagcggaaagttgagtgtggtagtcaactgccaagatggcgtccaatgatccctgcctcctggtattgatacccttgtgtagtcacctcccatgtggtactaggtttggtctgtgtgattgtagaatagatggcagaaataatagtgtgtcatttctaagattaaattacagaaaatatcatagcttcagccgggcacggtggctcacgcctgtaatcacagcactttgggaggctgaggcaggtggatcacgaggtcaagagatggagaccatcctggccaacatggtgaaaccccgtctctcctaaaaatacaaaaaattagccaggtgtggtggcggatgcctgtagtcccagctactcgggaagctgaggcaggagaattgcttgaacctgggaggcggaggttgcagtaagctgagatcacgccactgcactccagcctgggcgacagagcgagactccatctcaaaaaaaaaaaatatcgtagcttccatcttgatcactctgtgtttactaatcatgaggaaagccagctgatatagagaggcacacatgggagaggagcagaggcctccattcaacggccacgtaagccatcttaacaggcaggttctgcagccccagtcaggtcttcagatcaccacagcccctggccaaccgctggactgcaaccttgtgagaaaccctagtcatggagctgggggagaaataggttctggggcacattttgaaggtcaagggcaatggattttctgatgggttggctgtggtgtgtgaaaaagaggaggtccaggatgactccaaggttttttgcaaaaaacatagaaggatagaatgccattagagatggaaagactatataatgagtagatttggaaacatgctacataaaagtctgaaaataaggtgagaggtctagaggtcttgaattataaattcaggtgtcatcaacctatagatggaattttaaactgtgggattagaggagagggaatgtagagagagaaaaggtttgtcttcctcctcataaccactcagttctttagttctcagcttaaatacttatcaagcaaagatctcccttgacttgaaccaaaatatatcctgtgggaacatatataaatgttcccatccctgaccttgtacatctttgggttttttagagcatactgggtctgccatgtggtaggcacccagtaaaaaattaatgactaaatgacagaactctgtaagaatcatctatttttacaagtaatttagcaagctcccatcttaaagtgcaaaccatccagaatttagtctgtttgatgctttaagaatccttttttccctcaagggggaagtgtgagaggcagagcaagcagcgagctatcccaaaccatatagaactgggaagaatgaatgtttatcatctctctcatattctatctccccatcttttctttttcttaattttgttctgtttttattatttattttgagatggggtttcactttgtcacccaggctgtagctcagtggtacaaccacggctcaccacagactcaacctccccaggctcaagtgatcctcccacctcagccttccgagtagctgggactgcaggcatgcgctaccatgcctggctaatttttccgttttttgaaaataagggtttgttttttttttttttaaacaaaaagcaggctgtgttttttgtttttaaagatgggcggtctcggtgtgttgcccagacaggagtgcagtgactattcacagtcgccatatcatagtgcactgcagccttgaacccctgggctcaagaagatcctcccacctcagcctctcaagtagctggggtgtgtgccacttttccaggctcccatggttttctgaagaagaagcctcaacaagtttcccaatattgccttctgcttgttcacacttcccgatgcagtggtctcccctaatcctgaaatttcttacaaaaagagggtggtatagctgcctcagagccaagaaaatgaacattctctcaaggcctgggcttttatgcggctgtctctgacaattgaagtgtcttaagggagtgatgtgttagtgtcactcaggaactagttggaaatgcagattctcaggaaccagcaatctttatttttaacaagtcttcaggatgattaagataataaaataaattccaagaaggcctcttcagaaagtggaactcttgtttagcctgaacagctttgcttttttttcttttttttttgagacagtctcactctatcacccaggctggagtgcagtggcgccatctcggctcactgccacctctgcctcccgtgttcaagcgattttcctgcctcagcctcccgggtagctgggactacaggcacgtgccaccacgcctgactaatttttttatatttttagtagagacggggtttcactctattagccaggatggtctcaatctccagacctcgtgatccgcccgccttggcctcccaaagtgctgggattacaggcatgaaccaccatgcccggccctgcttttttttcatgtacaaaagcacaaagagtttacctgatgttttgagtgcttttattcatgccagctcctgagtcaagagtttatttcttctgttaggataacaattgtttatcttgtcccattcagacagttttgaaatgcagttttcttcatcatgtccacatgaggtgaaaaattacttgttggtttttttttttaagcttgttaatggctctgtctttttaaaaagtaacttaaaatgaatgttatataaatatatattgaaaatttagtttatactttcacctctcagagtgtttgttatacagctgagcattagttgccctttttgttttatgcatttgttggctatctgatgtacataaccaaatcttagagaagggattatttattattaactcataacaaatgaattagtgaatattgattctctaccatgtgcagtcacatatgatttcggtttacttactattgacaactcatctatattcatcataggataataagaaatattggccaggcatggtggctcacgcctgtaatcctaatactttgggaggccgaggtgggcagatcacttgagatcaggagtttgagactagcctggccaacgtggagaaaccttgtctctacaaaaaaatacaaaaattagccaggcatggtggcgggcatctgtaatcccagctacttaagaggctgaggcaggagaattgcttgaacctgggaggtagaggttgcagtgaaccaagatggcaccactgcactccagccttggcaacagagcaagactccacctcaaaaaaaaaaaagaaagaaagaaagaaatattaatctttctagttgcattcaccaggaatgagttttggatttcttctatattccagatccctttaagatgtaccatgatgatgacctggcagatttggtctttccctccagtgcgacagctgatacttcaatatttgcaggacaaaatgatcccttgaaagacagttacggtatggcttcttcaaatggatttattctgtagggaaggaaaaaaattttttctttactcatctttggttcactgactagggctctgtgacaaaagattaacaagaaaaaagagaccaaagtttaaaatgtgaatttaatatgtacatgagaggtacctagggaatgagtaactccgcaagaggtggctttagaattccaccttatatagcttcttcaataaagaatgacaaattttttttttgagaggtgagaagatgaaggaaaagacttttgagtctctaggggccgcaaattgtgggagacaggtaaatggtaggtaaaagctagttagtaaaggttgctgtgtagattcctatggtgccatctccaggctaataatagccttcagcttaaaaaagtccttatgccaaagtagcgtattttggggtggcatattctggtgtcctttagttgtttaatgccaaacaatcaacatggcctttcacacatcacctttgaagctaaccactaagaaaagtcagatttaggggctgtgggtgtgacaaggctctctttggattaatcaaaggagacaattcacagattcacagttgggctgtcatctccccttttttttgagacagggtctcactctgtcacccaggttggagtgcagtgatgcgatcacggcccactgcagccttggcctcctggtcaggtgatcctcccacctcaatctcctgagcagctgggattacaggtgtgtaccactatgcctggctaattttttgtagagatggggttttgtcacgttgcccaggctggtcttgaactcctgggctcaagtgatccacccgcttcagcctcccaaagtgctgagattacaggcgtgagcctttgcacccagccacatttttctacttcttcatttacaggcagacacagtggctcatgcctgtaaccctagcactttgggaagctgaggtgacaggattgcttgagcccagcaatttgaaaccaatctgggcaacatagggagatcctgtcctacaaaaaattttaaaattcatccaggcgtggtggcacatgcctgtagtctcagctactcaagaggctgaggtggaaggattgcttgagcccagaaggtcgaggctgcattgagccatgatcatgccactgtactccagcctggacaacagagttgagaccctgtcttaaaaaaaaaaaaaaaaaaaaaaaaccatctgggtgcagtggcacacgcccgtaatcccagcactttgggaggccaaggcggatggatcacttgaggccaggagttcaagaccagcctggccaaaatggtgaaatcccgtctctactaaaaatacaaaaattaggctgggcctaatggctcatgcctgtaatcccagcactttgggaggcagaggcgggcagatcacctgaggtcaggagtttgagaccagcctggccaacatggtgaaaccccatctctactaaaaatagaaaaattaggccgagtgtggtggctcatgcctgtaatcccagcactttgggagacggaggtgggcagatcacctgaggtcaggagttcgagaccagcctggccaacatggtgaaacactgtctcgactaaaaatacaaaaattagctgggagtggtggcagacacctataatcccagctactcaggaggctgagtcagaagaatcacttgaacctgggaggtggaggttgcagtgagctgagattgtgccattgcactccagcctgggcaacgagcaagaatccatctcaaaaattaataaataaatataataaaaataagaaaattagctgggcaaacaacaacaacaacaacaacaacaaaactgctacaaagtattttaataaaattgtcttctaatgttggaaagggaggtgttaatctcattttgcagatgaagaaattaagactcgcagttttttactatagtatattatgttggttgtggtgttggaactagagttcaatcattaatattttgaatctttatattaccctttatatattatatagaaagtagccagtgaatgttgattaatggcactactgggatatactataccacctactaacaactagctaaaacctgaagaatgtcagcagtgtttcctttaaaacttgtttgcgttgtcggccgggcgcggtgtctcacacctgtaatcccagcacgttgggaggccaaggcgggtggatcatgaggtcaggagttcgagaccaatctggccaacatagtgacaccccatctctattaaaaatacaaaaaaattagccaggtgtggtggtgtgtgcttgtagtcccagctacttgagaggctgaggcaggagaatggcgtgaacctgggaggcagagattgcagcgagccgagatcgtgccattgcactccagcccaggcgacagtgcgagactctgtctcaaaaaaagaaaaaaaactttttttgcattgttttttattagtctgtgtcttcctggcaatatatgcagctgattttaaatatcaaatacctcttaggccgggcgcggtggttcacgcctgtaatcccagcactttgggaggccgaggcggttggatcaagaggtcaggagatcgagactatccgggctaacatggtgaaaccccgcctctactaaaaatacaaaaaattagccgggagctgtggcaggcgcctgtagtcccagctactcgggagactgaggcaggagaatggcgtgaacccgggaagcggagcttgcagtgagccgagatcacgccacttcactctgtctgcgtgggcaacagagcgaaactctgtctcaaaaaaaaaacaaacaaaacaaaacaaaacaaaaatatatcaaataccttttgtttccaatgtttactaagtttcaaaatgtatttgtttgtgtttcaatattaggtatgtctccctgcaacacagctgttgtacctcaggggtggtctgtggaagccttaaactctccacactcagagtcctttgtttccccagaggctgttgcagaacctcctcagccaacggcaggtaaactattagagactccctttatcagttaatggttgcagtattggtaatcaatataaatcatcaggtgtattttttagcagcttacagcaggtataaaaatttcagaacaatcacaaatgttttgcttatattagtgatatcaccactggaggaattaaattgttgaactataacacttagggttaacgggcacataaatactttttttaaattttttaacatatatatatttttttcatcacattttcattgtattaggtatcagaatttttttttttaattcagtacagatttacggcctggtgtggtggctcacacttataatcccagcactttgggaagctgaggcaggcagatcacttgaggtcaggagttccagaccagcccagccaacatggtgaaaccccatttctacaaaaaatacaaaaattggtctaggcacggtggctcacgcctgtaatcccaacactttgggaggccaaggcgggcagatcacctgaggtcaggagttcgagaccagcctggccaacatggtgaaaccccgtctctactaaaaatacaaaaaattagctgggcgtggtggcaggtgcctgtaatcccagctactagggaggctgaggcaggagaatcacttgaaaccggaaggcagaggttgctgtcagccgagattgcgccactgcactccagcctgggtgaaagagctaaataaataaataaataagctcagcgtggtggcgtgtacctataatcccagctactagggaggctgagacaggagaattgcttgaacccgggagccgagatcatgctactgcactccagcttgggcaacagcgtgagaccgtgtctcaaaaaacaaaaacaaaaattcagtacagatttagaactctggagtttttcttgataggaagcatgactgacctgctgtcccacagattatctttctaatactaattctgtgcccgtgttatttttgaagcctatgttttctctcttctttgccatttctcctccactacttgtcctcccagtattttacatcttattcttccaagtgttgagactgtcaaagagtaggcagaatatgttacttgacattagcttcttcttctttttttttttttttttttgagacggactcttgccctgtcccccaggctggagtgcaatgccgtgatctcggttcattgcaaactccgcctcctgggttctagcaattctcctgcttcagcctcccaagtagctgggattacaggcgcctgccactgcatggctaatttctgtatttttagtagagacagggtttcaccatgtttgtcaggctggtctcgaactcctgacctcagatgatccatccgcctcggcctcccaaagttctgggattacaggcgtgagccactgtgcccggcctaacattaattcttagttatgtgtacagtcttatggtcacaaaagccaaatactctcatgcctgaagaaagtaagcatttttaatgcaaaggtatgagtagacaatgatgtgtcctaaatttccaatttagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaaagttcccgtttttataagtaaactgttcctgctcctaattaagaccaacctctcctcattttgccctagattccatctcctctttcctactcgatatattgccccatgtattcttcccttttttgcccctcataccaatttaaatcttttttcattggatcattcccacccatttaacaaacgtttgttatttttcccatcttaaaaaacgaaacattgaccgggcatggtggctcacacctgtaatcccagcactttgggcggccgaggtgggcggatcacctgaggtcgggaattcaagactagcctgaccaacatggagaaaccccgtctccactaaaaatacaaaattagccgggcatggtggcgcatgcctgtaatcccagctactcgggaggctgaggcaggagaatcacttgaacctgggagacggaggttgtggtgagccgagatcgcaccattgcactccagcctgagcaacaaagagtgaaaaactccatctcaaaaaaaaaaaaaaaagtaacataactagacataccttcccaacttcagcttccaactaccacttcactcctttgctgccccttgtaggagaactcctcagaaactaatcccatatccaatttctggcagatggaaaatagctgaaatcatgcttctctgaaacgtgtgtggcttttgttattacctttagaaaccgtcacaggaacggggaaaaagtgcagcttgccggccgaggaggattctgtgttagaaaaactaggggaaaggaaaccatgcaacagtcaaccttctgagctttcttcagagacctcaggtaagttaggaaaacaaaatgaactctttgaaacaaattaggggcgatagagtagtgatggtagacattgtctctagttccctgttgtatggtggtaatcagcagtatagtttatgaagtcaattctcttagacagattttatctggtttagacagaatgtcagcttgttatatctttaaaaattactactacagcaaatcaggatacctaattttttttttctccactgttttttttgttgttgttgtcgttgtttttttttttttgagacagagtctcactctgtcgcccaggctggcgtgcaatggcgtgatcttggctcactgcatcctccacctactgggttcaagcgattctcctgcctcagcctcctgagtagctgggattacaggcgcctgccaccatgcccggctaatttttagtagagatgaggtttcaccatgttggccaggctggtctcaaactcctgacctctggtgatctgcccacctcagcctcccaaagtgttgggattacaggcgtgagcgaccgtgcctggccttctccactgttttcatagtgaagaaaggacacccaaattttgatctggttcagctattcactattctatcctgtgtggtcttaagcaagttacataacttgcctatatctcagtttacttagctataatataaattaattggtcaaatgttctctaaagtcttactagttacagtgttccatggcccaacagcatctacattacctgagaggctggtagaaatgcagaatcttgggctctaccttaggcctttgtaattattatctgcattttaattagatccccagataattctaattttcattaaactttgagaggtactgctctaagatactttccaatttaaagtttgattattcagtgaatttgaagattacctgtttttaataacccagaagcatatgtatatgattatcaacttgattttctgtttacttttctgtgactatgattggaatgtggacatcctgacatatgggacataagggcccatgacttatttcacttagaatctctaatgctttgcacactacctagcacaagactagagcttaaataaatgtgtgattttttttttaaatgttgttttactgactcaacaaatcagtaaagatttatcaagtgcttatggtatacaaaatacaccatgttaaggcatatagatatttaagtccccgtccttgccccctgaattattatattataacctgaatgaagagataagttctcaggcatgaactctgaaacccaagatttacataataattgaataaaatagtataaaagatggcactgaatagctgctgattaattgctgaattaaatgttataaatactgggggatactatagcctagcaattttttgagcgatgcaataattaacctgagatattaaacaaaggctaggatttagaggatattggaggggtaaggacaagaatgaaatccactatttacatattataatattcttggaaatcaatttattgggtcagacttgacaggagctggcatatacctgctcttaatgagactcttgccaggatcttggatccatattatattaactgggaggaaggttagaccagatcacctgctgaaactcttccaaaggtactcatcttaattgttaaaattaattatcctacttaacattatatatatttctctgtcttttgggaagtacatttaggagcagaatgttgaaatttaacatatttgtctttcaaagtaggatgctctggttctggaatcatgagaatttttctctgaccaaaatgtggattcagtatattttgtgtgtgtgcgtgaagtgacttaagtctggccttctgatctagttcccagaatctgtctggtttgtttgacaagtattagtttaatattggtgacctagtcttagaattataaattttgtccaaaatcatgtatatttaactgaagcaattaataaatttcaccaaaaagaggcaagcactaagaatgaccaatataaatcagatgagatttacaggcagtaagtgcttatttttagaggttaaaagatgtgaaatgtttcatttttaaaagttcaatcctgctacttctgaaatttcaaatattttataaatgtttgaaaacaatctttacctgagatgatgatctgttaaatatttttgctagcgccagttaaaagtgagaaatgttttagaaaagactgttttcctgagcaaattacagtaagtactatatgtattagtgaaaatagcctccttaaattagtcatttatatggtctggtttttttgtttgtttgtttgttttttgttgtttttaagaaacaataacgaggagttttttgtttggaattttagccaacttcatgtattgcggtacccctcccacacaagccaaacaagtttgcagacccagtgaccgcaggtcaacccggcccaagcctgccagggtccctcctgagctgctgggaggctctcctccatggaagactcttgatcacaggctgggccactgctctttgtctgagtcaggttgggtctctggttcatcctcctgtggtgggcctgggaaccaaagaaaaagtattcatgttgactcacttgaaccccagagggatcttggcagggaggcctgggatatagaaagcacaccaataatgatgaagaaaaagaagaagaaaccaaagcaaaagagatattctcaaccacgggctggaggaccttcggatgatgacaatgcagataagcctaaaggtcatccatttgcagctgacacacaaaaatcaggtgttctccccagccagcctaccactatgggtacagaatatggacttgtatctggagaaaacttgaaaagggaatgtttagttaactccagtgcagccagactggtagctgagaactttgtctcagagagtctcagaattcctttatatccttctgaagaagcccccaaaactgcaataagttctcagtctaagctgagagtagaggaagagagcaaaagtaacaagtcagtactacaaaaccaagacaagaaattgctgaagcaacatgaatacaaaccacagcctgcaccccacctgaagactcctgtagataaaagccagtcagtaggccctctcaatctgaaaggacccctagcagaagtttctgcatacaatgtagaaacccctttggatatcagacttaaagagggttgctctcctttcttggaccaagaggttatgggtgtagtttcaaaacccacagcagcaaaagaaataccaaatttggtacccactttgatagcaagtaatccattagaatgtaatctaaaagaagggaataatgaaagtaaaatgactaaactgcagaatgtcaaactgaaggagtttcctgaaggagctgaagaggataaagaactaaaaaaggaagcttttcccaacgaaagacaagagatcagcatctttacttctgagcagctgcagggccaagtgttggtacaggtccctggggtagagaatgaaccatttaagagaatggcaggtgatggcaaaagcaggaagggaaggggaagttctgggaaaatgagaacagattctgggaaggtaaaagcaaaatctgagctgccatttcttctggacagccagaaggacggaagggctgttctcataccgagtgagccagtctctaaaactgaaggaatgactactcaggataagagtgaggagctggggctgaattcttcaaagcaaccaggcactaaggctgatctcacggaggcagtggtgatgggggagcctaaagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaacattcatggagatcactctcttaagaataaagctgagcttgctgattccatgaaaaatgaagcagggatcgatgaagggcatgtgataggagaatctgagtcagtgcacagtggtgcgtctaagcattcagtagagaaagtcacagagctagcaaaaggtcacctccttcctggagtgccagtagaagaccagagcctaccaggagaggccagagccctagaaggatatgcagatagaggtaatttcccagcacatccagtgaatgaagagaaagagactaaagaagggtctgttgcagttcagattcctgacttactggaagacaaagcacaaaagctcagtttttgtgaggaccaaaatgctcaagatagaaattccaaaggttcagatagtttgaataagaaggtagatctgactcttttgtctccaaaaagtgaaaatgataaattgaaagaaattagtctggcttgtaaaatcacggaattggaaagcgtttccttgccaacaccagaaatccagtcagatttcttacatagcaaagtcgaagctcctccttcagaggtggcggatacgttagtaataatgactgcttccaagggtgttcgactcccagaacccaaagataagattttggagacacctcagaaaatgacagaaaaatctgaatcaaagacaccaggagaagggaaaaaggaagataaaagcagaatggcagaaccaatgaaaggctacatgagacccaccaagtcccgaggacttactccacttttgccaaagtctacaatccaggaacaagagagacataagcaactgaagtccgctggtatgaacctgccatggggaaatgtgtgtgcttgtggcttttgagtcagcatcagaaaggcaaagagcttgtgtcttggctccatccagactctaatcatccttgttaatcattggtttgttggcatgaaacctataactgctacggtgtgttttctgcagccaatgtgttccttgtgtcctgcttgaggaggctggtaacttggttgcatgccttttttacccagcactgaacgttgaattttaggggaagttgaattttcaatgaattgtctaacaaaagacctatcatcatccatttcttaatttttttaaaattgtgcctcctatgtatcaagtttacagctaaattttaatcattacttggtataaggattcacaggaggaaagaaaatatttcatgtctagctatgtgcatgagatttttttcaatttatatgtagcttgtgctggtgggactaaatatccaaactgcttttaggttaaatgaaatcagtccacctccttatgaggaaatggtggcctcaaaccagcattggtaggcaccgatttatttgtgtttctagtaatgggaaatgatctctcaatgatacagatacattttttgaccagtttgttgcttatatccattgccccacagttccatgtgggtttgagttttgggcatagtctgtgtccatcaaacatagtccataaaacttgcccatgttgtgttcctcataattttactcttttttggctctattcagtcaagtaattggaatgagattaagaagatgattcctttaagatttagaaatggtagccccgtttccccccacccccaattccccaaaaaagtatacatttaatcgtggcttccctgaatctagctttcaaaaaatgttcccttgtctttgagatttttcacagcctacaagtgacactatttcttaatcactgtttcccagcttgcatgatgtagctactaactccagaatttaaaaaaaacaccaattggttttagtagccagtcaggcttttagagaggtttcatcatgggattgtgttctgcatggtatggacttgttcttttgggtaaagcttgtctatgcatgagtatgtacccactaaggaatactgctgtgtgagtaaagaatgctaaaggttgttatttgcataagacattctcatcttctctgtttttatcttctattagctaccctattaccaaggcagaaaatgaaatagtatgtagagggctttccagcattcattgagatttccagtgttctatccagttctttcgttttggtttctagacccattctttagtttcagcagtgatctaaaagttaacatgtaatttctgtgaaatcccagccatctctttttgctcagtatttccaaagaaatgcagaaagaggatttgtttttcttgaggaagcaagaccagtactgcagaacttttggggccctgcctgggtcaggtcaggctcagagactgtgttagcagtggccttacagagtgggtatgggaaggataatgggtttgggacaaaatttattgtttcttctataaattctaccacacctttcccctaaggacaatgtatacctttttaatagttaaaaaaaaatttttaaactaattgtcgaataggttaatacattcacatggtacaaaggagtatacagtaaaacgtaagttggcctccctccattaaccgccttccagctttccctctccagagcaaccagtgttcacaatagcttatatatccttccagacaatttatgtataataagtaataacatatatatttcctgatttcatataaatgagacgtatacatacatactgatgtgtgctattctttttaaacttaatttttaaagagatcttttaagactcagtataaagaagccaggcgcagtggctcacacctataatcccagcactttgggaggccgaggcaggcggatcacctgaggtcaggagttcgagaccagcctcaccaacgtggagaaaccccatctctactaaaaatacaaaactagctgggtgtggtggtgcatgcctgtaatcccagctacttgggaggatgaggcaggagaatcacttgaatctgggaggtggaggttgcagtgagccgagatcgcgccactgcaccccagcctgggccacaagagggaaactccatttcaaaaaaaaaaaagaatcagtataaagaaagaggcctcttttttttgtttttttttttaatcttttttcctggtacatgtctctagatatgactcattcttttttgatagctgtatactatttcattacataggtatatactaatgtattatagtactttttttttttttgagacagagttttgctctcattgcccacgaaggagtgcaatggcatgatctcagttcaccgcaacctctgcctcctgggttcaagtgattctcctgcctcagcctcccgagtagctgggattacaggcatgcaccaccacgcccagctaattttgtatttttaatagagacggggtttctccatgttggtcaggctgatctcaaactcccaacctcaggtgatctgtctgcctcagcctccccaaagtgttggaattacaggtgttgagccaccgtgcctggccagtacttctttactgatgcacatttaggtgtttcccaactttttttcattagaaatatggtacataaactatctttgtatctataggatgtcatcttcatgtgtgtgcgtctgtgtaataaaaaggggctccggagtaagaatctctggtttgaagaatatgtattcataattttgatgggtgttccatattgctctctgtaggcctacagagatgtcccttgtagagaaaggtacatctctactcccaccctcaacatagacaaatacctgtttccctgcctttctctactagtgtgattttttttttttttttggttatgtgtactgatctaatcggtgaaaaattatttcatggcatagattttgtgtgtgtgctgttttttgtttgttttttttgttttttgagatggagtttcactcttgttgcccaggctggagtgcaatggcacgatcttggctcactgcaacctccacctcccaggttcaagcgattctcctacctcagcctccctagtagctaggattataggtgcctaccaccacgctcagctaattttttgtatttttagtagagctgggtttcactatgttggccaggctggtcttgaactcctgaccttaggcgatccacttgcctcagcctcccaaagtgctgggattacaggcatgagctaccatgcctggctgtgttttattttttttttagtgacttcttcatgtattaacaagtttataaaagccaatccatgctctgaaattatgaaaatattttcttttctcttctattaatatttttcattttaaattgttggccaatctagaatttgcttgtttgtggggttttttttttttgttgttgttgttgttttggtatgttttgtttataaggttgtgaggcagggttacttggtcatcccaccatcatgtttataatcgatctcccactgaactgccacctttgtcataccctaaatttctgcatgtatttggtctatttctggactttctttcctgatccattgatctttccaccaggcttcctaatatattttaatatctaatagggctagcccaaccccttgccctattattctttttcagagttgtcctattcttattttttagttttgtagaagaaaaattaatccactcaatatttttcttgaagtcactgtttctagcttatcgtagggagagtttatgtcttgcatatcgagtttttctgtcgaacagcataatgtgttcacatgttttgttagtccatcactggtgtttatctttgttcctcactttgaatcattcatgttaactgccctgcccccatattgctaccaattctcacatatcttgttctcattcgtcttgtggtcaaatggtgtcacccatggtttccattgtttggacagtaaagatattacaaatggtgttggctgggcacagtggctcacacctgtagtcccagcactttgggaggctgaggtaggcaaatcacttgaggccaggagttcaagaccagcctggccaacatggtgaaaccccatctctactaaaaatacaaaaagtagccacgcatgatgttgcatgcctgtaattccacctactcaggagactgaggcaggagaatcgctctcttgaacccaagaggcagaggttccagtaagccaagatcacaacactgccctccagcctgggcgatagagtgagtgagactccatcccccgccccgcccctctctagcccccccgcccaaaaaaaaaaaagatattattagtggtgttagtaaaaataatagtacctctaactaatccgggtgttaataataatagcactggccaggcgcagcagatcacctgaggtcaggagttcgagaccagcctggccaacatggtgaaaccccatctctactaaaaatacaaaaattagctgggtatgacagcgcacgcctgtaatcccagctactcaggaggctcaggagaatttcttgaacctaggaggcagaggttgcagtgagccaagatcgcaccactgcactccagcctgggagacagagtgagactccatctcaaaaaataataataataataatagcacctaccacctattgagttgattttatttgcctggttatctggaaataggtaaatagatcatacacacacacataaaataacactattaaagattatctccatttttcaggtgagaaaatggaggctgtcaaggtcacatagctggtgaagtgccagggttagaatttgaatccaagtctttatgtttctaagatccatgcttttcttagacttgcttcagaagcttccggaagtttcaggtacttaaaaagaaaaagatgaaggttgacaattagtaaacataaaatagactttttttagtatctaggcactaattaaacacttttctacttggagaaataaagatacatcatgaaaatataaactgtgaattagaggttaatttaggattagaatctaggtcttttgactctgtctagcattttattgtccagagagtctgtgtttgatttatttacatgtactttttaacacccagcctagagctttatatatacatgatgcctaatgacattttttgaattataagtgaattatctttttgctgatcttaccctgtttagaagtagggaaagtgaatatattgccaaagtctcttccagcttactgtttgctctactgttattttttcatgctgctgtcaaatttagggaaactttaacagaaggtttctttgcatactatgcatgttcttccaggcagggaagattaatgcaatacgtcaggaagtctaagctcaacttttcagaaaaggactttttttttttttttttttgagacggagtctcgctctttcgccaaggcgagagtgcagtggcgcgatctcggctcactgcacgctctgcctcccaggttcacgccgttctcctgcctcagcctcccgagtagctgggactacaggcgcccaccactatgcctggctaattttttgtatttttagtagagacggggtttcaccgtgttagccaggatggtctcgatctcctgacctcgtgatccgcccgccttggcctcccaaagtgctgggattacaagggtgagccaccgcacctggccagaaaaggacttcttatgggattgtgttttttgtgaagggaagcacaaacttgaaaggatgatccacattagattccaatacccgctccatgttagttgttcccctggaaaccaagtagaactgtgagtgacagtgtacttgctatgctgctactgtgaatgggacagtttgggatccctgtaaataggccctccctttgccatagtgaagcctggtcttcttataatctggctttcatttctttcttcagtttgcttgagctcatcaactgtctaccagcagctgggaatgtcagtttatggtgagaaactctcttggtgtgaaacttgaagtaatttataaacccagaattctaacagtttcaaggcccttgtacataaataaaatatgctcagcagatgaaaaaaccatttgttatcttagaacttgctactattttacaactggagaagtacccatttggtaatgtcttttcttaactgtagtgccatttgtgaagttcctttcctcattactctcaccccacttgccctctgattcaactggcttctttttttttttttttttttttttttttgagacagagtctccctctgtcgcccaggcaggagtgcagtggcacaatctcggctcactgcaacctctggctcctgggttcaagcagttctcctgcctcagcctcctgagtagttgggattataggcatgtgtcaccacgcccggctaatttttgtatttttagtagagatggggtttaaccatgttagccaggctggtcttgaactcctgacctcgtgatccacccacctcggtctcccaaagtgctgggactacaggcatgagccactgcgcctgactccactggcttttttttactaccatgctgatgaaatttattgggactagtcacacaactaaaaatagctaccatttattgaaccttactatatactcattgccatcctaaactcttaacctccaaaaaatactgtgtggtcattaccttgtttgagccagaacatttaaatattctttgaaatgaatcaagcaacaattgattatcctactttgttttgttaaatttgtatttatttttttgagacaaggtatcactttgtcacccaggctgaagtgcagtggcatgatcacggcttactacagcctcgacctcccaggctcaagtaatcctcctgcctcagcctcccaagtagttgagactacaggtgtgcaccaccatacctggtgaatattttttgtagagatggggtctcactctgttgcccaggctagtctcaaacttctggcctcaagcaatccttcctccttggcctcccaaagtgctgagattctaggtgtgaggcaccatgcctggcttgaatatcctactttaaaagaagcttcttcccctcatattccctcacccttcacttgtaccctctggttgacaaatagcattgggggattctgaacacactgttaaaataaaaacttagttttgatttacagtattgcagatatagttatttctttaagatatggaggtgacagtaagggggcttccattcttttttttttttttaaatagggtcttgctcagttgcccaggctggggtgcagtggtacagtctcagctgactacagcctccgcctcctgggctcaggtgatactcccacctcagttgcaagtagctggaactacaggtgcgtgcctccgtgcccggctaatttttgtattttttgtagaggctgggtttggccatgttgcacaacctagtcttgaactcctgagctcaagtgatccgtccacctcggcctcctgaagtgtataaacattgcctattgctctgcaaatagcggacacacagcatgatttgtactttttagtatttagtttattcattcattcagtagataccaagtgacattactcctactctaaaaatagactaataaaacacattctatactcttcagagattccagggtggaaaacagacagttttcctctagtaagagaagtttactcctctgaaaaaggatagaagtgtgagctagatcctatggaaatacagagcagaaagggactaagttttcctacaagacctagagaaatcttcacacaggagactctgaaagtatggctaagagtttgctgagcaaattaaggtaaagaattctaggggacagctgtgtaaaggcatgcatagtgaagtgcaggtgcatggaataaagtcaagtttggggaaacagggacatctgttaaacattttgagatgaaattggggaaaagaaagtaagctcctaaaggatcctaggggtattgtgtgcctctaaaagcagaagatcttagatttttgcttgaagaaatgggttatctttctacctagtttagttggatgattctcttttcttttggggagggctatgggagggtccatactagacttaaaagaacaaagacttgatatttccaagttgtagtttttagagttgttgttgttgttgttgttgttgttttgagacagtctccctctgtagcccaggctggagtgcagtggcgccatctcggctcactgtaatctccacctcccaggttcaagcgattctcctgcctcagcctcccaagtagctgggactacaggtgcacaccaccgcacccagctagtttttgtatttttagtagagacagggtttcaccatgttggccaggctagtctcaaactccagcaggtgatgcgcctgcctcagcctcccaaagtgctgggattacaggccttagctaccatgcccggcctttagaggatttcttatccataagcattttcatgtctttggttcacatatatcagattattcgcctcagcttattcattctgtctgtttgcttctcatcctttttttaatcagggagaatcatgatttattttcttgagttaaaacatgagaaatgtttctaaaatgtagaatatggtttctgaaatagttttacctttatgtatgtatgtctaaacacttggaacgtttacttccagggaagaaactagattataacttgacaactttatcttttattaacaaggagtgagtgtcatcaatcattgttaatagtagaattattgactttcattgtaatgataattgtttcctggaggcaataactgggaacagttggtcaatctggaaagtagtgttgccttggtaactgataagaaagaatgcagagaaactagttgtctgtcatgtataaaaaccaaggccctgaacaggttaaatactaactccaagcacaaggctaaaacagaaatatctgccagtacatgtactgggattagagacctgcaggctttgccaagagtcctggaaaccaccttctgcccagacacacaggaatccatgcgctttcttcaaactcagacagaatggaatagaacttcacaatatttagctcaaaggacattccagatcaccaccgcttgggttgggttgaagacagctttaatgatggaacggatcaggtcaaatgatgcagatgcagtgtaaaaggaaactacccatcctttcactgagcagatcttttttgaaagcttatttactgtgagtcaagcactgtgcagtgcacccacatggcacaaatgcacagttcacattcctaccttctagaagctcctgggaaagtcatataaataaaagattacagtgtggtttctaaattctaaaaagagatagagtattatgataatataaagaactcaggaggggttcaaagagactttgcagaggtgagtgagtaggaataggacctagaggcaaggggccgggtgcggtggttcacacttgtaatcccagcactttgggaggctgaggcaggaggatcacctgaggttaggagttccagattagcctggccaacatagtgaaaccctgtgtatactaaaaatacaaaaattagctgggtgtggtgattagctgggacacctgtaatcccagctcctggggaggaagaacctagagacaaggaatcccagtggcagctgaatctaggacttagtccttctggttcttaagtgtgtttctttttacctaggcaggctcacccttttcaaacttcatgtatttacctcatccaccaacttgatataattttacagtggctgggagattggagtttcttgctgtggctatttcctgtggataaatctgcatccctgattgagattatgtctgtaattcttatttggactggagtactgaactggccattctcagggtgttctgtgggttgttttgttttgtttttaaacaaggtctctgtcgctcaggctggagtgcagtggcgtgatcatagttcactcactgcagcctcagactcttaggtttaagtgatcctccttcttcagcctcccaagtagctagtactatgggcatgcaccaccacacctggctaaaaaacatttttttcttattttttttgtatagatgtgggtcctgctatgttgcccaggctcttgaactcttggcctcaagtggtcctcccacctaacccttctaaagtgctggtgttacaggcgtgggctactatgcccagtctttcttgagttttactaattattctatactagggtttccccatcatttgtcatccaggtggcattcacctcatttggggtgcaacaaagccattaattattcttccatttaatatctttgtatgccttgcaaaagcaatagtgtaatcttttttttttttttttgaggcggagtctcgccctgttggcaggctggagtgcagtggcgcgatctcagctcactgcaacctctgcctcccggattcaagcaattctcctgcctcagcctcccgggtagctgggactacaggtgcgtgccaccacgcccagctaatttttgtattttcactagagacagggtttcatcacgttggccaggatggtctcgatctcttgacctcatgatccacctgcctctgcctcccaaagtgctgggattacaggggtgagccaccatgcccagcctagtgtaatgaaactagaagctactctgtcccttccccctctgtaaaagcgtctggttctctgctttttcttagtgaggctgaatctgtcttcctactcagaagccacatgaaaggaaacttacagtgctaaggcaccatagaaagatattaacataaatctaagttctcttaagactggaaattagaaacagaagtttgctaaggaataagtcacccacatcttactctttgcataattaaagcaggaccattctttcttttttttttttcccccccccgatatggagtctcactctgttgcctggcctggagtgcagtggtgggatctcggctcactgcagcctccacctcccaggttcaagcgattctcctgcctcagactcccgagtagctgggattacaggtacctgccaccacacccagctaattttttgtatctttttttagtggagacagggtttcaccatgttggccaggctggtctcgaactcctgaccttgtgatccgcccgcctcgacctcccaaagtactgagattacaggcatgagccactactcccggcctcaaacaagaccgttcttaagatataaagtaaacaccgaaaccaagtgcattgcctctttttctcccttacttcaaacacgcgtttgctcccctaaacacacatacatacacacacatgtgtatgcatactgtgtattaatttgggagttttggagtgatcacaaaagaattaaattataattccaaattaaagtttgaagtacttcaatgatcacaaaaaagatacattgggccgagcgcaatgcccacagctgtaatcccagcacttggggaggccgagttgggcagatcacctgaggtcagaagttcaagaccagcctggccaacatcgtgaaaccctgtctctactaaaaatacaaaaattagtcaggtgtggtggtgtgggcctgtaatcccagctactccggaagctgaggcaggagaatcgcttgagcctgggaggcagaggttgtagttagccgagatcatgccactgcactccagcctgggcaacaaagcgagaccccctctcaaaaaaataaagatacatcgaaaaggagagtcatctagtgactaagattaatttttgctcagcggtttgggaagactggcagtcagaaacctagcatcttctttgtggcttttccattaagttttcaccatgtgatcatgggcaaaccactttttttctctggacaccattttgttcctctataaaatgaggggtctgttagggaagcctcagcattctgactctgtactgtcacacatactttagtgtctttgcagtactgttgatggatataatggacccttgtcctaaaagggattcagggaataggttatttactttccttaggcagtgccccagattttgaaatttagcttttctttttctcttatctgttagtgattgcaattacgatttatatgttgtttcttgtgagtagtagtggttgttttgttttgtttttgtctgtctttaccagagtgcagcagttctccagtccagggacttaggctttctcacttttgttgttgttgttgttattattactacacatcagattccctatagggagtaggaaaacctacttcatatatatatatgtacagtttcttggttgtttttttgtttgtttgtttggagatggagtttcgctcttgttgcccaggctggagtgcaatggcatgatctccactcactgcaacctctgcctcccgggttcaagcgattctcctgcctcagcctcccgagtagctgggattacaggcatgtgccaccacgcccggctaattttgtatttttagtagacacggggtttctccatgttgttcaggctggtctcgaactcccaacctcaggtgatcctcccgcctcggcctcccaaagagctgggattacaggcgtgagccaccgcgcccggccttcttggttgtttttttaaagctagcatcagtagatacattatgtatttgtgtgttttaactactttgtcaaatgctttttatatatattccctcaatcctcacggctatgtgttttgttgtactcagacccctgggtgaccaccaaacttatctgtatgcctgagcacctggctgacatgatgtcttgggtactcgccccttctatgggcttgaacttcttgttctgaccgcccccccaccccagattgcttctttcaactctctgtctcctgagccttgtaactatgaagccagtgcttggcccagttgctagatgttgacctcataattatattttttcagtttgaccacatttctgatctacacagtatgaactgtagtctggaatatgcacttctttgtgcctgactagcttcattcttctggtttctgctcttggtcttttggctggttcacattttgcagtctgctgtttatggatagaattactgaggcagaatatgtgatatctgaaggtagcagagacctgtaattttagttattgccttagctgttgggtagggatgaactagtgaagtgggtctgggtaggctggccagaactaaaaataatttggctataaggaacaagtttctatgcttgttctttgccttggtattttccacttcttcagaatataagggccaactaccactttcttcagacatgctgcaacgtccgccatgcccagtcatgcctctgccaataggcagcactcccgcatgagacagaaaggttactgaagatactgcctagtggagtcccaggttgaagtcatactttgagctggacatagcagtgggcctgtgattacttgaatggctgtttcaacttcagaagtgaaagtggtaaaactgaatccaagagcaccttaaagattcccctccttttatagaggaagaaactgaagctaagagcagttaaatgagtttctaagactcttaactattaagtgacacagattttaaaatctggccttctgactcaaagtcaaattaattttttccccaccatgtcagtaaattaagggtgtatatgtgtgtgtcgtttgtggggggtgactagtttacacagaatggggttgttgaggcttacctgatttctaaggtattttccagagttttcctctggtatattcagactgtattacaacaatatcttcctcacccccttttttttttttttggacagggtttcctctcacccaggctggagtgcagtgatgtgatcacggcccactgcagccttgacttactgggctcaggcaattctcccacctcagccttctgagtagctgggaccacaattgtgatcaccatgcccacctaaatttttgtactctttgtagagacagggttttgccatgttgcccaggctggtctcaaactcctgggctcaagcaatctgcccacctcagcctcccaaagtgctgggattacaggtgtgagccatggcacccagccatctccagactttcataattttcctcacatattgtacatacttaattatattattcaattatatgtataaaaaaagaaagcaagaattcaactatgttgtattaccaaggcctttctgtacccaatctcgcctcatattttttcttttttttttattttttgagacggagtcttgccctgtcgcccaggctggagtgcagtggcgtgatctcagctcactgcaagctccgcctcgtgggttcacgccattctcctgcctcagcctcctgagtagctgggactacaggcacccaccaccatgcccagctaattttttgtattttttagtagagacagggtttcaccatgttagccaggatggtctcgatctcctgacctcgtgatccacctgccttgggctcccaaagtgctgggattacaggcgtgagccaccacacccggccaatcatattttttcttgttactaattagaatcatgattctcctggcattcttcattttgttatacctcacttccttttccttagcaagatctttgccatagagtatggaaaccaggttccttgccagttaatctgtattgtgctttgtcatgtattgttactaaacagctcaagatcaaggggaagaaatgtatatgaggctcagttcatgttcagtttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctacagtttagcaagctttcctatgcggaccttggtaatttctttacattttatagaccaaagaacaatcttaacttgcccttttttctaaaggcattgtttaaaaactgtcatcaaatcattgcagtttatggcaaatggcctttttttaaaaaaaaaaaaaaagcaatctaaatcttttcttcatcttggaaaaagacttctcttggatttctgatagaatatttccagtatgctatgttattgcaagacagtaacttacagctagacaagaaaaatcagctttgttcaaagtaagagtatagcctgtccttatagtgtaatttttttctcacagttttgttttatggttccttcagtttgaatatacaatatttgagctcaaagcccagggcagcaaaggaccatgctgagttaaatgggggcagtaagctctggtgagtggggaaaactccaagctacaattgttagagtccctaagtctggaggtcagagaaagatgcactgcccccagtgtgttcacatgacacctaacagattattaggctggaaagagcagggcttggtagtggagggagcaacccagctcatccaaggaaccaagtgggggcagggacaggcgtaaatgcataaggggtatgttgtcacacaaatgtcttataattagaatatctatccccaaagccctgatcactgaagtctttaaatgaaccctttattaaactcttccattatgcagagctacagatggagctcttacgggttttggggaccccactcaagtcagttttcaagttagtttgataagttgctatgacagcaaacccactcttcctctgagaatgaatgcctgcaatcttaatactacgttaaggtgtggttttttttttttttttttagtccaattttgaacaatttcctggattcattgttcttcagggttatagctggggattggcaaatgagtctcggttatttttaaaacagttttctgagtggttgaatgtggaagggtgggcatggtatcagataaatgagtgtgtgggtatgcacgtatctatatcagtgaaagccaaaataattactatccttagtgcttggattggcaccatactgtgttttaaattgcagatctaaacagagtgctagttcacgggaaattacattctcagattaaagtagcattttgttgtgcagaaagcagcaggttccttcctttctttcgctttcattcattcttcctttctttctttctttcacatttgtaagtgcatttaatactcaactgcttgaggagagaggggcattgagggagagatgaattttgtcatgaatactggggaattggtgtgatgtcactgcaagctctgtgtgatcgtaggtggtattagagctccaggagcgaaagcagggagagcagtggaggagagacgatgtcgctctcagacaagcagacagcctctctcactgccgcgtacggtcagctcagtaagggcaagcctgcagagtgccgaatggactccccaaaagaaatcagtcaagccggattcgaatggcagaggacagagggcaaactgaatgaaattgggctgaatgtcagcatggacgggcaaccaaaagatgggcttgtgaagaatgccagcttcctggagcagaacaagctctgcttttttgaggggaagctagacaaagagctgagcattgaaatgcaggacaaggactgtcaagaagcctcaggtcaccttgagagcaggtatgtgatttcagagacctgccatcccttggaggggaactcggtacaccagaagacctccgagttccatctgggactcatagaggggccagacaaaaacaaaaccattccagttcaggggaaggtggcagggaagaatggactagagaccaagagccagtcagatctggatttccctggggctgctgacatccctaccagatatgttaaggagcaggaaaccagtgtttggaaccccagctttcatccagtggctcaaggctctctgggctcaagggaagcaactccgggagagatggagaatagcatcacccctggctgcccagtgattggggtggtaaatgataactctgagcagctgaagtgtgagtccccactcctggtgtctctagcccacccagcccccattattgagcattcacccaccaccattccgccaatcactatggtgttcacccaggaacatttgaatgcaagctgtcacatcagagaccatgataaggagttggagaaattgagttctaccgaggaggctgtgctcaaccaagccccccagcagaaaaaggcagtgcgcagggccctgtctgaatgttctcacctctcagttcccccagctgtcaaccttgcagataagtaccctgaactccctgcccgagaagagccttcttctggcctgctgcctccccctagtagcccaatgcctagtcctacacctgggaaactgggagctcctgctatgaagcgctccatgactgtgggtgaggaacagacagctagctacaaattgagccctgggaaactgcccatcttgtctactaaagagatacctcctttcatctgtgaggaaccagtggccaagaagagagaagaattggctcacttcagcaacagcagcagcaactctgggaagaaggaactcggcactgctggattatatctccatagtaagctggagcagattcctgaaggaagcagcaaggaaaaagggcaggaagattttagtgaaactagaattgattcatgctcgcaggtttgccagcgaggagagaaacagccaggacagacggctctggcagggaagaaagaaattgaggtcactgcaacccagagcactccatcgttcctgtttgaaaagcccccacgtgatggtatgtttctaaattttgcctccattgggaacaagcagacagcaaggaaggaaccaaagtgacagattaccggcagagcactaagcagctttttacagctgggttctgtgactgcctggggaaagcttaattcccttgtgttggaagcttgctgggagtgaggcaaggaagagaacaaagtgaatcttgcagggtcaagctgaatgtcttgctagcatgacagataatgtgaattgagtgtgcaagtttggggtggaatggggtcagagaatggtgggtataaaaactagaccccctttcttgacctcatgtcaccctgtccaacccatcccccatccacccagccctcagctccctgttggtttgaaccagatgattcctgagctctaaatccttcaatcccaactgattgatttccttgcttgaaaatctgtcactttatatagattcacaatgggtttatcagcactaacctcctctcattaagttgcacaatctgggtggaagctctgttttctgtttttgctttggagaacgttttacttttgttcaaactgaaaaagagccctttaaagctagctatttaatattctttctgtgttcttcatgtttgacccaatcttgcttctagttttctctttttgtatgtgttttgagaggatttgtggggagaaaaagaagaaagagaaagcagggagagaaggagagacttgcaacctaataaacagctaaattttgcggtctttgtgacagccttttgtgtctttcttcctggccctttcttttcttccccatctcccatccccccacagctcttattgtggtggtctaaaaaagcttgtgtttctccgagtccagtttgagcacaaagggccataattcacaaacttgtaaatggggatttaaaacatgtgttttgcttgtttaaaaaaaaatagtcttgtttcctgggacctgttttctctaatatttattactctcagtatatttttatgaaattgtactttttttctttgaaagtaagaaatggtattttctaggggagtggtaagtagaagacatacagatgttttgggttttttttttttatggagataaaaaacattttttgttttttatggagataaaaaacacgtttttttatggaggcaaagaagcttaatagttcctctttgatttcttatgactccagaattacaagcattcaggtgtcccatgctgttgcttccttctagctgggacagaactgtaagctcttcctggacaggactttgtcatctttttcttgatccccaggtgctttgttcagtaccacataacttctaggtgatcatgagtgaagactttgtttcagaacaagttctttctaattcagactaacagaagtttgtgctaatagaaaaaaatttcagatgactgacaaatccaccgatccattcacccgataaatgtttaaatgctgactctgctaaccactctgtagataaaacttttataggaagattgtttcatttaacatgcctaccatttgcattcactatctaggcactggaaattatccttatcctcaagcaacttttgatccagttggaggactgggaggcagtgggagggttgtgaattgtggaaacattttggaggaagtcacatttgaggtgggccttggaaccctgggatgccaaataatgcggagggaaagccttccaggcaagggaactcatattaaacaaagatatgaagcctagacagctcatgttaggtaaaagaacaatggaggaatctcagggcatccagtcacaggaaatgtggccaggctgctgccattgtgtatatctctcttgggacctctgcttctccctgcacatgtactccattctcttccctttaaaaatctgtatttcctctgtcatctctttttgcttcccttgtaactctgcccaggacagaatagcattgagttgccatggtttgagctctgtggccagctttgttaccaccatatatgtcagggttccgatgttgcatgactgtcatttccatgtctttgtctatactgacaatgagtgagtaattatatcttattggctcagcttggtccagtcaactctataccaggtcccatagccttcttaaccaatctgagccatttagacccacccgcttcattcaccttgaggcttctctaaaggagagagtataggttaaggaaatattccaaagccgtctttacatatgtgacaagaaataatgggagaaaattctagaaagttgtttggaatccaatcttgctaagcttcaaatgtcccactgaaaagtttaaagcttactactgtgtctggaattggtgggttcttggtctcactgacttcaagaatgaagccacggaccctcgcggtgagtgttacagctcttaaggtggtgcgtctggagtctgtcccttctgatgttcagatgtgttcggagtttcttccttctggtgggttcgtggtcttgctggctcaggagtgaagctgcagaccttggcagtgagtgttacagctcttaaggcagcgcgtctggagttgttcgttcctcccggtgggtttgtggtctcactgggctcaggagtgaagctgcagatcttcgcggtgagtgttacagctcataaaagcagagtggacccaaagagtgagcagtagcaagatttattgcaaagaacgaaagaacaaagcttccacagtgtggaaggggacccgagcgggttaccagtgctggctcgggcagcctgcttttattctcttatctgggcccacccacatcctgctgattggtagagccgagtggcctgttttgtcagggcactgattggtgcgtttacaatccctgagctagatacaaaggttctccgtgtccccatcagattagttagatacagagtttcgacacacagattctccaaggccccaccagagcagctagatacagagtgtcgattggtgcactcacaaaccttgagctaaacacagggtgctgattggtgtgtttacaaaccttgagctagatgcagaggttctccaaggccccaccagagcagctagatacagagtgtcgattggtgcattcacaaaccttgagctaaacacagggtgctgattggtgtgtttacaaaccttgagctagatacagagtgccgattggtgtatttacaatccctgagctagacataaaggttttccaaggccccaccagagcagctagatacagagtgtcgattggtggattcacaaaccttgagctaaacacagggtgctgattggtgtatttacaatccctgaggtagatataaagactctccacgtccccaccagactcaggagcccagctgggttcacctagtggatctcgcactggggctgcaggtggagctgcctgccagtcctgcgccgtggtgcgttcgcattcctcagcctttgggtggttgatgggactgggcgccgtggagcagggggtggtgcttgtcagggaggctcgggcggcacaggagcccatggaggggtgggaggctgaggcatggcgggctgcaggtcccgagccctgccccgcgggaaagcagctaaggctcagtgagaaatcgagcgcagcacttatgggccggcactgctgggggactcagtacaccctctgcagccactggcccgggtgctaagtcccccattgcccggggccagcagggctggctggctgctccaagtgcggggcccaccaagcccacgcccacccggaactccagctgacccgcaagtgctgcgcgcagccccggttcctgctcgcgcctctccttccacacctccctgcaagctgagggagctggctctggccttggccagcccagaaagggggtcccacagtgcagcggcgggccaaagggcccctcaagtgccgccaaagtgggaacccaggcagaggaggcgccgagagcaagcgagggctctgaggactgccagcacgctgtcacctctcactaccatgttctgaaactgtggtgactgcctatgatagcagataaagtagctccaggtcagctttaggaagatttacttgttctcagtaagtgtgatgaactggaagacaaagagttgaaagcaaacaatcctgttagaaatttgattcaggtagtggcagatgaaacgctgaggatatgagaggggaaatataacaggtgaagataaagtgaaactggaatttggaaggtgtgtgagaaaaaggaattgaaggtcatgctgtgatgtgaggctggttttcccagccagtggtagtataggtaatggaaagacccaacagaagagcacagttcattgaaggagttagtaagttccacatcagacattgcttttgtgaaactctggggatatgtgggtggtggtctctagaaattgcctgatagctgggcttggtggctcatgcctgtaatctcagcactttgggaggccttggcaggcagattacttgaggccaggagtttgagaccagcctgagcaacatggcaaaaaacccatctctatggaaaaatacaaaaattaggtgggcatagtggcatgtacctatagtcccaactgtttgggaggctgaggtgggaggattgctcgagcccaaaaggacaaggctgcagtgagccaagatcatgccactgtgctccagcctgggagatagatcaagatcaggtctcaaaacaaacaacaaaaaagaagttgccttatatatccatgagacaagggaaagggcttggtgagaactaccttctgggagagagaaagcagtttctgcttatgcacagttacatttatttgtataggtcgagttactgcatgcctgtatcatagacaatgcgactttatgaaatatgttgtttactgaaaaatgctgaacttattgaaaaatatttatagtggtctggggccagtggcagctagttacacaagtaagatcttctttgagcttgctgtagaacaaaggcattagccgggcgcggtggctcacgcccgtaatcccaacactttgggaggccgaggcgggcggatcatgaggtcaggagatcgagaccatcctggctaacacagcgaaaccccaactctactaaaaatgcaaagaattagttgggcgtggtggcaggcgcctgtagtcccggctactcgggaggctgaggcaggagaatggcatgaacccaggaggcggagcttgcagtgagccgagatggcgccactgcactccagcctgggtgacagagcgagattccgtctcaaaaaaaaaaaaaaaagaacaaaggcgttaacaaatttgcacagttgttggctatggtttttccccattacattttaaaactagaaaaatactcagtttttgactaaaagtacatatggttcaaacatcaaaaagtacaaagtgctctccattacaaaaacctcctaccaagacaagatggtatcatctcattgttttctgctcctcccctgtaaatacaactaaatagtctggaaataattgaagataattccataaaagaatatgaggtagaaagaaggcaaacctggtagggatctcaggacttgaggaatggcaatacagtgaattccctgggactgatgaattgattgattgattgattgattgattgattgatggtagagatgggatcttgctatgttgcccaggctagccttgacctcttgacctcaagtgatcctccttgcttgacctcccaaagtgctggtattacaggcatgagccactgcgtccatcccctgggttttctttttgtctcctacatatccctggctgggcactggagaggcctgtaacctggaattaccaacaggcatagactgaaaagaaaaggaaaggaaaaaagaaaacaaatagagaaaatctgttctctattgccaaaaaaacaagaaagaaaaaaacccagcaaagacctaatggtgagccctgtttcactacccatccccagcagtgggctcagtctgcctgcaggtacagtgtcaatgcagcccataagggccttcctgttgtccactccatactcagcagaagctataggcctggtccgcccacatcaccagcaactgcagggaggcctgtcccctaccaggtaacagcaccagtggcttctatagccctggtgtcttgtaatcctctacccaggggcaggagactttcgtaggtttcagaacctctacttccttccccttagcaagagaaagcccccgaggtaggtgtttcctgctcccagcaaccccagcagagatcaaacaggaggtctgcctgggtcccaggcagccagagagcagtccagaggaagctctctattctatgtttccagcatcactcagcccctatgtgctgacactgggtgacacaggtaagtccctacagccctttcaggcagtaccaaaagggattagttagaaccttagcagaatcagaacacaacaggccataaatgcattgcaagggctctaggaaccaaattgtcatcagaactacagtcataacctgtagactaaatataaacagggtgattgcatgctaaagtacaaaatcagaattttaaagcagccatcataaaagtgctttaacaagcaattatgaattctcttgaaacaaatgaaaactaaaaacctcagtaaagaaatagaagttacataaaaagaaccaaatgttaattgtcaatatgaaaaatataataattaaaattaaaaacttcaatgggctcagcagcagactgcagataacagaggacagaatcagtgacgttgaggacagatcaataggatttattcaatctgaacaacagacgaaaaaatggtctacaaggaaaaaacatatcttcagacccatgggacaataacaaaagatctaacatttgtatcatcagaatctcaggagaggagcaaggatgcaaggctgaacaactgttcaaagaaataatgacaacaaacatcccaaatttgacaaaagacaaaacttacagattcaagcaactgaacaaataccaaataggataaatgtggagaaatcatgccatgacttttcataattaaacttttataaactaaagacaaaaatctgtaaaaaaagcaaagagatatgatgcattagggaaacagcaatttttttttttaaccttccttatggtgctgaggaaacagcatttaaatgacagcctgtttcttatcagaaactggggaatgcaaaaagaagtggcacaacatttttcaagtgccaaaagaaaagaactgtcaactgcaaattatttggtaaaacaatccatcaggaatgaaggggaaataaataaaaaagacatttttagataaaggaaaactaagaatttgttgctagtagacatacccttagagaatggctaaaggaggctctccaaaaaaataagatttggtaacagaaggaggcttggaatttcagaaataaaagaacaacaatggaatgggtaaaaatatggaaatagccaggtatggtggctcatgcctgtaatcccagcactttgggaggccaaggcgggtggatcatctgaggtcgggagttcgagaccagcctgaccaacatggagaaacccccgtctctactaaaaatacaaaattagccgggcgtggtgacgcatacctgtaatcccagctactcaggaaggctgaggcaggagaatcgcttgaactcgggaggtggaggtcgtggtgagccatgccactgcactccagcctgagcaacaagagcaaaacttggtctccaaaaaaaaaggaatataatagacttatctcctcatgaattttttaaagtcataaatcatatttgaagcacaaattgtaatgccatctgatgtagtgcttaatctatgaagaggaaacacttaagacatattttagggctgggcgcagtggctcacacctgtaatcccaccacttttggagaccaaggtgggtggatcacctgaggccaggagtttgagaccagcctgggcaacatgacgaaaccccatctctactaaagataaaaagaaaaattagccaagcatggtagcgcacacgtgtaatcccagctgctcggttggctgaggcatgagaatcacttgaacctgggaggcagaggttgcagtgagccgagattgtgccactacactccaacctggacgacagagtgagactctgtctttaaaaaaaaaaattaaagtagggagaaaataaaggatcctaaatggaagtaaggttccagtaggtcactcaaagtagtaaaacatagctgggtgtggcggtgtgcatctgtagtcccagctactcaggaggctgaagacggcaggatcacttgagcccagagtttgagaccagcctgagcaacacagtgagaccccatctctagaggaaaaaacagtagtagaacattgataccagtttgttgtatgtatattgtaatacctagagcaaccactaagaaaactatacagagcaatatactcaaaagcttttttttaataaaaatagaattctaagaaatgttcaggtaaccttgggtgagatgtaatttgaaaaaatgaaaaaaggaaattaaaaagattaaaaatgttcaggtaaccaacaggaaggcaggaaagtgaaacagaaatgagaaaaagagagaacaaataaaaaataaaatatcagacttaagccttaacatagcagtaattattttactttatttcatttatttttttatttactgagatggagtttcactcttgtcacccaggctggagtgcagtggtacaatctcagatcactgcaaccttcacttcccaggttcaagcgattctcctgcctcagcctcccaagtagctgggattacaggcgcccaccacaacgcccggctaatttatgtatttttagtagagatggggtttcaccctgttggccaggctgatctccaactcctgacttcaggtgataagcccacctcggcctcccaaagtgctgaatggattacaggcgtgagccactgtacctggccatcaggaattattttagaagcaaatggtctgagtactacaattaaaagacaaagattggaagagtatattatttttaaaaaatgactcaagtaggccaggtacagcggctcctgcttgtaatccctttaggaggctgaggcagaaggatcacttgagcctaggagttcgagaccagcctgagcaacccagggagaccccatctctacaaataatttaaaaattagccaggcatggtggcacatgcctgtggtcctagctattcaggagctgaggtaggaggatcacttgaaccgaggaggtagaagctacagtgagtacagtcagccatgatcacacctgtcttaaaaagaaaaaaaaattgcccaagtatatgctatctacaagaaatgcataacaaacataaggacataggtaggttgaaagttaaaagatggaaagaaatatatcatgttaacaattttttaaagtagcagtagctatatataatgattatgcatatatatatatatatatatatatatatatatatatatatatatatatatagttgttttttcttgttgcccaggctggagtgcagtggcctgatcatagctcacagcaggcttgactcgctgggctcaagcaatcttcccacctcagcctcccaagtatctgagtcttataggcatacaccaccatgccccactaattttctttcgatttttgtagagaggaagtctcactttgttgcccaggctagtctcaaactgctggcctcaagtgatcctctgcctcagcctcccaaagtgctgggattaaagattacgtgtcctggagtgactatactaacatcagacaaagtagatgtcggagaaaagaataaaggatcaatcccactaagattgatccttacatttagaaaacttagcaattctaaatgtatacacaccaaaaaacagagcatcaagatatatgaaacaaaaactgacagagctaaaaggagaagtacacaaagtcacaattacagctggggacttctgtaacccactatgaacagttgatagaactactagacagaatgttagtaaagatgtaacagtgccatcaaacaacaaaatctcataaacattgatagaaattccactcagtgacagaatgtacattcttctcaggtgtccattaaacactcaccaagatggatcttgggtcataaaaccaacttgaatcaatttaaaagattgaaattatgatggggcatggtggtttgtgcctataatcccagcactttgggaagctgatgtgggaggactgcttgagaccggtcagtttgggccacatggcaagacctccatctcttcaaaaaaattttttttgtaaattattcaggtatggtggcacgtaccagtagtcccagctacttggaaggctgaggcattagggtctcttgagcccaggagttccaggtggcagtgagctgtgatcatgccactgtactgcagcctaggcaacagacttcatctcttaaaaaaaaaaaaaaaaaaaaaactgaaattggaattatttcaggtatacaaggttagtgcaataatcaaaagtaattgtcagccaggtgtggtggctcacacctgtaatcccaacattttgggaggccgaggcaggtggatcacgaggtcaggagatggagaccatcctggctaacatggtgaaaccccatctctactaaaaatgcaaaaaaaaaaaaaaaaaaaaaattagccaggtgtggtggcgggtactgtagtcccagctacttgggaggctgaggcaggagaatggcaggaggcggagcttgcagtgagctgagatcacaccactgcactccagcctgggcgacaaagtgagactccatctcaaaaaaaaaaagtaatctgttatagtctgaagaaaataaattgtaaacacagaaaaatcgtttaacagaatcaaatagccattcatgttaaaactctcagcaaagtaggaatagagaggaacttatttaacttgacaaagagcgtctacagaaagcctacagctaacatcatatttaatggtgaataagtgaatactttctatctaagattgggaacaaggcaaggatatctacttgcaccactcttttaaatatagtgtactggaagttactatagagatggagaacatagtagttgccatatatttagggattggaaaggggatggggtagatatggctatagaggggtaacatgaagaagccctattgattgtaaccagccactccaggccaggtaatctgtaatcccagcactttgggaggctaaggtggtggtggtggttacacaaagctacacttgataaagttgcatagcactacacacacaaacacacacacacacaaatgagtgcatgtaaagtgaaaaatctgagtaggctctgtgggttgtctctgtttcttggttttgatagtatactgtatttacgtaggatatcaacacttggggagactgggtaaaagggtacacagggaccttccctatgtatttctttgcaacttcctatgaatctgtaattatttctcaaagttttaagcctcctaacctccccagttttgtgtcccatcctttccctcaaaaacgttgttctgtttaattacaatcctttcaaaaattcttttaaaatgcatatataagtgtatttgcaatatcttttccctcatcccttttcaagacaaatagtttcacattatacttatgctttgttgttttttttttcacttaatagagaccattgcatagtaatcataaaagaatttctccatgctttattttttcacattcagagattacattgatatttctaccataataaccagttttctattaacggacttctgggttgttcttttgcttttagaaacaatgatctggtggaaaccttgcacatttactatttggctggtgtgtaaatacacttctaggataaattactagaaattggttttctagattagaatttatctgtccttgtaattttcagaaaatgacactgccaggcagccctgcctatgggtcatacagttcacatacctaccaagtatatttccctatattattctcagtagttattttaaaattttaggacttttgacaatatgttaatattaatggcatttcaggccaggcatggtggttcatgcctgtaatcccagcactttgggaggctgaggtgggtggatcacttgaagtcaggagtttgagaccagcctggccaacatggtgaaaccctgtctctactaaaaatacagaaattagctgggtgtggtggtgcatgcttgtaatctagctacttgggaggctgaggcaggagaattgtttgaatggggagacagaggttgcagtgagccgagatcgcagcattgcactccagcctgggtgacagatcaagactttgtctcaaaaaataaaatggcatttcagtggggtttttttatttttcttatacttaacattgtacatcttttcatagtttcaaaaaactttgtatctcttttctataaagtctgttcatattgttttgcattttcccagtggattattggcctttgtagcagttactgatttgtgggagtaatttatagaataagctctttgtctttggtatgagggtcaagtattttttctgtttgtcatttgccttttgacttttattatagtgttttgtcttattttgttttttgccacattgaagttttttatttttctttagtcaaacttatctcttgtggcctcttgactttgtgccagttagaaatgccttcccccacagcaaggttatacatttcacagtattttaatgctctcaggtatagtcctattgaaatccagagtaacctctccacagagaggaggctatgttgccttaggcaggagactttatttctggccctgagtctggttccatgggtctccttggccttgttgaaaatctgggtcactgttagaactggatcaggttaatctcacatcctccataaagtggttctttatagggaaaggaaggaaagggagtcattgaatgatcttctggctcttatcccatctcacagcaacctttattccaaagatagactggtagaagaggtttttgtcctattgcttggagagctagtggttggaagacagagtccctttggtctctagggaagggaaaccaaacttaaaggaccatttttttccactgatcatttgtgcatgtgtcccttagactgcttctccacagggtcaggctctctgaatctgaggaatctaaaactgtcctccatcacaatgagaacttgggaggcttgtccacatttcagcagcacaaccctgtggacttttttcagaatgaagtgctagttagtggtctgtctttgctaaaccttgtattttcaaaatgggcatgtaaaatgtttgcttagcataattcccactcaccctctccccttaggaatagccaggccagaagaaggaaggcctgtggtgagtgggacaggaaatgacatcaccaccccaccgaacaaggagctcccaccaagcccagagaagaaaacaaaggtaggtgccagaatggtggttatcttctactgccataatttttaaacggagtatcttctgctgttattgcttgaatcacgaatgaaatttcttttttctgagctgttattgtccttcctcatgtttggacatgcttagaaaatatcttgtattctcatttaccacagtggcctaaaccaactttaaaatctcagcctttgaccctattatcttatatatctgtaaaaaatgttctgtagaggccgggcatggtggctcatgcctgtaatctcagcactttgggaggccaaggcgggcggatcacatcaggagatggagaccatcctgaccaacatggtgaaatcccatctctactaaaaatactaaaattaactgggcgtggtgatgcatgcctgtaatcccagctactcaggaggctgaggcaggaggattgcttgaaccaaggagttggaggttgcggtgagccgagatcatgccactgcactgggctccatctcaaaaaaaaaaaaaaaagttctgtagagattgtttcaacttcccttaacaacaacaaaaaggacaattgcaaaaatattctgaaataaattctgaattatttactattatctcagcgttagatgaaagaaaaaaaaagattctgaaatatccattcatgaaaagagaatgcagattttgaaggtggatcatatagcttcagatgcataactagtacttattgcaaagttcaaaagccacactgtaggctgtggctgctattgtcccatcaagatacaggtagtttcagcatgttgtccagggtcttcaaaaaattaaaaagttattaaaaaaaatacaggtaataatggctgaatcacctcctgatgcttttcttttagaatagccaccaaaagttagttaattattaagagttaattgttttactgaattaaatcttcaggtgccaaactgccagaatttgtgccactatcattaagaaactattcccaggccaggcgcggtggctcacgcctgtaatcccagcaccttgggaggccgaggcgggcagatcacaaggtcaggagatcgaggccatcctggctaaaacggtgaaaccccgtctttattaaaaatacaaaaaattagctgggtgtggtggcacacgctggtagtcccagctacttgggaggctgaggcaggagaatcgcttgaacctgggaggcagagcttgcagtgagccgagatcgccactgcactccagcctgggcgacagagagagactccatctcaaaaaaaaaaaaaaagaaagaaaaagaaaaagaaactattccccattttctttctctatcctggtttcattccattatttattgagctcagaagaaagaaatgctaattttaagttgcatctatcctcattgcttataattttactttgaattgtgcaatttatactttttttaatttgtttttattcttgtctgtttgatgttgccctttaaaaaataaaaataaaaaataaacaacaatcaacctaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaaggtaagtggtcacctaactactgtgccgaggaaaattgttcccctctgagtgtcagatagacagatccttgttgctaacagacaacagaatcaggctggtggaattgggaaaaggcaagggaaatgggggagagggtgatttgaaaattggcatggctactctggacgcgctgcctatgggttagccctgctccacgaggagcagccaaaaaaagaaaaaagaaaaggaaatcaatttggggcccattgatgcagacattaacattttgaagcccttttatgctcttacctttcccttccctgtttggaggtaatactctatctacttaggttcttcctcctttctctcagctacctactctttacctatttaagcacttattaaccagtttcctctactccacataccagttagatattcttttttggtataattcccacatcaaatgtaattctttgtctttccctgttatcatcctgcagaagttttatccattactattgtgatataactagttcttccagcttatctcagcatgttccagcatgatgtgataacttactttgctttgggcattaggccacctctcactgagctacttctgaagtcatccagttttccaggtcacccacggtttctgtattgcccagaaactggtcacatttggagcagcattagtgttacagaattgctccaggaggagaggatagtggaggctgtggctgcattccttaacatcttgtgttatttgagaagggcctttaggtcagcctgatagtactctttaaattcatggtacgaaatagtttcccatgttaaaatgtcagtttttaatttaatatggtgaagaaaactgtggaacctaggagttgaagtctaggctgaagccctggccaagaaactgaaaaatcctctcataaactagtaatgataaaatcttgtaaagctttctctctgatcctcatttatccagttggttgcttttcttgatctttagaaaacaataggtttgaataagagggcagaggggaggtgcctggagccctggcagcaggtcctccctgttgcttattcagcagcggcttctggggggtgacagaggagagtaggaaggagaggtgtctagtgaaatttcactctataataatcatataaatgaagtgtagtgtactagttgctgtatatacatgaacttttttttaatttttatttttttgagatggagcctcgctctgtcacccaggctggagtgcagtggcacaatctgggctcattgcaacctccacctcccaggttcaagcatctcttgtgcctcagcctcccgagtagctgggattacaggcacccgccaccacgcctggctaattttttgtatttttagtagagctggggattcaccacattggccaggctggtctcgaactcctgacctcaggtgatccgcctgcctcggcctcccaaagtgctgggattacaggcatgagccaccgcgccagtcctgttctaatctcttttatccagatgaggaaataaagctcagagaggcccagcgatttgccaaatagcacacttagaattaaggggccaaaccaggactgcagctcaggcttctgacccagatttggccagtggcctcttcatctgcagcttattttggtagaaagatttgtagagacagagagagaaaaacctattcagaaaaaataagtagattacgattctggcagagaagaaaatgtaaattgggaaacagcagaatagctccagttaacttctgcaggtttttgaagccaagagcctgacatctaaaagatgcaacatccttttgagatttctatcccacataacttttttctaacttattttatcattattaccctcatggcaaaataataagactatgctagattattctgaataatagtcatagtcttaaaaatttgatgcacatcccagagagcatctggtttagtcctcaaattttagagcaatagaaaagggaatcctctggccaaaatcctacatgtttccagcagagctggtagcagaaccactttccctgattccagccttagcgttcttcacaccatacttaaggcctttatttgtggaaattgtcattaccctacatttgcagagttagactttggatgccagcccttaatttctagtacctccttagctgatttttccatttaacgatatcctgcttgtcgctacctacatactgccctctttatagccacttctcttggaggaagagagctgagcccactgtgtctgtgatttggcatactctcttttgtaatgtggtaatttgtttatcaaaatagtgtcttcatcccctatccccgtagaaaccaggctaaactgattctttcccttattcactagagacgtcattctcagcctccatgtaaaaggaactagagtgacccagatgccaagcatctatacttgagagactttttcccttttgctttcagactgtagctgtgatatcagtgctttttatcccttctgttgatcaggcctgcctcttctcatcgtctctgtgctgagacctttcatcctttatttcctgacatcacatattatcaaagctggtccttcatcaccctccattctaatctctttatcccgatgaggaaataaagctcagaggctcagtgatttgctggagtagggctacagctcacgcttctgtcccagatttggccagtggcctctccatctgcagctcagtcctgttcagcattctctaggtgcgtgttagccaaaagaatggctcgatttgaacataatttttagtttttgtttgtgtatgtttaatctttggtcaagtataatacattagattttattacattaaatacattagtatttttggcatttctacagaggttacattaaaatatatgcgtgtgtgtgtgtgtatgatatatatagcagtagatttggaggcaaacgtaggttgtggtgatgtacccatcagggctgttcattctcactggctcaagttggattgaagtagttttactctctgttgtgtgccctcagatcacatagcaccctgcatggccagtttgttgctttatgtggaggactttgctcttagaaccatatgtattttcctgtcagtagctgctgaacccacagtacctcctgttctccaatacatggttgtatagacacatcttgtgtccaggtgcagtggctcatgcctgtaatcccagcactttgggaggctgaggcaggcggatcatgaggtcaggagatcgagatcatcctggctaacacggtgaaaccctgtctctactaaaaatacaaaaaattagctgggcgtggtggcacgtgcctgtagtcccagctactctggaggctgagtcaggagaattgcttgaacctgggaggcggaggctgcagtgagccgagatcatgccactgcactccagcctgggcaacagagtgagacttcgtctccaaaaacaaaacaaaacaaacaaaaaaagaagcatcttgtagcgtgactccttggggctattgctgacctgcaggcctcattcccactttcctatttccagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactggtgagtattgcctttctctcccatgggaactagggaggggaaaatgggatcttggctttgccccagccatagctctagctagtatcacaaacagctgtgcaggcctgcttacgcaccggtccttagtggactacctggaacagtggtagccctgtgggcctggtacttaacaagccttgatctctgtgtgagcttagcagttgtatgtattcagaaaaatcttgagtgaaggcagaaaaatgtactgctcatgaatttccaggtagaatttactcttgccttagtaacccacagcacctagcacgtggtgctcatgggcttacatgatgataagaagagggcgtggtgctcatgggcttacatgatgataagaagagggctattcaagtccataggcatgtattgacagcctacttttaaggccacatagaaggcttatcagggcagtagagaagaataagactcagtgcctgaccatctaatttaccactccattcccagggactaacacagtccctggctcaaagtagatattcagtaattgttaaataatgaggaatctcactattggatgaactatccaacaggtcagtttgttaaatgttatattaataagtatattttgtacagccattaagactgagggaaaacctgcagaagtcaagaagatgactgcaaagtctgtaccaggtaatagcccatccgccattttgtagagccctaacttgaacccccacctcctctgtggcttaagtctccctttttctctctctccctgaacccgtgttatctctcactcccttctttgcagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggtgggtccagggagcttggggtcctggcatgctggcccctgcatcttcccctccatttccacccactgttcccaggcccaccaaagaagcaggcagtcaggacactggactcagcatcagggtatttcagccggggctctgtagtgggttttgtgccccagcagcagggaggcggggtaggctgagctctgggctttctcttcctgtctcagtaagaaaggctcctgttctagatgttggggtctgagtttacatttttgcttggatgtaaaaggattcttttgtagaagaaacagaggaggcctcagagactctgcaagtgagagagacacttgacatgagcctagtttttcatggttcttagcctgcacagagaatgtcaggataggcagaaggtagaacacctcttacttccacaacccatgacttgagtggaatatatctgaaagaggactagggtgtcctcttatggccaggatgagtcgtgctgtgagcctctggccttcctaaacagcaggactgcactgcatatagtgatggagaaagatcacagtgcttcacttttaggattttccggtggttaagattttctggttgcatcagtcccagaattatttaactgttggtaaccatgggaactctgcgtgaaaaggtggtgatgaaagtccgtctgagaatgttcgggtccctggagtagtgaccatctcatctcctaggtcattcactagctctacaccaccaccaccatccagggcagcatacttaaattgcttaatctggagctgttaagaaattcaggagggacaaaaatgaggtggaatcctggtgctgttggaagacactgatggcaagctgagatcagtctagagaagagcctgagagttgcttgtggtagcgacagtggctctggtgtgcccagcaggcctctgggctgtgctgctgatggcctatctccccgtctttgctcttatggtttcatggtgcaaaagttacaggagttcttgggtggggagttgagtgacttgatctagtgaattgttttctgcttcaacatacctaaagagtctgacactttctatcagtattgacttcctgtgaccgtggcagctgcttggggcatatcaggacatttggcatggggtggggggtattgtaattggaaaatcatgccccagcacactctcagaatcactaatttggttgtcttagccttcctttgtgccttttcttcattagctagtgtcttgatctgttcctcatgtcttaagactatggcctgcagctccttcttttgtggtcctctactcaaggatctttgacttggtctaccctgggaaatgtatggttttgcctaggatcaaaggccacctgcttttgcctggtggcctgacctggatttgagtcccctacagccttcttcccttcttggcttttgagctcttatcctcttggtttgaaatttgccctccctttatctccatccaggccaaagtagagaaaaaaacagaggcagctgctacaacccgaaagcctgaatctaatgcagtcactaaaacagccggcccaattgcaagtgcacagaaacaacctgcggggaaagtgagttttatttagacccacctctgcaaggtgaagatggtaaaatacttcttccagcctgagccacatgccctctcttgcactttttccctttccctaactagtttctacttcttctcccctatattcccttctctgtgcttgatgactcggccatcagaaaattttttgtattaaccttgaaagttaatagagttgggagcccattagccctttggagaatacatatgtgtataatttttggctggataaaatggatccaaagactttcattcatttccttcacactgaccttgatgtgaaacctacctggtatggatgcaaatacagtgcacccacattcgttatcaagaagacatggcaggggtaatttccaccacctggaaccctggagcccctgtgctttaccttgaagtagaagatccctctcataacgctgctgggtatggagataacttcatttgtcctggttccccgggtcacctcttaactgaaagttaggatgctcattcccaatggaaacccacttagtataggtatgcagcatcaactggagggcagaggtaagctgaaaccacaggttctttccccttgcctctgtaaacctggaaaccaggcccctcctgagtgcttgcaacacctaccttccttagctgtagcaggtaggtgtgcctctgccagagaagcccgcactccagcccttagggaccagcatgggaagtctcagcctagggcattcctacagtgaagaaagctgcaccgtggcttctgggtgactactagaggtcctaggttcagaccaaggctcattaagtagtttgctaaccacttggttaccatcaaagttgtgaaaaaggctagaaatgagtaggtacaatgaggtatatgggttggagtttctcaggatttctgtactctgtggagaactcttcagcctgggacctgcatcatttgcaaagaaaggaagttggcaactattccttcttgagaaggtcctaggattctttgttccagactcttagagccagggccttggtgtttctcagttccaggggaagccattcccgtactatacagtgtggttgtgcccccaggattgggcgtccttgctgccctgcttagagcctgttctttccgcatgggcatctcacagggcagaggattaggcatatggaggattcaagaaggtattttacccttgagtcaaaaatactatgccttctcgagccctgagacaaatgggctaagtgtggaggctgtagccgctcccctggtgttggagattctgtatccatttgtatgcacatctgagcactggcccctccttcctgttagtatcatccgtgcccttgttgccagctgcccagtgcttctcagagcagcctttgcttctgagagtgggtctggctgcagccattccagggcccagatttaagggaagcaccctctttgggtgagaacaggtccacatgataagacttgcagagaagagccaaggacactgtgcccagctcttgaggagggagcagagcaaggaggtagggctgtgcctggttgggcatcaggttaggctgctgcctgggccttgtgaaccacaaccccgcccccaaaggagcggtgatgaccaacatgcagtgcctgcgcagctctgctcctgtcgttgtgttgtctgttcacgtttttcactccccttcttgctctttcacatttcttttcctgtgcttttccacatctgttctgtagaaggtgggggtggaggtttaacaacactttttgttggtcattgtgatcacgtgtggactcactgccttccctgtgtcggttctaaccagtcctctccctttgtgttgttttttctattttctaacactccaggtccagatagtctccaaaaaagtgagctacagccatattcagtccaagtgtggttccaaggacaatattaagcatgtccctggaggtggtaatgtaagtataagctctggttagctggcatctgagatatagcccactgtggggtatactagggagagagccaggtgcccatgtagatagaatcccagtgacctgagctgtagcgttctgtaagaagcagactagcaaagtgaggggaccttgatgctcccatgttagacagggtgtttctggtgagcccctaaacaccagcatggtgatatccactcagtatctttttacccatatgggtgggaggctttggatttttctccagctatgtcagagcctgggtctgagcacagtggtcagcagcagacctgttgcctgtctggagtccgttcctgggatgtgtatgtcggtctgcatgcccttgaattaccgtggaagtaacttctctgagacagatgtctggatggatctttccagagctcatctttgaatccttgttattataaaataagaattaatcaacattttcttcctatcccttccccacgtttttttgagatgaagtctcactttgttgcccaagctagagtgcagtggtgtgatctcagctcactgcaaccaccacctcccaggttcaagctattctcctgcctcagcctcccgagtagccgggactgcaggtactcgccaccatgcccggctaatttttgtatttttagtagagacgggatttcactatgttggccaggctggtcttgaactcctgacctcatgatccacccactttggcctgccaaagtgctgggattacaggcatgaaacactgcgcccggccctcccatttccctttctgctctccttttttttgtccattttctaatcccttcctcctttttcttcccctccttttttagtcccttttcctgtttttttgtttgtttgtttgtttgtttgtttgttttgtttttgttttgatacagagttcactctgttgcccaggctggcgtgcagtggtgtgatctcagctcactgcaacctccacctaccagggtcagtcaattctcctgcctcagcctcccaagtagctggggctacaggcatgcgccaccacgcccagctaatttttgtatttttagtagagacggggtttcatcatgctggccaggctggccttgaactcctgaccttgtgatctgcccgccttggcctcccaaagtgctgggattacaggtgtgagccactgcgcccagactttccctccttatctttttgtcctctttcctcttccacccaaacatccttctttttgtcttgctgccattgtgtgccagctctatgatgtgtattagggacacaggtgatcccagctcacagggaggttctggtctagggagagacagggcgaagtcttactatcgtcgagtgtgtgaagaacaccctgtgtgctttccgcttgtcactgtgacagtgcctagaaaagtggtactctgtggagttgtgccagaggcaccagaagccgccatgtacagcccctgccctcaccgctcccttccaggccaagtgagacagcctgtcttgcctccgtttcttttgagttcattcggttctttctccttactgtcctgaaccggactaggtcctgctccacttacccttatcatttttagactctgttaacactcctgcctcctccttggtgatcatgacatcctgcccatggcctacagatacccccagcagttgtatcatgaggaatgcggccatgagctttcattcttgccccacacaactccttcctgcccctccttcctggtcatcttctcaccactgcctcttcctggcctgggtagaaatggcatcctttacactcgggtggaattgcttgaccagactaattagtcagcctggaataggatcagctgaagtgaggtgacaaagatccagcccacgaggggcccaggcagctgctgagcctggctttgtcctggatgaaaacagaaggtgaacaggggttctgagggaactgggtcacttgtgtaggtgagacatagagatatatttgtgtgtgttgtgtggtgcatataagagctctgaaaatagtcatcattaatgtatcacctgctgtgatctttccacactgcctacacatgacctcacatgtgtagggttttttgttttgttttgttgttttgagggtgaatgtatttttaaagccttttcactttaggaggcttccttaaacagagaattagggagactactgtgagccatctttcctggtgggaagatgaggataaacaacagctgaccacagctggacccaggtgctttgtttccttccataatctctgtcagtccctccctaaagccaccacaaggaaatgtgcagtttaaaatgatgagccccccagctgggcaccatagtaagacccccgtctctacaaaaaaaagtcttgctctgtcgcccagcctggagtgcagtggcgtaatctcggctcactgcaacctctgcctcccaggttcaagcgattctccttcgtcagcttcccgagtagctgggattacaggcacctgccaccatgcctagctaatttttgtattttatgttatgttatgttattattttatttttgagacggagtctcgatctgtcaccaaggctggagtgcagtggtgcgatctcggctcactgcaagctccgcctcccggattgatgctattctcctgcttcagcctcccgagtagctgggactacaggcgcccgccacaatgcccagctaattttttatattttttagtagagacggggtttcaccatgttagccagaatggtctccatctcctgacctcatgatccgcccgcctcggcctcccaaagtgctgggattacaggcatgagccaccgcacctgggctaatttttgtacttttagtagagacggggttttgctatattgggcaggctggtctcgaactcctgacctcaggtgatccacccaccttggcctcccaaagtgctgggattatagcaagagctactgcgcccagtcccaaaaaaaatatcttttaaaataaggccaggtacagtggccctgggaggcccaggcaggaggattgcttcgaaaccagcctgggtttcaaagcaattttaaattagacatgtgcctggcagcattaggtggcatgtgcctgtggttccagcttctcaggaggctgagaggggaggattccttgagcctgggtagttgagactgcaatgagccgtgatggcaccaccacacttcagcctgggtgacagagagagacactgaaaaaaaagggaggaggacctgctgtgcagacagaacagcattacaccccccaccactccccacacacacacacacacccacacccacacacacacacacagaaataacgcagttaccacagggatgagaggctccaaacaggatcctagttagtgctccaaaaatgcccccgacagacagacagacataccccttgatgagagccaggaggacaccagcggaggggagggaggggagtgatgagccagtgccaatgtagtggcttcttctgtggctggtcccagttaagattttgtgtccgttttggttccatttcacccttgcaaggggctgtgcatgtgtagtgggcactgagacctgctgacagcatgttttggtacctggagtgtgcctgcaggctctcatagagcggcaggcagcctgtgtaagcacaagcagagcaaggtgtgtgatgccgtgattgctcctaggaccacagagagccagcgtggcttctgcagtccccgaggaggggacacttgggccagcccatgaaggaggcgccgcacatggttccctgaggctggagcatagagtggaggcagggtggtgtgggggaatcgtttggaagcagattgtagactcctccacatagccacctaaggagggagagctgtagcctagaggtggtggactttattaaagtgagtgaggctcagttaagctttttaaaactttttactgggctgggcacagcggctcatgcctgtaatcccagcactgtgggaagccaaggcaggcagatcacctgaggtcgggagttcaagaccagcctgaccaacatggagaaaccccgtctctattaaaagtacaaaattagccaggcctagtggtgcatgcctataatcccagctactctggaggctgaagcaagagaatcgcttgatcctgggaggcggaggttatggtgagccgagattgtgccattgcactccagcctgggcaacaagagcgaaactccgtctcaaaaaacaaaaaccaaaaaaaaaaaaaacaactttttattgtgggaattttcaaacacagacaagtagaaaaaaacagtaaaatgaacctgatgtaccttttaccctgcctcatttactatctacatgagcagtcttggtttatctgtatatgcctatcccaagtattttgaagccagtcctagatatattatttatttgttaatacttcagcatatagctgggcgcggtggctcacacctgtaatcccagcaatttgggaggctgaggcaggcggatcatgaggtcaggagatcgagaccatcctggctaacacggtgaaaccccatctctactaaaaatacaaaaaatcagctgggcgtggtggcacgtgcctgtagtaccagctactcaggaggctgacgcaggagaatcacttgaacccgggaggcagaggttgcagtgaggcaagatcacgccactgcactccagcctgggtgacagagcgagactccgtctcaacaaaaaaaaaaggaaaaaattgatccatatatttaaaatagtaacactaataagataatacaagctataactcttttaatcttaagctgtttttactctacaagtccccactccattctttttttttttttttttttttttttttttgagacacagtctcgctctgtccctcaggcatgaaactataacacatttaaaatcatatttttgtataaatagctttaacatttcaagttatttctctaggatatattcctaacataggactcttatgtcagaaactacatctgtttcatggtgtgggctacctaggtttttttttttttttttttggagacagagtctcgctctgtcacccagactggagtgcagtggcgcgatctcggctcactgaaacctccgcctcccgaattcaagtgattctcctgtctcagcctcctgagtagctgggactacaggcacccgccgccacgcccggctaattttttgtatttttagcagagatggggtttcaccgtgttagccaggatggtctcgatctcctgaccttgtgatccacccacctcggcctcccaaagtgctaggattacaggtgtgagccagcagctttttttgttttgttttgttttgtttttgagacaaagtctcactctgtggcccaggctggagtgcagtggcgtgattttggctcactgcaacctccgccttctgggctcaatcaattctcctgcctcagcctcctgagtagccaggattacaggcgtgcaccaccatgccctgctaacttttgggttcttgttcttgttgttgttgttgttgttgttgttttaaagacagagtcttggctgggcgtggtggctcacacctgtaatcccagcactttgggaggctgaggcaggtgggtcacaaggtcaggagttctagaccatcctggccaacacagtgaaaccccggctctactaaaaatacaaaaatcagctgggcgtggtggtgcgtgcctataatcccagctacttggaaagctgaggcaggagaatcgcttgaaccaggcagtcggaggttgcagtgagttgaaatcatgccattggactccagcctggcgacaaagtgagatttggtctcaaaaaaaaaaaaaaaaaagacggagtctcgttttgtcacccagggtggagtgcaatggcacgatctcggctcattgcagcctctgcctcctgggttcaagaattctgtctcagcctcccgagtaactgggactacagtgcccaccaccacacccagctaatttttgtattttttgtagagatggggttttaccatattggtcaggctggtcttgaactcctgacctcaggtgatccacccacctcagcctcccaaagtgctgggattacaggcatgagccactgcgcccagcctaacttttgtattttttagtagagacagggtctcactgtgttggccaggctgttctcgaactcctgacctcaaatgatccacccgcgtcagccctcccaaagtgctgggattacaggtgtgagccactgtgcctggctcattcttttttttactggtaatttccttgatgggtaagctcagtggtttgtcctagaatctggattcttctaattacatcctcatggttttaattaacatattctgttgtccctcaattttctttaaatttatttggttttggttttttccccacatgctagcatgacatgtaagtaggtaatgaggtttattctgtgagaaattacattcatgtctcattcttcggttgtctctttttttgtgatgttggcaattcctggacctgtgggttcagtaggcatatgccgtggtaagactaattctagcattacttcttcatttaccagctggaatacatccataatgtgaaactgactgcccctcaactattctttaattgcatactagacaaaaggtcaagagatagaggcttcaaatatggaacactgtctagaaatctgtggccctggccgatgcagtggctcacacttgtaatccaagcactttgggaggccaaggcaagtgggttgcttcagcccagaaattcgagaccagcctgggccacttggcgaaaccccttctctacaaaaaaatgcaaaaattagctgggcatggtggtgtgcgcctgtagtctcagccacttgaggggcttgagcctgggaggttgaggctacagtgagctaaggtcatgcctctgcacttcatcctgggtggcagagtgagaccctgtctcaaaagaaaacaagaaagaaatctgtggctctacatcttggtgagggccctgggcttggagagtgactgttaacttcttgcaggtgctgttgtggttacagctaagatgagcttgtcaccattgcttgaagacccatgttgggttggtttaagcagctaccagatctttggctggtaaaagtacccttccctatgccctctcttatgggggataaggatagggagatgtttggatgaggtcttcatgtctccctcttcttgaattggccatttcttcccctaacaaataacaagataccttgttttaaacccagataaagcacttacagtggtgtcatcagcacatacttaggaggaggtatctgtgctgtatcctaaacttccattttggagatgcctataaatatctgtataatgaactatagattgaggagaaaagaaaaaaatttctatctagggaaaattgcagactttttggaaagatgagacaaagtagaggctgtgtgttttcacagtagtaactactctgtatgtaattatcaaacacgtgaagccattatggtatagttcctggtggtgtcccttcaagagatgatatgagaaagagacggattgaagcgagagctatgtgaggccgtatggaaggcaccttttgagctgggcattgaaggatggggaagaaaacataatgggtttgctgggttaggcatgagccaagttttagaggaaagattgagaatggctctggcaagctggggattgtgggtagttattctgtgccaggccttgggctgtgggtgcaaatacaaaaatactggtggcattatatctgtcctctggaaacatggtgaagactatatttcctgacaccaaagaagggaaaacagggctcaagaaggtagctcaccatttaacagcttgtggtgaaacccaccagaatggtgcaacactgcatggagttgatgtgttggaaagtcaggctctcccacagtacctaccagaggacagcggggccgctcacaggaatgctggaatccccatccagcaacccagagggcatgcatggctatagacttaaagatgcaccaccttttttttttgaggcggagtctctttctgttgcccaggctggagtgcagtggcacgatctcggctcactgcaagctctgcctcccgagttcatgccattctcctgcctcagcctcccgagtactgggactacaggcacctgccaccacgcccggctaattttttttgtatttttagtagagacggggtttcaccatgttagccaggatggtctcgatctcctgacctcgtgatccgcccgccttagcctcccaaagtgctgggattacaggcgtgagccaccgtgcccagccaaggtgcaccacctttaaatgcaaatttttgcatttttagtagagatagagtttcactgtgctggccaggctggtctcaaactcctagccacaggtgatctgcctgcctcagcctcccaaagtgctgggattacaggcatgacccactgcacctggctgggaaaattgttataacatggattaagcaggaatactatgattacacacacacacacacacacacacaacgcgcacacacacacacacacacacacacacaccaccccctcacctctcccaaggggaaaatgcattgaaaaggactagaagtaaatatgttattccaggttctctgggcaaggagttgataggtaaggatttgagatggaataaaggggatatttcatgggagccttggtgctggtgtttggacctggtgaaatgacagaagagctgtctggagcatgcatggacagggtctgcacagaaagacctgtggggtgtggaaatggtggtttggtctggctggaggtggggttagaagtgaaggctggtggccgggcgtggtggctcacacctgtaattccagcactttgggatcctgaggcaggcggatcacctgaggtcaggagttcgagaccagcctgaccaatatggagaaaccctgtctctactaaaaatacaaaattagctgggcgtggtggcgcatgcctgtaatcctagctactccagaggctgaggcagaagaatcacttgaacccgggagatggaggctggggtgagccaagatcgtgccagcctgggcaacaagagtgaaactctgtcttaaaaaaaaaaaaaaaaaaagtgaaggccaggcgtggtggctcacgcctgtaatcccaacactctgggctctggaaatctgaggtgggtggatctcctgaggtcaggagttcgagaccagcctggccaacatggtgaaaccttgtctctactaaaaatacaaaaaattagccagatgtggtggtacacgcctgtaatcccagctactcgggaggctgaggcaggagaattgcttgaccccaggaggcggaggttatagcgagctgagatcgtaccactgtactccagcctgggcaacagagcgagactccatctttaaaaaaaaaaaaggaagtgaagagcagggccagggtgggtcgagggctcttttaagtacttagggagatgaccttgtctttgaccagactgagatagcagcttacagagggagcgagaaaccctgaacatggagaagatttaaaaggtagcatggggttggctctgacagtataccttctctctgaatgagtcttttgtgtccttctcttcaggttcagattcagaacaagaaagtggacatctctaaggtctcctccaagtgtgggtctaaggctaacatcaagcacaagcctggtgagtggtgcctcccttgcccactgggtctccagggtatgtcgtcctgccatgggtcagctgggcagccagctggctggcaagggtttcatctctgtgcctttagcatcccatgaagactacccaggacaccacagtcctcattctgtcagggagcaggagttcgggtgctaacctctaagtggaggaggagcagtttcttacagcagccatctgcacaggcattctcttgagtacctactgtgtgtgtggaactattgagctaggcctggggaagtggtgcactctgagctgagaacctggattggctctaaacgaggattacagaagctactgctgaaggagctgtatagagggcagtgttcaggtcccacctatcagatgcaggagcaaagggtgctcccaaccagtgaagcatcagccgctagccctggcaggagaatgggaggcgttcagcaacttgcactaatgcagtttccttccagcaacatggttggcccagcgcccctgtggaagtcgctgtgcggaggctgggctcttgccttgggtagtcccctagcagcctcgtgtcctagttcctgggtctacagcagatttgtgagtaggactgctgtagcagcaggcacactggctggcagacctggtatcccagaaggctagccaccacaggccagataaggtgaaggcaaaactctcttccctcagggcgggcgcggtgtctcatgcctgtaatcccagcactttgggaggccaaagcgggcggatcacttgaggtcaggagtttgagaacagcctggccaacatggtgaaaccctgtctctactaaaaatacaaaaactagctaggtgtggtggtgcatgcctttggagaattgcttgaacccaggaggcagagactacagtgaggcgagagtatggcactgcactccagcctgagcaacagagcgaaattctgtctccaaaaagaaaaaaaaaaaactccctttccctctcagcgaagagcatgatccagtttagaatgtgttctatttagaaagatcaaaacagttctgtccttaactaaccatttttttccccttttatctgggaaatctcctatcagatacttccttctctaatgacactgagtcacttagggtctagtttttgccagggctgggtttcccaatatgggacaccgggagacctcggccagaagctgtgcgtggaggtctgccatgtgagctgagaggagatggaagaacaggagaaggggcccaagggaaaccacgctgctgggcgcgggaggggctgggtactcattgagggcagctcgtcccgcacccttccccttggtctcatgggcacactctggccagtgagctctgaaccctgggcgtgagttcagaccactttccctccccgtcctagcctgaggtcactagatcccaggcctgccttggtccatgtctttccttcctcagcgcacagcctcggggccactctgtcctttttattattccttctttttgctagagtgtggtacggtttagggtctcagacaattttcacaacctgtcactgtcaatcagcagattggtggtaactctgggtgagtcccttctcttttgcagcatcagttttaccggctgggaagcagggaccgtggccgtgatgacagggcattcatgagaattcagtgaggctgtgcctgagaagcactgcatggcccagttagcgggagggcattcccacacagagtagagaagcagaggcttcgccctggaggctgtgctcggagccccaggcctgcccaagcctggcctgcagctcagtggctgtggcatggggtggtggaagggatggctttccttttcttggaggtattcccactggctggacggagagattgtctcagcctcactgtgatatgagaagtcctctttagacaaacgtgttcactgttcttcatttgccacccagaacaggtcacgtctgtctcatttctagattgggcatatcgctagtcctggttttgcctgcagggatattcctctgccaccctaggtgaccagttcctttgtggttccaggtggaggagatgtcaagattgaaagtcagaagttgaacttcaaggagaaggcccaggccaaggtgggatccctcgataatgtgggccacctacctgcaggaggtgctgtgaaggtagcgagtgggtcactggggagacacagctggggaggggtgggaactatgcagttagggtcagggtcctcacaggtaggcacctgtcaccgcccctcagtctcttcaggagtcatgtcttcacccacaccattgccgttttcccaccgtgtatcatcagtcctgactgaggcagaagtgaagaggccccagcccagccacccctcacctgtcagctggaggcagaaccttgctcctgagagccatggccttcctaattgagcccatccagccatttgagaaggccacggactgggacacagaccacccccaggcgagcgggggttctgcaccacacagttctccccagctgtctcgcgccaaggggaatgtgggttcccgccccatgtcaggctccgctcctgggttaggagcaggacagcacattcttagctgccagcgacagcaggctgcctggggcctccctctgcagggcctgcctggggcctccctctgcagggcctgcctggggcctccctctgcagggctctgggacagagctcaagtggcagaggttcccatcctcacgactggctgggcctcttctcccttccctctctcctctttcctcccttcctccttccacagtactgtgagaccttttgtgtgccaagatgctgtctgtcctatgttccatgtcatccgtgggtggggggcccatgaggggcatcttgcagaccccgagcacaaggatggctgctgctgctcgggttcaggtgcgcaggggagaggggccaggagccgctgccctgggccttcccttccatctctgctccccagtgccagccactgcccagcccgtcccctgtcccatcctctcctgatgctctgactgaagccttgatcagcttccaggaacatctgggggggtccttgctgccacaggctctcagttcgtgccccccatacctcgtgaggatgccgttctcacgcccgtctcagtggggcgttaacttggctttagtctcttttccaaggacacagcgagcgagcgtggaccaggattcacatctgggcttttctgaccctaagccttgtgttcttttccttgttcacattatatccctttattagttctggaattattgtttttaatcgaggcctatttctcactatgccgattagaaaccacttctcccttgtcactttttgggtatttggcgacacacgctttccagctccccagtggcctctcgcagctgttctctcttctctgccttcctcacactgagtgttccatgtcccccaaatgtcctcctcctatgacgccctccaggcctccacagtgtccctgggttatacctccttggacacctttctgcctcccatggacccctggtcccagaatggtgccccgcacagacaaggcctcagcacctgtgttcctgaccagacagatgtgcaggcagggctgcccgggagctactgaggaccccactctgtgtgcagggggtggcctgggttcagggagggtttgggagggtgggctgtacccttcagggggctacccttcaggcttattgcttactgttgtcatggctacgtctttggtaccagcctgaggcctggcacctctgccctcagagaggcttcatcagagcctcacatgccacagaggggctctgagagtgtgtcactggtccagctgctcctgaccctcgggagtcggtctcccaggtgaggtggggtgggtggggccggggcacctgcctgggattctccaagcgactgtgccttgagccagtgggtgccagggcagcaagggtgggggctgtgtgtgaaacccaccaccatcaccccatcccactccccccctcgactgaccctgcactgtctcccccactgtttcattgtagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagtaagtggctgggctcggcctaagggccagccaggggccctgccactggccgcaaattgaaactcctttgtttttgactagagtgtggcctaaattttaatgaagtaaccttttattttccaggcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatggaattccttcaggccggcacccacaccctaggacatgtaagccctcatgtccaagggagcctcatgcagatagtaggaaatcaggtctggaaatttaaaaataaaaggcatgagactaaggctatctgcttcccttatgccctgactggagaggggagggaggagaggcaaggcccacagagggcatcccagctaggccttgggatggctgcagtgaggagaaatcccgggaactgtattgacacaaagattcttattgcacttgtattttttgtattaaagtttgcatggtttctaataaaggattcaaacataagtttgtagtgaaatggcctgggagattccaagggcttctctggagggggattggctgcagtgtagatttgcctctgaggaggctgccccagacttggcctcctcatgccccctcctgacctctgcccttctctggtcctggcatccctggagaaggtaggggtcttgacctaagtttagatttgatctccatgtgcagggaggctgtcctgggcctgacaggtcctccccctttctgaggtagcagtgccttgtggaggtttgacaccatgtccctagctccccaagcacacaccaggaaactgcaggggctcacggaggaagtgctgcctgggccagggggaccagctttcctccgtagagaccatgtgcagaacacttctgctgtgccaagaacatgagggagccagtgttttgtcagcaggaagaaagggcctgctgggatgaaagtgggaaggaaacagggttgcgtagtcaggagacacctcaggggcaacagcacaggcccagagtacctgctgcctccactgcgtctgtcctggggtcatgaggatgctgaggttgacgacaggttccaggtcctttcactcctttggccaaaggttgggggtaggtggcccaagtggcgtgctctctaggtagacaacaggagtggtcagagttccctcaaaggatcctccactccagagcacctgagaaggccgggaccagaggccctgtgtgatgtgtactccgcagctgtttggggtgggacatttctgtacttctcgatttgcttatggctcagccattacctgtgtcagtccatgattctgttgtaacagttttaagagtaaataaataaagctgcctgatgtcccatc

SEQ ID NO: 35687 - DNA, 238579 bp, Homo sapiens; identical to SEQ ID NO: 35686

SEQ ID NO: 35688 - DNA, 19948 bp, Homo sapiens
gtactatcctccttacttttgggtcgggccctccgggaagatggcggccgtgcaggcggccgaggtgaaagtggatggcagcgagccgaaactgagcaagaagtgagtgtcgctgcgagtctttaaagcctttgcggtaggagagtctgggctgggaagcgccgcgaggttcccaccaaggctgctgtgccggggccttcttgccggctctcgtgggtacgcacatgctgagacgtggtggctgcgccctgcagaccacgtaccccgggataccccgggcacgccggctccccgttcccagctggcaccggcgggatgctccctatcatactcctagagttaagagactgtggaggaggaactaggacgagaactaagagttatcagaaaagaaaagcgaaacttcctgcttagcttcatcctcctttctgagaaatgcattcttttgttgagccactcagtaaacgtggaagttggagaaatgttaaataccctagcttttcagaaagaccttcaaaattttctgggcctcactaaggtcattctgaacgttatgtattaaaagggatcagttctaaaactgtcatgcatctacccgtatgggttattcagtagatacctgtgagtattaagtgatcaacgtctaacagtagagaccatcttaattcagcctgatatctttgttaaccactcccaaatccctggagtatgtaggttaacatagataagtcaggattagccaccctttaactggctgtcttatattctcattagcgttccccatttgaaccacagaacacaggtaattgagtgttttatcattgctaggaagatggtacatagtaccattccagaggcatacgagagggcttaatccccgtggcgcgcacttgttatcccagctactcgggagactgaggcaggagaatcgctttaacccaggaggcggaggttgcagtgtgctgaagtcgtgccactgcactccagcctgggagacttgaggtagtggtccttcagggactgccagaagtgctgcgtgagcgagcccttctccatcgctttccccaaggagttactgagacggagccagaccctgaatgaaaaagaaaagagaaatgatgtttctttttttttttttttaagatggagtctcgctctgtcgccaggctggagtgcagtggcgcgatctcagctcactgcaaccttcgctgccagggttcaagcgattctcctgcctcagcctcccgagtagctgggattacaggcgtgtgccaccatggctggccaatttttgtatttttagtagagacagggtttcaccatgttgggcaggatggtctcaatctcgttaccttgtgatccgcccaccttggcctcccaaagtgctgggatgacaggcgtgagcctgagccaccacccctggcctgatgtttccttttgtgtccctggctttgtgcttcaaatatcttagaaaaagtataagagaaattgtcgaagtttatagttgggtaggaccttaatatattgtcctttattagagcaatccgatggacttccataaaagtttggaacctggtctttggactgctaccttagagaaaattgacttgactttattaagtcaaatttaattgaatgtggtatatctgtgatatacgatcctaaagtttagttcattctttcaaaccacctatgataatcaattacattgaattgaactttaggactgtatatcacaggtgaaagcacggtttccagttcagagtgtgtttttaggtaaacggaaaaaactggttaattcctctttactgactttttttttttttttttttttttggaggcagagtcgttgttgccccggctggattgcagcggtgcgatttcagcccacggcaacttgcaactcccgggttcaagcaattctggtgcttcagcctcccaagtacctgggactacaggtgcatgccacaacacccggttaaatttttgtgttttagtagagacgggatttgaccttgttgcccaggctggcgtcaaactgctgagctcaggtgatccgtccgcctcaaccccacaaagcgctaggattataggcgtgagccaccactccctgcttcactgacttttctaaaattaaatacagctactacttttttgaccagcttttctgtgccaggcacaatgctagatctctacaagctttctgtctagtgtcagtaataaccttgcaagaggagttattgtccatttttcaaattaataaactgaggtcctagtaattaaatgcactattaaagtgtgcattcctaaaatatagtctagcagtgatccagagcactggagcacggatctgaactcaggcctgtgactccacagtccatgctctgtatcctgactgcacagcactactcacgttgtcttacctgtcattgatgtctattcctctcgttaccatgagctaaaataatttttttctgattaacatttccttccgtttattgttctggggaattccttggtctgaaatttttagtaagcaccattttgtgccaggtattgactccaagtttaaaagcagatgtgctccctgcccgagtgaaatagcctcctcaaatttatttgaacacggtaaagaaggtgatctctgtaattctgttgccttccagtgttgataatgtataaacataacgcagtctaaggaccttcctgaaattctcctttccccttgttcctagagttccaaacaagtcttctctttgacacgtatttttgtgtggcttgcatttatctttgtctagagtttgcaattgatagtgacagtttcctcttattttatatgcttcctattgccatcttgtggccaggtatttcctctccaggtgagaaaccacacttcagggcttcagaaagtgcctcacatcctgttcccatattctaggatgttgtgagcaattttacctgtaagctatccattaacttgctgttggctttaccccagatatgcatgttttttccatagtcaggactaagaacattgtcagttacagttgtagcacagagagtgttacagggttgctatcagttaagacagtcttaagttaaatgggactaaaaggtagtagaagcatggtccccctccccaacccataagagagttggttgggtatatgtatactgtctgtcccatctgacaccacatctctgtgtttcccgctaggtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaaggttggtgcccattaccttctttattgctctggaagcaaaaattatttccttacttggttcattttccgttaagcctctggctaagtctttggacttgttgctaaggaaacaaggagccctaataccaaaaccaatagtcctttctcattttctctttaataaattcaaatcgtctctccttagagtcttgagatgacatgtggatcttattctagaagagtgctaagaacaaaacctttgtttgaacaaataatttctaatgccagctatttcccttttctgtctttctggagttttgtgtgctcttgagattaatttggtttctagtcttagtgctatccctaggacctttttggattatccttaagattgatttgatttaagaggagcacctggttgagtggaaaacagatttatcttaattctagaagaactagacagcctaatcttagcagtccactgactgaattatagcatgataacaccagcacagtgttttggaaaggttgtctttacaaatgttataagacattatatgtagaaaaagctgtcaactttgaaaccattcagaatctgtttttcttttttacaagatgaaagattcggccaggcgtggtggctcacgcctgtaatcccagcactttgggaggccaagacaggcagatcacgaggtcaggagatcaagaccatcctggctaacacggtgaaaccccatcttcactaaaaataccaaaaaaattagccgggcatggtggcgggcacctgtagtcccagctactccggaggctgaggcaggaaaatggtgtgaacccgggaggcagagcttacagtgatctgagatcgcaccactgcactccagcctgggcaacacagcgagactctgtctcaaaaaaaaaaaaaaaaggtgaaagattcaaaacctcaattcattttttaaagttattctaaattcatatcgaaaatgaaggatgtgtcctgaagccagaatgtttgcgggcatgacttgggatcttctgctgtggttcactattgcagaatatttgattatgttcagcggtttgaaagaatgatccataaattgtctttgaatagtaaagatatccctccctacaccaatctgtttagtttctggtttcagatagcaaattcagactataagagacatgaacatatcatacagaacagctcagagttgtccgcattactttggtttttcaggttcaagtgataagtatcaagagtttggataccaagtgatttaaccagaaatgtatttaaatctatatgaggcacagagagtaaagggttaagatactaaaagatacctagaaagctcacatttggttagctgaatgccagggtcagggtaatccctttatacaaacattatctcattacacaccataacaactggtgggggttgtctattattattttcgtttcacaggtgagaagttaattcactcgtccaagtcacataattgacaagtgtgttggaatttagtcccaggcagcctgactacaaagatggtatattaccccctgtactatactgctttgcacaccgttctattttgttgtctaagtcaggctccagtgggcaaagtgagactaatgctgacagccattcttggagagactgttggtaggggaggtctccttgagtgctaaagagccggctcttccttactatcatcctaactcactcttaggggagggatagagagagggggtagcagagggctggagatgttgccttatcatgtattagatctggcattggaggggtcaggtggctcacacctgtaatcctagcactttgggaggccaaggtgggcagatcacttgaggaaaggagtttgagaccagtctggccaacgtggtgaaacctcgtctcactaaaaatacataaattagttgactgtggtggtacacacctgtaatcccagctactcaggaggctgaggcacgagaatctcttgaaacccgggaggcagagattgcagtaagctgagattgtgactgcactccagcctgggccacagagcaaaactctgtctcataaaaaaaaaaaaaaaaaaaaaaaaaaaaaaaaaagacctggcactgttggaacttcaccttctagggggatactaaacaactaagattcagtcactgtcctcaaggagctccctaacctaattagctcaagaaaagcctattctaattttctagaaaaccttttctcctattcaaaactaatgcataggattttctttgtcttggtacatcttggttttagttgggacctaatgccaaggacctgagactggcaagcagagactgagagtgatttttcacatctttgttctaagcttatttttccctttgtgtctttcacataaagagtttagtgacaagctacttgagctgagctgtgggtgtggaattgaggggtatagaactgagcaagagcgtttctcctgggcgattcatgtttttgataagttgctaggggcagaacatagaggactcttcaggcagctaacacattgaacgctttcatctttccaacagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtgagttccctgggccaccagcatggttgggcacaggaaagcttctgatgaggcttctggcagattctttgggactggacagtaggagggaccagtacgcctgaggtcactgccagggataagggagggtctcccactgcatctggttaaaggcacagaccctgagtgttttttatgtcaacccccaaaaggcatttgagagagtccagcattcaagtgaattaaccttccttggaattagcttgaccttgaggccccagggaaagtgtctctctaaagattgcctgaggtttactttagaccaggggctggccaactacagtccaccagccaaacccactctccatgcccccactttatccttccctccctggttttttgtttttgtttttgtttttttgaggcaaagtctcattctgtcacccaggctggagtgcagtggtgtgatctcactgcaacctccgcctccccggttcaagtgattctccttcctcagcctcccaagtaactggtattagaggcgcacaccactacaccctgttaatgttggccaggctggtcttgaactcctggcctcaagtgatccacccgcctcgggctcccagagtactaggattacaggcatgagccaccacaccttgcccctccttggttttactagtaaaattgtattggaacacagctgtgctcatttgtttacgtatttctgaggctgctttccccctgaaacagcagagttgagaagttgcatcagaaaagctttgtgagaaaggctgctgtagagtattccttgtttacattctccaggccccatgccttggggaaaagtctgatgtgtcgccagaggtaggagagtagttaagaacataagcagttaagaacgtaagtgactcgactcaccatgcaaatgtggtctacaaaagtgacaacaaggccacctgtaccaattaaaaattaaacttttatgattttaggcagaactcaggtttttctttttgttgactcttgcattttgaaatgctggcctctggccgccctgcatattttaagtgcaaatctcactccatattcaatcctgtaatgcagaggtcttggttaaagaaaacaatgtattggggtcactcgggggcagaatactgccctctgctaggtgggccccactggtctgaccaggttcaacttctgaagggcttttttttttttttttttaacagcaatactacaaaatccgcagtcaagcaattcatcagctgaaggtcaatggggaagacccatacccacacaagttccatgtagacatctcactcactgacttcatccaaaaatatagtcacctgcagcctggggatcacctgactgacatcaccttaaaggtggcaggtaggaactctccctggcaaatcactgaactcccacagcaggtaggcctgcggcttcagtagcacaagggaaggtctgggttggtcttgttctcaagtagcctgtgtctgaagctactttactaaggacagtgccattatatctatacagaaagaagcagagcagccctgagacatggaatcatattccagatgaggtagtgctacaaagagaggggctttctctataaggattcccttcatcagcaagaatcagcggtagaagtctcaggcttctaagaattccagtctttggcctaagaatgctttgcactgagacagtatttctagaacattgctcttttggagttgtagtatcttgggtgagatcttcttttcctaaatttaaaaaacaaaaaaaaaaaatcacatcttttccttgccctctcccaccaaatagtaaaactatcagttgtagaaaatttagaatagtcaaagaagcacagagagaaggttttgattacgcataatcctaccacccagagagaatttctggcaggacctaaatgcccaaaagatttcttctttaaagtgcagtgattttactaaaatctttttttttttttttttttttgagatatagtctcactctgtctcccaggctggaatgcagtggtgccatctcagcttactgcaacctctgccccccaggttcaagcaattctcttgcctcagcctcccgagtacctgggattacaggcacctgccaccacgcccggctaagttttgtatttttagtagagatggggcttcgccatattgaccaggctggtctcgaactcctgacctcaggtgatccacctgcctcggcttcccaaagtgctgggattacaggcgtgagccgccacaccctgccactaaaatatttattgatgttagttattctagttcagtattctcagatacacagtgtgctctgagatcttttcacatctgtgtattcagatttttttttatttttttatttttatttttttgaggcgaagtcttgctcttgtcccccaggctgtagtgcaatggcgcaatctcggctcactgcaacctccgccttccgggttcaagcgattctcctgcctcagcctccccagtagctgggattacaggcgcctgccaccacgcccagctaatttttgtatctttagtagagacggagtttcaccatgttggccaggctggtcttgaactcctgacctcaggtgatccacctgccacggccttccaaagtgctgggattacaggcatgagccgctgctcccagcagatcttttttattttaattgtttgtttttattctgtttcttgctttacatttcctttgggacttttatctgcatactggatcatcttgattcttttcgataattgtcactttatctcaaatcctttttatctttctttatactttgatttttaaattttatcctccttttcactttctgtttctcttaaggcattatttgttgtatttagtcactattatttccttatagcttagtctgcattttctgaaagattttttactttatttctaattctttcatgtgttatcacctcatttcttagtttttctagttctaatttgtgttctttcatgttttgcgtctttttcttcatgtctttcagctcatttttgaatagtaagttagaattttttgcttttcacggcacgtactcactcataagtgagagttgaacaataagaacacatggacacagggaggggaacatcacacactggggcctgtcaaggggcggggggaccggggagggacagggttaggacaaatacctaatgcatgcagagcttaaaacctagatgacaggttgataggtacagcaaaccaccatggcacatgtatacctatatgacaaatctgcgtgttctgcacatgtgtcccagaacttaaagtaaaataaaaaaaaaaaaaggaactttttgtttttctaagcatgtctgtcttgagtgcttttattttgtctagaggggtgttattctccttctatctctccatttttagttttttaagtaactttatatggtatgtgagcccagtgcttttatgttgcttacatttacatgaaatcagttttcctgaatgttcaaaggaagcacggtttcgtttttccagtgagctccctcttgtttttgtggcatgttcagaaatactgcagcttgttttttgagatttcctggttctcttcttcttcctcactttttttgggtcttctttttttttttttttttggtctcttttttccttgtcctgttagtttttacggtcttgtcctagaagggagcctggctgttgagagggtttctgtgggctctactcctcattccctttagattttttttttttttttttgagactgagttttgctcttattgcccaggctggagtgcaatgccgtgatctcagctcactgcaacctccgcctcccaggttcaagcgattctcctgcctcagcctcccaagtagctgggattacaggcatgcgccaccacgcctggctaattctgtatttttttttagtagagacagggtttctccatgttggtcaggctggtcttgaactcccagccttacgtgatctgcctgcctcggcctcccaaagtcctgggattacaagcgtgagccacagcacctggcctcctttagatcttcttaatgcaaccctcacctgtatggaaacggacacatcccctccctgtttcagctgctctcccccagtgagcctggaggaaaaggttcacattttccagaggatacctttggccatttgggggctttccagttctcagatccctcccataccccatttctccccactgctttttccccgtatagaggtcttatggctcttggtggtttgcctccttgcttatatttgggggtccttggcaacgtcttcccacagcattttgttgtaaattttgtccatggatttttcgcttcgcctctctagctgtgctttctatttttatgtgaggattcagggaaatccaaaaactatgctgctaccagcaccaccatcttctaggcatccagtgacttaatcttgaaagctagatcctgaaagcatgtctttaactggtttgaatggacattgttggtttgagggaaaagatggggattaaacctcaagctaaaatcagattgtactgctttgcattgtgccctgaccaaaaaaaaaaaaaaaatgcaggccgggtgtgggggctcacacctgtaatcccagcactttgggaggctgaggtgggtggatcacttcagcccaggagttcaagaccagcctgggcaacatggtgaaaccccctctctactttaaaaaaaaaaagaaaaattagccgagtgtggtggtgtgcacctgtaatcccagctactcaggaggctgaaacaggagagtcacttgaacctgggaggcggaggttgcattgagctgagatcgtgccactgcactccagcctgggcaacagagcaagactctgtcccaaaaaaaacaaaaaaaaaaatgcagagggagtttttttttgacactgataccataaaatgacttctggttctgtcagtcagtatttttgctcttctttttctaggtaggatccatgccaaaagagcttctgggggaaagctcatcttctatgatcttcgaggagagggggtgaagttgcaagtcatggccaattccaggtatctcgaaatacccagttatagacctttcttggttggcctagagcaacacagcaataggctgatgtggtcttactggtatttgaagttagagtaagaaggagtgggacatggttggggaaggctgagaagaggataatgtggccacctggtcacctgtaaagtaatgactactctcaagttatatgacagtaaagtaaaggatagtccttttttaatagtggcccctgaatctgacgtccttcttgggctcacattaactaggtattaacagttgagtgagggttccagaggagaccagtggtcagtgttcatttgaattgttgttactgaattacatttctttttcactcagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggtaagcgttcttggcctcctagctgtggcctcctagctttctgtttgttttatcatacctttggatcagacataccagtgatttctaactgctgcttttggtttaggaaacaaggtatcgccagagatacttggacttgatcctgaatgactttgtgaggcagaaatttatcatccgctctaagatcatcacatatataagaagtttcttagatgagctgggattcctagaggtaaggagagttccttgcctgacgtgatgagctgccttgcaatgcttgcctcctcctctcccttgccttccttttccaaagcgtatcctgtgtcaggatccttcatgcctaatgagaatgtccccttttcttgccatcgtctctgttctaccttgtcctgattaggaaggcaggacctgacttccaagataatggacaaggtatagggccatccacatgctaatgatgtcacattcaatatgtattcacgtcattttgcttttttgtagcattaagaaatattttttgattatatgagaaaggcaaacacacgtaccataaaacaaattcaaacaataaattaaatagaagcaaaactgaaagtgctctttcactccttctgactaacttccctacccaaacttgagtttgatatgtatccttccacaccatttactgggcatatatacgtatgtacatatgcatgttgcagatggagtgcacatatgtaaacattttggaggagttttatttttggtttaaatatgaatgaagtcacactatgtgtattgtgatggacctgcttttatttcacttaagatattctggatctctttgtatgagatagatagatactctttcttaatgctgcattatttgttccaacaagcatctttatacacatgttcaaatgtttctgtaggatggatttctagaagtagaataagtcaaacaatataagcagttaaaattttttttaaacaatcagttgagataactcactaccttcagaccagcctaaatttttaataaatactgggaattgggccgggcgcagtggctcacacctgtaatcccagcactttgggaggccgaggtgagcagatcacaaggtcaggagatcgagaccatcctggctaacacagtgaaaccctgtctctactaaaaacacaaaaaattagccaggcgtggtggcaggcacctgtagtcccagctactttggagtctgagtcaggagaatggtgtgaacccaggaggcggagcttgccatgagccgagatcgcgctgctgcactccagcctgggcaacagagcaagactccgtcttaaaaaaaattaaataaatactgcaaattgaactcaagaaaggctatatccatttagattctaatttacagcttgtgaaagttcgtggtactatattaatgatattaggtattaatagaaattgagacactgtcgtagaaaatcatagtgtccttttttgtcaagcacttgcacattactgttgaacttattaacatttagtttggggtataacaggcttagactatattacatgcaaagcatggtctgtccccaaggcctctggttatctaaggactgatgtttctccctgccttttttagattgaaactcccatgatgaacatcatcccagggggagccgtggccaagcctttcatcacttatcacaacgagctggacatgaacttatatatgagaattgctccagaactctatcataaggtagtcagtaatagtacacccttttcccttaaagaagcagaaagctggaataccactggctagatgggtatagtcagaaataagaggaacagagagagtaaagcagccaagaaagtgttctgatgggtcaggtgtgtggatgtgagtaacacttccagaatttctctacaagattaatagagcattgtagggcagagaccaaaggggttgtctttcccatgtatacaggcactccttacctactttggttcccctaaaacttttaagataaagtcttacgtggattagatctgatttaagtctttcacagaagaaagagcctaatctgtctgtggaagttggaaataagcatcttcaggcctggcgcgggcctcacacctgtaatcccagcgctttgggaggccaaggcggatggatcacttgaggtcaagagtttgaaaccaacctggccaacatggtgaaacccagtgtctacaaaaatacaaaaattagctgggcgtggtggcatgtgcctgtaatcccagctacttgggagactgaggcaggaggattgcttgaacccgggaggcggaggttgcagtgagccgagatcctgcaactgcactccagcctgggtgacagaatgagacttcgtctcaaaaaaaaaaaaaaaaaaaagtatcttcaaatcactataaagatgtcttgtcaaattcccaggtaaatattgaagattattattcaggattcttagttgcagacaacagaaactgttataactagtttaagcaaaataaaaatttattcagctctataggtgaggtattgctcctcacaagagggcattagctgcgggggtctgcctgcagaccctgacctaaacgatggatgaataaaacgtacactgaaacacagatactctgttttgccagtcctgctgagtgtccgatcacctgcacaccaagagaggtgtatttgtcattgcggccgaccctgagcagctctcactccaggcatttatttagtatagaattaacaacagaagctttgagtaaacacacttgtggataattaacatcgtaagagaggagttctaggaattattaaagtccaggtaccatggtctaaagtaaataccattagggagcagtatctttggtcaacctccccccaagagggccatctggctgaaaggttagttaatggaggtagggtaaacagacttaactggggaagcctctattttccgtagtatttaccctatgacctaatgctgtacggtaagaactggctgccttcagcctgttcagttattacaagctacgtaacctttcggccttccaaaaggtttgtgactattccttataactttccccaatatttccctttaatatttctgccaccatcctgagtgaatcccaacatagaggaagctcacagtccccaggaggatcagagaatcaggcttggaaactatacaactaggaatgattctgagtcatattagaatgggctgttctcatggagaacccagtgtattttcctagtaggcacagttactacagctcataatcctggcactaggcacaagtcattgccgctaggacctctgcaatctaaaagctacgtgtgactggcccccttcaccagaatgaattctatgcaatacccacatcttttgttagtagtttccatgctgaagtctcacaagtgtatctgactggtggagcttgggtcacacgcctgcagcctaaccccaagagaggctgcttccttggggaggttcagactcaatgatgggggatgcccaagacaggaagagtatcgagaagtcctaggcagccaaaaaaggggtaactatccacactacaagggtataaagagagcagggtgcttggcaatttgaccagagacctgagagtatacctaacctgtgaaaaccaagttacggcttttggagactgaaacttcccagagctgttaatacaagattagctgtcatggggccgggcgcggtggctcatgcctgtaatcccagcactttgggaggcggaggcaggcagatcacctgaggtcgggagttcgagaccagcctgaccaatacagagaaaccctgtctctactaaaaatacaaaaaaattagccaggcgtggtggcacatgcctgtaatcccagctactagggaggctggggcaggagaattgcttgaacctaggaggcggaggttgcggtgagctgagatcttgccattgcactccagcctaggcaacaagagcaaaactccatctcaaaaaaaaaaagattagctgtcatgaccgtggccatgtgttgttgttagatgcttgtggttggtggcatcgaccgggtttatgaaattggacgccagttccggaatgaggggattgatttgacgcacaatcctgagttcaccacctgtgagttctacatggcctatgcagactatcacgatctcatggaaatcacggagaagatggtttcaggtgactcctgctctctctcatactcatcgggtggttggtatgctgctttcagaggagggctgcctggatttcattcccgctaaataacaggtttctctcccagggatggtgaagcatattacaggcagttacaaggtcacctaccacccagatggcccagagggccaagcctacgatgttgacttcaccccacccttccggcgaatcaacatggtagaagagcttgagaaagccctggggatgaagctgccagaaacgaacctctttgaaactgaaggtaaagtgacaacactcactcctccgttgtaaggccctccttcctgttcagctctgaatttgattgggtcagagctagaatttcccacactattctctttatgtacatttttacttggctagtgtgatgtctcctgccctaacttttgcatttgtgtcccagaaactcgcaaaattcttgatgatatctgtgtggcaaaagctgttgaatgccctccacctcggaccacagccaggctccttgacaaggtgagaaggccctgccttcttgtacatgtcctcatctggtgctgaatggttccctcttccctgggaaaatgaaccccactggggagagttcatttctgcagcttcacaggaaaaccctagagagagaacaagagaattaacagacttttaactgtcatactaagctctgtgccaaataatttatgtgtgtgatctcagttaatcccgtccagcttttaaaaagctatagggtagggtgggcatggtggctcacacctgtaatcccagcacttcaggaggccgaggcagatgaatcacctgaggtcaggagttcgaaaccagcctggccaacatggtgaaaccctgtctctacaaaaaatccaaaaatgagctgggtatggtggcgggcacctgtaatccccgctattcaggaggctgaggcacgagaatcactggaaccaggatgcggaggttgcagcaagccgagatcatgccactgcactccagcctgggcgacagagcgagactccatctcaataataataataataataataataaataaataaaaagctataggataaacccatctggatgggagctgagatcttctgtctgggctgggacgatcaaatactattcagaaatggtgactgactctgctttgctttctcattaagcttgttggggagttcctggaagtgacttgcatcaatcctacattcatctgtgatcacccacagataatgagccctttggctaaatggtaagattccagttacctattgctgcataacagccccaaaacttagtggtgttaacaatttattgtcaagattttgtggtttgactggtggtctttctgctgggtggtgttgaccagggtaacccaagtggctttttttcaactggggattctgccagggcactttggttctcctccacgtggtcactccacatacgatcttatcctccagggcctcttcatgtggcctgtctggcagcacagcctgggcttcccttcagcatggtggttgggctctaaggggaagcttccaaaagaacagacctcattgtgcaaacacgtatcaagcctctggtgataacccattggccaaaccaagacatgttgccagcgcagagtccaggtgaaggagactacacatgggcatgaatgcaagaggtgtggtccattttaacagtctgcccgctggcctgttaggaagatcattaaaccttcctggtctctctcaccctcctcaccgttgtaccaaatgatttgttgctgagactgcatgcaggcttctgactgcaatcagtaacacttttgagtccactagaattcaattattgtattagatgtttgatcgttagaccaacctggccaatatggcgaaaccctgtctctactaaaaatacaaaaattagccaggcatagtggcatgggcctgtgatcccggctactcaaggctgaggcaggagaagtgcttgaacccaggagacagaggttgcagtgagccgagatcacaccactgcactccagcctgcgtgacagagcgagactccgtctcaaaaaaaaagaaaaaacaaaatttagctcattaggggcctctatattcagcctcctctttggtctcctgtccctaggcaccgctctaaagagggtctgactgagcgctttgagctgtttgtcatgaagaaagagatatgcaatgcgtatactgagctgaatgatcccatgcggcagcggcagctttttgaagaacaggccaaggtgagaaaggggactgtgagcagaagctgtgccaactcaccaggaaataccagccttaaccctgatctgtgtcagcgtatacgttcttggtgacttcagaagtgaaagataaagccataggcttgctggaggagtcacatttcaagatggtgacttcatctggtattgagtctgtcgtacataagaggaacttcattattaatctccgtatggaaagcgtgacgcttgccttgaaaatacacttgccaagcaagaacattattttcttagattgtacatgtattaaggtggcttagggctgggaggtaggtagagatgaatggagaagacagaacccccacaggctgcctgcagcaggtgttgacagggctgttttcaggaaatgggagaaagactcttgtaattgtcacagtctctgagaattaacctgtttggagtcccagagccccaagcagcagaagggttttctttcagagaaatttgtatgtgttctgaggtcgatttcatcagtcctgacctccaggtctttgaaagaaacggctgcatcttggagttactaggaaatgaattcccagcaagtcctgagtgtcaggagcatctctggaatgatggtactcccacctcggagcctggtaacatgttcactcacacactgagatatcttagaagaaggtcaccttttggttctctttcctcttctaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggtacgtagcaaccctccacagagcacacttcctgaggaagctgcattgtgttggagccagggcatggtgggcctggaggataaaattaaggaagggctttgggctgggaagaggagcaggcagaggagttccatgccactcacaggagggccagagcctctgaccttaaaggatttgggttttttcctaccaggggcagaaggaatactaattgtttgcatttcttgaggatccagggaagtctccgtgcattatttcagctaattaagtcagccttatgaggtgtagaaactgttgtttcccatttttatagatgaggaaatcaaattttcatagaaatgcgtctattcatccttttgacatagtgccctaggcagtgctatgcatttgttctttgtcatctgtaacttgagagggtctgagttgaaataaaagaacacatgagccttttcagctggaatatactaatctctggattttggtggtaacaacagaggcaagaggaatgggtagatagctgtgaaaaaatgttgagagtgcttctcagcttcaaggtacattcttatctcccacaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgtta

SEQ ID NO: 35689 - DNA, 77854 bp, Homo sapiens
gcggggtcctccgtagttctggcacgagccaggcgtactgacaggtggaccagcggactggtggagatggcgacgctctctctgaccgtgaattcaggagaccctccgctaggtaaggggccgagaccaatgacctgtgtgggttgcatcagccagggagggtgcagggcgtggaaggtcgctgcgccccggctttgcgcagtggtggtcaccatctgggatgttggacctgcccctcgccccagaattgtacgtggaggaggctccgcacccctcgccccgtgtccccggcaggtgcatctgctcctgaagatggttttcccgggcatggagggaggcgcagtgtgagcccgggctagacaacacgagactccgcttcggatctttttctcagagggatgaactcccagtcaactcacctctccctttttcccccggagagcgagagttgctcgtggaaataagattttaaaacttaaaatccaatagtcgtcgcttctcttttagcatttttcccccaactccttttcttacctcctttcctgtcctgtccctcctctcaggagaaatcctcagttcacttgagtcaaattttccttacgttttatcgagttcagaagaaataacccagacgagcatattagcatttaggatttcaactgaggctgcatttatttttaattaaatgtggtagggtaattggggaaaacacccaggtacactgtagactgatgcggttgcttttactgcaccctgtggatgtgtagtaaatttcagagtaaacattggatctgtcaccttactgacacatcttaagttctgtttggaattattttttcgacatgaccaagattattgttggtagattgcttagaatttctgctttttcattactttgggaaattacacagaagaatttaagtagtttgccgatttttttttttcttttgagagtcagggtcttgctctatcgtccaggctggagtgcagtggcgctttcaaggctcactgcagcatcgaacttccgggctcagatgatcctcccacctcagcctccttagtagctgggactacaggcgcgtgccaccatgcctggctaattttgtgtttgtgtcttttttggaaagatggcgtttcactgtgttgcccaggcaggtctcaaactcctgggctcaagccatcctgacttggcctcccaaagtactaggattacaggcgtgagccacagtacccagcctgacctaatatttgttaatgcatatgtatgataatacacacacagtactttctaatgttgaagaagcccatacctttatatacagttgaccacgtggggctgatgaaattattcattatattctcaactttggtgatgttttaaggttgttgaacaaaaacacaacttaatagccattttaaacatttaaaagatggtaatgttttggcatattggttgcagtaatggactaaccgcacaacaaatcaatgaactctaaaaggaatgggtttgattcctgagctggaaaggcattagagtgccttcatgattgagagcaaagacatttggtttctgcagacctgagtccaatcctggctgccacttactagttgtgaaaccttgacaagttccttatttagcttctcccatagtttccttgttttaagaaagggagaataatgtcttccagataggattggttgccagagttaagtgagactatagttaaagctcctgatactgttttttttttttttttttttttttttttttttggagaccgagctcattgcaacctctgcctcccaggatcaagcaattcttgttctcagccacacgagtagttgcgcttagaggtgcgcaccaccatgcccgcctaatttttgtattttttagtagacacagcattttgccatgttggccaggctggtctcaaactcctgacctcaagcagtccgcccgccttggcctcccaaagtgccaggaccacaggtgtgagccaccatgcccagcctcctgatacattttttgttacttagaaaatcaccctgaaggtggcctgtttctgtagtgtattacagaactcagaattctgccagtattctgtgaaactcttgtcattttgaactgtatgccagttatcaaatatatcatttttctaattgctcctctccctttttaatttttgatttaattattcccagtttaattcaattacattttatctttaagtaatataattagatgaaacattttaaaataatagttgcattgctagaattttcctattttgtatgcattcatcatgttatatatttaatgttaatttcaaacttaaaataaagacctttttcccccataccacccaagagcatactgtagatatgaggcttcagtatctcagcataactccagtgtacatccccaacaaacttggaaactccaggtgatctcacacaagcacccaaatcaggaaatacacttggatacaatgcttccatctaatgcacagaccccatccttgttctatcattatttgttacaaccagaccctccatagtgttgagatcaaaatcccgtattatgctttgtttgcatctgattgtcacctctctccagtttctttcagtctggaatggtttcctagtcttcccttggctttcatagctttgacctttctgaagataacaggccacttaacttgaagaatatcctctgtttaagttgtctgatatttcctggtgtctagattcaggctctttgtttttggcaggaatagcgtagttattccttgttcttcattgcagcccatcagttggtgcatgaatttaattttcccattactgattattctaaccttaattttaatgggcagatgcattggaatcatgtaaatgttccactttgcatcagatcttcacccactagtttcagtatccattgatacttcctgcctaacttgatttttatgattttatgatgtttgcgagatagtgactttcccattctaccattccttctgtatgtattagttggcatttttctgtgaggagagctttctctttttcccatttaaaaaaatcatagcaaaaatactcaagaagttacaatttgtattattttcattttctatttaaaattattttgtttttaaaaattagttttattgaattataacttgtatacaattgttcaccaattttaagtgattgacaaatgtgtacaatgtgacaaatgtgacaagtgtgtaatctacaccacagtcatcatgtagagtatttccattacttcagaaagtcctctcacgcccctttgcagtcattcctttccctactcctagcacctaatagcgactcatcttctttttgtcacttttttgctttttctataatttcatatacattgaatcatattatatatattcttatattctcatatgtgcctaggataatacttctgaaattcatatatctttttgtctatgacagtagtttacttttgttgttgttgatgttgttttttgtttgtttgttttttgagatggagtctcaccctgtcaccaggctggagtgcagtggtgcgatcttggctcactgaaacctctgcctcccagtttcatgtgatcctcctgcctcagcctcccgagtagctgggactataggcgcatgccaccacgcccagctaattttttgtatttttagtagagacggagtttcaccatgttgtccaggatggtctcgatctcttgacctcatgatccgcccccctcagcctcccaaagtgctgggattacaggcatgagccaccacgcccggccagtagttcatttttttatttgctggataaaatttcattgtatgggtgtgctaaaattgatctcatttatttcgatgtcattaccctgatttgccagtggaagcccctccaacctggactctgtcctttctttcttttttctttttttttttttgggagatggggtttcattcttgttgctcaggctggactgcagtggtacgatcttggctcactgcaaacctccacctcccaggttcgagcaattctcctgcctcagcctcccaagtagctgggactacaggcacatgccaccacgcctggctaattttttgtattttagcagagatggggtttcaccatgttgtccaggctggtctcgaactcctgagctcaggcaatccgcctgcctcagtctcccaaagtactaggattacaggtatgagccattgcatgtggcctttttttttttttttttttggggacggagtcttgctctgccacctaggctggagtgcagtggcgtgatctcggctcactgcaacctccgcctcctaggttcaagtggtcctcctgcctcagcctcccaagtagctgggactacaggcctgtgctgccacgcccagctaatttttagtatttttagtagagactctatgtcctttcgacatatatgttctctatctttgagtactcctttgctttctaacacaataagatttttcaggtttattttgcaccttccttgccacagccctgtttccagtggaacatggtgtttataaaccagtatctgggtgctagttgtccatcttttttttcagacagaatttcactcttgttgcccaggctggagtgcaatagtgcaatcttggcttgccacaatctccgcctcccaggttcaagtgattctcctgcctcagcctcctgagtagctgggattacaggcatgtgccaccacacctggctaattttgtatttttagtggagatggggtttctccatgttggtcaggctggtctcgaactcccgacctcaggtgatccacccacctcagcctcccaaagtgctgggattataggcgtgaaccactgcgcctggcctgtctatcttaatcaaattaagggacagaggattaatgaatcaattaagtgtcaagaggccattttacactgttttagagtttgagctgtggactacatgaggcttgcattcagatcctgactgctatatattttgtcaaggacattaggctggttatttaactcctttaagcgttactttcctattctgtaaaatggggatgaaagtatctctcatttttttttttttgagacagtttcgctgtgtcattcaggcaggaacgcagtggtgcaatcagggctcactgcggccatgacttcccaggctcaagcagtcctgccacctcagccccctgggtagctgggaccacaggtgtgtaccactatgcctagctaatttttgtatttttttgtagagacggggtctcactatgttgcccaggctggtcttgaacttgtgggttcaagcagtcctcccacctcagcctcccaaagtgctgggattataggcttgagatatcatgtcctttgaatctaactctacaggttaccccaaagatgaaaaattctaactgtaaagcatttggcatagtgactaagatataatagtcactcaaatactattaacgatagcttttttctttttttttttttagttttttaaaaatccaaggtcaacatattaacaaaagcttttatataaggcactatactattttttttttttttaagacgcagttttgctcttgtcacctaggctggagtgcaatggctcaatctcggctcaccacaacctccacctcccaggttcaagcgattctcctgcctcagcctcccgagtagctggggttacaggcatgcgccaccatgaccggctaattttgtatttttagtagagacggggtttctccatgtcggtcaggctggtcttgaactcctgtcctcaggtgatccgcctgccttggcctcccaaagtgctgggattataggcatgagccaccatgcctggctggcactatactaatttctttttgtctccgaagggagaagcagattaatttcagtgtctctaactgaaagctgaacaaattcaaaaccagttggatatgctagtgaatggattctggattctgatttgttgctgctctgagacaaaagactacattttctgtctacagactactgagaaaaaagttcactccttgtaggacttaatattggtttgttgactcatcctgattgctttatgattcaagttataaatactgcattgcttttaaagataaaaaatcttttcatattatttataggagctttgctggcagtagaacacgtgaaagacgatgtcagcatttccgttgaagaagggaaagagaatattcttcatgtttctgagtaagtgttttcatctttttattttcagtactgattggctttttcttttttttagagtttttttagagacagagtctccctcttttgcccaggctggcatgatcatagctcactgtacctagaactcgtggactcaggatcctgccatcccagcctcccgagtagctaggactgcaggcacatgcctccacacctggctaattaaaaaatgttttttgtagagatggggtatcactgtgttgcccagcccagtttcgaacccctggcctcaagccatcctccggcctcagcatcccaaagcactagggttaaagacgtgagccaccacgtttggcctctgaatggcatttaaagaaatattcggcatcgccgggcgcggtggctcacacctgtaatcccggcactttgggaggctgaggcaggcggatcatgaggtcaggagatcgagaccatcctgggtaacacagtgaaaccctgtctctactaaaaatacaaaaaattatccaggtgttgtggcacatgcttgtaatcccagctacctgggaggctgaggcaggagaattgcttgaacctgggaggcggaggttgcagtaaaccgagaacgcgccactgcactccagcctgggtgacagagttagactctgtctcaaaaaaaaaaaaaaaatcagcattaaatgttgtatgcttgttttacttactaattaagtagattgtccctagaaagaagtatacttttctttattctaaaagaattgaatctagagacttaaatttttcagcaaactgattccccatgtagtctgtttaaaaggaactagaggtctagctttgagagcccatctgcaacaccagctcctgaaatgaggcagggttatttaattggactggcctactcccagaaatgagtgactggtttaatgggatcccttggcacccagctgttgattttttcctgtacaaccaccaactcagcttttaactgaaacttctagggaagtttcagacaggggaatgttgcttcagaaagcaataccccaaagactggcgctttgacatgctgagaggccttagaagctacctcagaatcagggtacctgtaaccttgtttcctttcacaacccaacatgcccacttcccccatcatatagagagggactttctagaatttcctcatctggccaagaaagcatctttccaaaagaaatgcagttgacttaagtcccctccttgtggatctcatcaaataatctggaaaggtcagtcaatcccagctcagacagacttcacctgctcttctgagggcagcttcaagatattacctaggtgactttacacgtgtaataagacagtctttgttcctgtgccgctctgtttcttatcttcctttaatgttgctccctcacctccctgcgcccacttcctggtccatttattctgatgatttactttgctcaaaagaattatctgcattccctatctttctgctcccctatgaaacagggtatgtggccaggcgcagtggctcaagcctgtaatcctagcactttgggaggccgggcgagtggattgcttgagctcagcagtttgagaccagcctgggcaacatagtaaaatcctgtctctacaaaaaaaagaggaaaaattagctgggtgtactcccagctacttgggaggctgaggcaggatgatcacctgagcccacgagacggaggttgcagtagagccaggatcgcaccactgcactccagcatggatgacagagggagaccctgtctcaaaaaaaaaaaaaaaaaagataaactgagctgggtgtggtggcttaggcctttaatcccagcactttgggaggccaaggcagacagatcacctgaggtcaggagttcgagaccagcctgaccaacatggagaaaccccatctctactaaaaatacaaaacttgccgggcatggttgtgcatgcctgtaatcccagctactcaggaggctgaggcaggagaatcgcttgaacccgggaggtggaggttgcagtgagctgagattgtgccattgcactctagcctgggcaacaatagtgaaactccatctcaaaaaaaaaaaaaaaaagataaagctgaaacactttcccctgttgccactacatacacacagtcaccccatactcataaacttctgctctctatctccccctttctcccagtgtagttgtaccataattgtcatttgattaccattctgtatttacattataatgaccgtgtaagttttatttactactgagccacatagtataattgcttttcatgtaaaactgttagttttccatggagtaattggtgtttgtttgctttgtaattttcttctgaaactttctgatttctgaacttttctatgtgacttcaggaagtttggaggaatcttcccttaggagtcagtattctcaaattttacaataatatgctttagtttgggtctatttttcatctgttctgctgggcatttggttgcctctttcattgtggaaacttggaaatcctgcttttggaaattgaaaacattttttctttgaaaaatgtttttctctctatttttggttctttatgtggatgttgggattagtcctttatttttctaagttgtcacctccattttccatctttctattttttttttttttttttttggagatggagtcttgctgtgttgcccaggctggagtacagtggcacaatccaggctcactgcaacctccgcctcccaggtttaagcgattctcctgcctcagcctcctaagtagctgggattacaggcatgtgccaccatgcctggctaatttttgtatttttagtagagatgggatttcactatgttgtccaggctggtctggaactcctgacctcaggtgatccgcccacctcggcctcccaaagtgctgggatcacaggcgtgagccaccacgcctggcctctttatttttatttttagagatggaggtctcagtatgctgtccaggctggagtgcaatggatagtcacaggtgcaattatagcacactacagcatccaactcctgggcttagcgatacacctgcttcagccccctgagtagctgggactacaggtgtgtaccaacatgcctggcccattttttttttttcctttactttctggaaagttcctcaacttctcaactttattatcccatttttctattgaggtttttaattttggctattatgtttttagtatctgagtgttctgttttttttacattctggatactctttttttagtatcttgttttatgattgcagtatttttgtttcattgctaaaaatgaatttattcttttatgaacttttattttaggttcagtggtacatgtgcaggtttgttatgtagataaacttgtgtcatggggtttgctgtacatattattttgtcacccaggtactaagccatccaatagttatttcttctgctcttctccctcctcccaacatccaccctcaagccccagtgtctgttgttcccttttttgtgttcatgtgttctcgtcgttaagctcccacttataagtgagagaatgcagtatttggttttctgttcctgtgtcagtttgctaaatataatggcctccagtgccgtccatgttgctgcaaaagacatgatctttttttttttttatggctgcatagtattctgtggtatatatgtaccacattttctttatccagtgtgtcactgatgggcatttaggtggattccatgtctttgttattgtgaatagcgctgcagtgaacatttccatgcatgtgtctttatggtagaatgaactatattcctctgagtgtatagccagtaatgggattgctgggttgaatcgtagttctgtttttagctctttgagaaaatgccatactgctttttacagtggtttgactaatttacactcccaccaacagtgtgtggttttttgttttttgttgtgaggtggagtcttgctccgctgcccaggctggagtgcagtggcacgatcttggctcactgcaacctccacttcccgggttcaagcagttctcctgcctcagcctcctgagtagctgggattataagtgcccaccaccacacccggctaatttttatatttgtagaagagacggggtttcaccatgttggccaggctggtctcaagctcctgacctcaagtgatctgtccacctcggcctcccgaagtgccgggattacaggcatgagccaccacacctggcttgtgatgggtttggatgaggtttgatctgccttcgtagcctctttattagcaatagattcttggctcctttgccttgatttattttatttatttattttttttgagacagggtctctctctgtcacccaagctgaagtacagtggtgtgatctcagctcactgtgagttcaagcgattcttgtgcctcagccttctgagtagctgggagcacaggtgcatgccactatgcctagctaatttttgtgtttttagtagagacggggttttaccatattagccaggctggtctcaaactcctgacctcaagtgatctgcccgtcttggcctcccaaagtactgggattacaggtgtgagtcaccacacttggccagccttgatttatattaaatcactgttattctcaacatcccagttatattttcatatttgcacctctgaatagacatgtaaagaacaaattagcagactgggcgtggtggctcatgcctctaatcccagcactttgggaggctgaggcaggtggatcacctgaggtcaggaactcgagaccagcctggccaacattgtgaaaccccgtctctactaaaaatacaaaaaattagcctgtcgtggtggcagccacctataatcacagctacttgggaggctgaggcaggagaattgcttgaaccctggaggcagaggttgcagtgaaccaagatcacaccattgcactccagcttgggcaacaagagtgaaactgcatctgaaacaaacaaacaattaacagatctattttttactatagtagaaaatacatggtaaatataataaagtttccatttttacatttcttcataagtctcatgacttactgatttgctagagcagcagtaatattttatctcgtgcttatattctagaaatgtgatattcacagatgtgaattctatacttcgctacttggctagagttgcaactacagctgggttatatggctctaatctgatggaacatactgaggtaagcaatgaacattttgttgtgtgtgttttgtcttatgcttctgtttttttatgggaacctcatcatttattgttggcttatgaactattctacttaaggatattaacagagtgttaattatatagaccaaggtacagaatgctcatcttgtttttttgtcacaaaaaaattctttttttgtaattcctaagtttgaacctttagtcccctaccagctgtacttttgggagcatttagtgccatcttggccttcacagattcctagcatttcatagccagatggggctgtatagatcatctcatccaactttcttactttacggataaggcagcaggcctagaaaagttaagtttgaacagggtaacacgcatagtttggatcccattttcttttctttctaagtgtatgccttgtttaattaattatttcagtagtaaattagctttatatacaatcatgtgcctcttaacaatgggatgcgttctgagaaatgtgttattaggcagtttcatcattctgtcaacatcatagagtgtacctacaaaaacctaaaggggatagcctactacccacctaggctatacagtgtagcctattccttctagactacaaacctatactggcaagttacaatactcaatacagtaggtaattgtaacacaatacgtatttgtgtatctaaacatagacaacatagataaaactataatcttatgggaccattgtcatatatgcagtctgtcattgaccgaaatgtcattatgcagtagatgacagtactgctttttagatgctgctttttttcctgtttgtattctgctctaaccttcctaaatctcataaaattcaaagtacacagaatggtttctaagtactaacttttaaatttttcaagtaaatgaatctgtttggctaggtaccatcccttcggttcattcaggttggcttatttctgccaccaattctcaaattcttattttcctgttctttcctgaagtgccccgccacactcctgtaaaaaaaaaaaaaagcagaaagcatagcaaaataaatgtggcatttatttaagttctattttagattttaggcaatcagaatttagtccacataatgataaattgtataatttgagaaaggaaaagcatagtaagagtgtactgttgctctagttaactagaatttttttatggtctttctttttataagttgaaatgttggaatgcatttcttttctgtcttttatgttgacagattgatcactggttggagttcagtgctacaaaattatcttcatgtgattcctttacttctacaattaatgaactcaatcattgcctgtctctgagaacatacttagttggaaactccttgagtttagcagatttatgtgtttgggccaccctaaaaggtatcaataattcttaataatcctctgttttaatcgtttaatattttgctggataaaaattatatatatttctgtgtgtatgcatgtatgtatatgtgtgtgtatatatatgtttagacagtaacttaggactttattacaggggaatgacctccctggctgttttattcctatccagctacgggaattccctgtgtttttctgccgtcccgtcgtctgtctcacaaccccaacttccttcttgcctttggagctgatcttattcctgataaagaagtccccatcccatttatgttagcacctctcctacttcagctattattttactccagacacttgtctctgacttgaaaaaagccattattgctcagtgagtgtgtgactgggaggttagggagtagtgggatgatgtggagttgtggtttttcttggaggtcacttccttcttctacaactagtttggaacaagtaagaatatgctttttccaacttggaaagacagttttttcaaaaacaactttcttgaggtataattgacatacagaaaatcacacttatttaaaaatgtatattttgataaattttgacatatatatgtgtgtgtatatatacatacacacacacacacagctgtggaactatggttacaatcaagataataaatatatccaccacccccaaaagttcctcatgctgctttgtaatcatccaccctcaccaggtcccaagaaaccagcatgcccagctttgcatatttttcgtcttcagttggttgtatctacggttatggaacccatggacacagagagctaactgttttagaaaacagttcagtgtatatccagatatttaacatttcattttctttagaagcacaactttaagccatctcaattacttcaattagtcacaactggaactttgcttttgaagctgcagatttattgaatagtttaaaattatctttgctcataggaaatgctgcctggcaagaacagttgaaacagaagaaagctccagttcatgtaaaacgttggtttggctttcttgaagcccagcaggccttccagtcagtaggtaccaagtgggatgtttcaacaaccaaagctcgagtggtaagcctttttttctttttttttaaaaaaaaaaacactttgggaggctgaggcgggcggatcacaaggtcaggagattgagaccatcctgaataacacggtgaaaccgcatctctgctaaaaatatacaaaaaaaaaaaaaaaattagccgggcgtgatggtgggcgcctgtagtcccagctactcgggaggctgaggcaggagaatggtgtgaacctgggaggcggagcttgcagtgagccgagatcgcgccactgcactcctgcctgggcaacagagcgagactctatctcaaaaaaaaaaagatgacatttcagtctgtctgaggccctaggtctgaaaagacaattattcctactcataaagtttattttcttttaataaatttaaaaggatcttcttgcaagaatctgacatttttaagtcttggtttcacatttaattgttcatctatataaagccctaatctttataattatatagctaaatattttgatcatccagtgtatgtcccttaggcaatccaaactccatataaataaaacctcattaattttacacctttgcaattttttctttcttctgaatctcctggtttttgaaccattgagcatcaagtcctgggattctgcagcactttttcattggttctgtaggaaaatgtgacatagtgtacagtacaaaagctccttttctctaccagagttgctccactttgatctgttttacactttaggaatgtgttgtaaagttttgatttaattaaggttttctaatgtaaaatttgaaaactactgtctacttggataaagatagcccagtccactcagttgttttggctacaaatctttactcatccttcactgtttttcacatttactcaacgagtcctgttatgacttctcatgtgtgtagatttgttttctgtccatcttcagtgctactgcactttgttgaggcctaatttttccttgcttggtttaataccataatctcataactaaacttccttttgtctcatctttctctagttcagggtatcactttagaaaacacaaatccacggtcctattatccctgaggactgactcctcattgcctaaaacttaaaagccaaacttaaaaggtcctctgtgtttttgacttaatctatttcggcttccttccctacccacccaatatgcattcctaacttttcatggacattgcactactttttcctgcctttgtgccttacctactctgttatttatttacttagaatgaataccccatatacttttttttttttttttgagacagagttttgctcgtcacccaggctggagtgcagtggcatgatctcggctcactgcagcctccgtctcccaggttcaagcgattctcctgcctcagcttcctgagtagctgggactacaggtgcacgccgccaggcccagctaatttttgcatttttagtagagatggggtttcaccatgttagccagtctggtctcaaacttctgacctcaagtgatctgccatcctcggcctcccaaagtgctgggattacaggcatgaaccaccgtgcctagcatcccatatactccatctgatacatttctacttatcttcgaggtccagcttggttcttaactgcttttaagcttttcctgataaacctaggtattgctgattaatttcaactgagtgccctaacagcaccctgaacatatctgtattactggtatttggttttatttatattcttaaccagattttgtaccctcaagtgtagggatgatgttctagtcatcatatttttcataaccagtgtgtgtagtgcctggcacatttgttgaatgagtgtgttcttagacatttaaccataagactttttgttgtgatggtggttgtgtttttcaggcacctgagaaaaagcaagatgttgggaaatttgttgagcttccaggtgcggagatgggaaaggttaccgtcagatttcctccagaggccagtgggtaagaaaatgtaactcacatttataattgaatatatttagtgggaaagctttaaaacagtgattaaatacttaaagtattaataggttaataatatagaagaacataagattttaattgtgagagttaaaattctaaacgttttaacagtttttatgttattaatagttaatgttgatttaatttgtagttttagtttgtcaacttagtaaaagagacattttagttttatcctgacagaactttaattatgtaattaacaaaatatccaaaaataagaaaccttaaatttcatttttatttttagatttttgggctttcatttaattggatttgtatttgtaccctgagcaatccttttaattagcagttgaagttataatagtattggtctttaagttattttttttccccaagtgaaggggagtcctgaaaagcctgttcctattcctttctttccattaggtttcccaaccccttcatctcttggcacccatggaaagtagtatttgaatagctcattagagaaaaagactgttctgtatggtgatcaccaggctggggctgcttcagcccttgcccaccattccccaaggctgagaaggaagtctttgtctttgcacacctgtcatcctatttgaagtatactggacaagctttataatagcgtccttccaatgatgttaatataataaaatacctcttattaaagcagttagcctcacttagaaaattaaccattaggaaaatgttctgccatgttttgtaattgaggtgattattttttccaaatttaagatttccaaatttaattttttcagattttgtattctatcaccataatgaagttctcacctttctatagtacacagtagaaactggaagatacagaaacaattttcttttagcgatgtatttaatacttcttcacaaactatttcataagcatcattaacagtaaaattgcttttagaatttcacattttgtctctgcttttctatgtttgctgattcaggaggtgaaataaagggtagatagaaggagatgaaacagaagtgatgactgtggaaaattcacagacttgatcgttaaatggttgattggtaattgactaagtggattcaggcataaataatacttaccttacatggtttaatatctatagacatcttgggttcctaccatctagtattctgctactgtgcacttggtatgagaggtcatgattgtcctgttggatagtgaccttgatcgtctaaaagccacctttttttggcagtggccatttttagctgcgccacttgaacatttgtcttttttaaatcttttcatattttgcgtcactgtcacttctgggaatagtgagttccccatgtttgtatatttacagtataatatatatttacctgttgtaaattatgtcagagactacgctcatgagacagttttggggtcaggaatataaatcagtatttagttttttttactatgcatagttttcatcatctcttcttgtactgttaaagagtttttctttaattactattttttcattttttcttttctgtgtcttaaatgaaaggccagaaggcttggcttagtcttttattcttattcttagctaacatatacatagcacctattatgtacaggtgctaccacatgctttacttatagtaacttattaatcccaacagccttctgaggaggcactgttgttatctctgttttacaaatggtttcggaaacagattcatatgttgtagtaacttgccaagctcaaacctctaccatctggctctagaatccatataattaaaaattgtactacatgtatctgttaacatatggcagaagcccaattcagcatcagttctaactcatgcagcatgattcttttgtgtgtgtgtgtgtgtgcgcgtgtgtgtgtgttttagcgattctgatatagagtcactctttaactgatgattttagttgtcttgtgacttatagtcctcttagctttcttgaggtttggaattgttagacctgcagatttagaaataacatttttgaaataatgttttgatctcatcacctttcttaaattaatttctgtattttaaagccaagcacattaactgtaaaataataggtactaattgttaatcttttcttgacaatggttataacatgttattgggtgcaacgccctcaagttaaaagtacaccacaatatttttcttcctgggaacttatggcccttcatttagttttatttttaataaatttttaattttagaatagttttagatttacacaaagttgcaaaaatagtacagaaagtttccatgtaccctgcacccagtttttcctaacattaacattttacattattatggtacatttgtcacaactaatgaactaatattaatatgttattaaactccatccttttttgggattttgttagtttttccctagtatctcttttctgatctaagatttcatctgggatatcacatacagccctttttttaaaaaatttttaattaattaattaattaattttttgtatttttagtagagacagagttccgccatgttggtcagcctggtcttgaactcgcgacctcaggtgatccgcctgccttggcctcccatagtgtcgggattacaggcatgagccactgcacccggcgtacagccctttattatatgtataaagttttgaatagccctaaatatgttgcattgtagttgtttgcattagtctttgtatataaaccctccttttttttttttttttttttgacatagcctcgcactgttgtccaggctggcgtgcagtggcgcgatcttggctcactgcaacctccatctcccaggttcaagcaattctcctgcctcatcctcccgagtagttgggattacaggcgcccaccaccacgcccagataatttttttttttttttgagatggagtcttgctctgtcgcccgggctggagtgcagtggcacgatcttggctcactgcaagctccacctcccgggttcacgccattctcctgcctcagcctcccaggtagctgggactacaggtgcctgccaccactctcggctaatttttttgtattttttttagtagagacggggtttcactgtgttagccaggatggtcttgatctcctgacctcgtgatccacctgcctcgacctcccaaagtgatgggattacagacgtgagccaccgtgcctggccaatttttgtatttttagtagagacggggtttcaccatgttggccaggctggtgttgaactcctgacctcgtgatctgcccgcctccgcctcccaaagtgctgggattacaggcatgagccactgtgcccggcccaagcccttcttaaagttgaatcattgatctgggatgctaatgacttttaaaaacttgattgatttgaaaataatgtaaattcataaacttttatgaatttttatattattttattttataaaataatataatttcataaacttttccccctcccatatggatatcaactgagatcaaacctgtgtgggaaaccaggtaactatcttaaaactgtacaactgctggccgaggcaggcgggtcacaaggtcaggagatcgagaccatcctggctaacacagtgaaaccccgtctctactaaaaatacaaaaaattagccgggcatggtggcaggcacctgtagtatcagctacttgggaggctgaggtaggagaatggtgtgaacctgagaggcagaacttgcagtgagctgagatcacgccactgcactccagcctgggcgacagagcgagagtccgtctcaaaaaaaaaacaaacaaaacaacaacaacaaaaaaaactgtaccactgctgccatcattataatttgaaactaatacaagttggtgaaagctgattaaacttccttgcttcatgccttgtcagcccaatcaactgtatttcaacatagtggtgtaacatattttcttttactcatgtacttgatagaaggagggtgttgatgtgtgatattatcaacagtgtctctgatctgtattcttccttacaattgtcagctgctcacaggaacagcagaacagtgtttttgtagattctgattcattgagtgttggtgctgatgagacctttgggattatttagttaaaattcttttatttttaatctccgtgacatgagtttacctatataacaaaacttcacatgtacccctgaacctaaaatagaagttaaaaaattaaagttaaaaaataatcttttggctgggtgcggtggctcacgcctgtaatcccagcactttgggaggccaaggcaggcggatcacgaggtcaagagatcgagaccatcctggccaacatggtgaaacctcgtttctactaaaaatacaaaaattagctgggcatggtggcgcgtgcctgtagtcccagctatttggggggctgaggcaggagaatcgcttgaacccaggaggtggaggttgcagtgagctgagaacgtgccactgcactccagcctgggcgacagagcgagattccgtctcaaaaaaaaaaaaaaaaacttttattttggcatctgagaaaaccaaagcctagagaagtaaagcggcttttactaattgtcatgtgctcttttcatttagtcatcacagtgacagtctcagaagagcttctctccagtggcataggtgggcacccagttctcagtagtagtaggtcttattaaagacaaacagtggaaggtagcgttggaaacaattttgaagcagctttactttaattaaatgatcattctttttgataaaaagaaaaaggagaatctccttaaggttgcaatgtttgtaaataccttgtcccctctgtgagattttacatttgaagttgtttcttataattgttttatatatggtatagtcttttttttttttcctgtcagggtcagattttctatcacagtactttttgttagaaaataaaatatgacttgggtaccaattagaaggacttttgtttagttctcatctcctcaaaaaggttaagtttaagtatttagttaaaacatgttaatgagtttctttgtgaaatgtttttgttttagttacttacacattgggcatgcaaaagctgctcttctgaaccagcactaccaggttaactttaaagggaaactgatcatgagatttgatgacacaaatcctgaaaaagaaaaggaagattttgagaaggtaattaaaagtgtagtgatgaccctttgccagaaaagtgaattaaagttacaggattacctaataccttcatggtatgaaaataaattttgttctcatagctgcttttttccctatctatatattccatatctgagacctaagccaagaaatgtcgagctcccataccaaaaaacttaagagttatttttcctttccccagttatagagtttacctgaatgatatgttttcctataataccaatttattaaatggtcactggaggcaggttttttggtcatataatcttaagtttatgaatgaaataaacactaagtaggtattggaaaatgtgaaggtttcctagcctcttatctttattcagaagtatggcagtgtattcaaagagagggcaaatgattgtcagttctcccagtaatgaccagcttttccaaagtaaatggaaaactccatcgtgagatcagctttctcagctggaaatttggaggctaatataatgagtatctatctgttttttcttttttgatctaatatcatgtaacttccacaaccattttcaggctaaataagactgatggtctatgttacatttgcttaaatgcagtatcaagggttgaaaatgcacgaaaaaatgcaaaagatatactgatggttattttggtttcttactacaggttatcttggaagatgttgcaatgttgcatatcaaaccagatcaatttacttatacttcggatcattttgaaactataatgaagtatgcagagaagctaattcaagaagggaaggcttatgtggatgatactcctgctgaacagatgaaagcagaacgtgagcagaggatagactctaaacatagaaaaaaccgtaagccacattgttttatattttaattgatattcttatattgtgcttctttagtagaacgtgatttcttttttgtgaaagctgctagtttttttgtttgtttgtttgttttgagaaggagtctcgctctgttgcctgggctggagtacaatggcgcgatctcggctcactgcaacctccgcctcccaggttcaagtgattcttctgcctcagcctcccaagtagctgggatgacaggcgtgcaccaccacaccttgctaatttttgtatttttagtagagacggggtttcaccatattggccaagctggtctcgaattcctgaccttgtgatctgcctgccttggcctcccaaagtgccgggattacaggcatgagccaccgtatctggcaaaagctgctagtttaaatacatttgggtatatgactcatttgtcttagaaatcttttttcttcctctatctttatgttcttgttattttattaacatcacaactgcatgtgaatatgcccttagtatctcacttattatgtgtagtcttttgcattgtattcattcaatttgaaggattccttctgcaacattttacagttttcttactttaaatacttagcctttctataatacaatgtttgatgataatgttgtcacccaagtcttccttttggcatgtgggtaaatatgaatataatatatagtacaagctcagtactaacctgtatctctgaaatatcacttgactgaagagcatatctttcttattcatggcttctctcctgaacttctaaattgggtgattttcattctgtaattatgttgtcagaacttcactataattaaacctggagtgccacatttgggaagtattagtaaattaaaatagttataatgagtcttttttattttgaaaaggttttctacattttcagaggtggctaaccaatggacttttagacctatcttgattatttgagggcaagtgtcttacatttctagtagcttccacagaaaattattgtttaacagtttgtatgcatacagggcaggtttttgctagatattgtgatatagagggagccatagccacttggaatgtagagtccttttttctggtattaaactcttttctttcctgtgtcactgttttctatcacctcttattttcttggatccaagagtatcctgcttctcattgggatgatgaaggggctttcagggagcccatgagctcagactctcaacctgagctgtgttctttagataggcacggtctgtagtgccaatgcctgtgggaccttagggccggaccaaaccattctgtcccttaggcatgaggtggcaaaataagaatgcttctgctttaaaggcagaatgttaaatttcagggagatgagaagagaaggggctggcccgttgtgccatgatgggaagggaaacactaggtgagcggagccttcaggccttgtactttttcttatgcttaattgataccacatgagtggaatgtattgatgttaccttttctaaaacgtatttgtatttgctaaatgtattgtgaaacttctttaattaaaaaatgacgcatttgctcttggtactggatactggaaatattacagtgtttttaaactaacacagggtggttataaaacaagaacatgaaaatttatatcaaattatagcactatgagaataatttgaatttaaccagattagtgaaccgtaatgtaattatcattttatagctattgagaagaatctacaaatgtgggaagaaatgaaaaaagggagccagtttggtcagtcctgttgtttgcgagcaaaaattgacatgagtagtaacaatggatgcatgagagatccaaccctttatcgctgcaaaattcaaccacatccaagaactggaaataaatacaagtaagtatatctccttcaatatgctaggtagccatctgtgcttttgttttgatcttctttaaacatggagtacaagcaaaatagtcaagaaacctggccttttgttcatccatgggttcactggctggtggccttctgtaaaggcatgtagcctttcacgggccgtttactcacctgtcaattaaggttctaccacattatttctaagatcacttccatctatgaaagtcctgagtctgcctagagttgctttttttgtattgattaggtatactgtgatgtacatctttaggtgaagatactttgcttcctgtaataaactttgagtctactttgcacaaattgattcctaaaagtaatagtattgaaaacttccagaaatatgaacaatacaggagagtaacatgtgtttagattagttttcaatgtggatttgtaggttaacgaatctttgttttaaatggaccttttccaaaaaaaaaaaccctactttataaaataaatcataaaaaatattttttaatactttgaagaagcgtactacacataaatgctgaattaaaatttctgaagagaatggtaaatgtaaatgattacttggttagctgatgtgacttactttaaactcatgggtgctgacatgtctgtccatatatagacaaatacacatgtgattatatgtgcatacatatcatttttctcaggattactccttgttttactaagcaaatcctttcaatacatttggaaaagtgactttggatacacattttcagtgtcaaataattgcaaagcataatgcagtagcatcttaatcaagttgtatcttaaaagttagaatgtataatggctgggcacagtggctcatgcctgtaatgccaacactttgggagtctgaggcaggaagctctcttgaggctaggagtttgaaaccagcgtgggaaacatagcaagaacctgtctctaccaaaaaataaattaaaaaaaaaaactagccaggtatggtggcacgcttcagtagttctagctgcttggaagactgaggcaagaagattgcttcagtccaggagttcaaggttacagtgagttgtgatcatgccacttcactccagcctgagcaacagagtgaaaccctgtctctagacaaacaaaaaggaaagcattggttgggtgtagtggctcatgcctgtaataccagcactttgggaggccttggtgggtggatcacttgaggccaggagtttgagaccagcctggccaacatagtgaaaccccatctctactttaaaacaaatacaaaaattagcggggcatggtggcgcatgcctgtaatcccatctatacctgggaggctgagaatcacttgaacccaggaggcggaggttgcactgagctgagatcgcaccggtgcactctagcctgggtaaaagagcgagactgtctccaaaaaaaaagaaagaaagcataatgcactaatatatatatatatatatatatatatatatatatatatatatatataaattcaaattgatactgcatgtaaattgtatacattatcttagtcagaaactgttttttagactatttcatcttaaatgtaattttgacctaatgattttctggtcttctgtcggttttttttttttacacagtgaatggagcactgtttttgagtgtgtttgagtacttttaagacttttagggatttacttgagtaagggattactcagaacagagtgagactccgtctcaaaaaaaaagatgttcaaaagctaaatttccttaaaattattacatgtattatttattgcttcctactatgttatacattggccattacagaaatattatgattatacaatttgccaagccaatacctaattttgtattagattgcaaatttgcttttttgtttgactgctaagttgacaactgactcattgttctcaaaggctgataatgttttgatacactttgagtattaagtcataaaaccttttggtttttaagaatctcttaacttgtaaagaattacattttaaattagtattgttgtttataatgcttaatctaagagggaaagggtaaaatgttttgtttattttattttctttttttctagtgtttatccaacatatgattttgcctgccccatagttgacagcatcgaaggtgttacacatgccctgagaacaacagaataccatgacagagatgagcagttttactggattattgaagctttaggcataagaaaaccatatatttgggaatatagtcggctaaatctcaacaacacagtgctatccaaaagaaaactcacatggtttgtcaatgaaggactagtagatggatggtatgtttaatgttacttagaattgacaagaagtaaggacatagtagatcagtgatttttaaactgcttgagagatagggaaggtgattgggaggagggggaatgggtaggcctatagaattcctgattcttatcttcttctcagccagtgcattagggcttccccttcttgttttaatgccacaaataatggagtgcccactggggatcatggaatgaaaaacacacatgagggcacatcctctgcaggtcttagcatttaatagaagaacagttttgactttctggttcttggtatatttggttactgatctctactctctgctgaggctgaggtttttctttttggctaggtcccaagaaggttaaaatacccttgaatcgaagtgaagatgtaaaagtttatcttgagctccatgaaaagggtattactgcatacttactgaggtttgcagatccctgcagaatattaatttcctacatatatttttgttttattccaaagggctttataaagtatattcatatgtgaatgacaggataccatcttttttctgattctcatggtcctatgtggaatagggaccttgaaaatgtttgataaataaaaatgtatgaatgcatgggatttccatatttgaaaatgtcaccattgtgtcttttttttcaaatgtgcttctactgtttccagtagtgcatttattttactgcagtatttgacaggtcagcagttatcctgttccttgaatttgggctcactagtattgcatactacctaattagtataactagctcttagacaaatgtttaacaagctgaatatgatttattattgattaagtatcttctactctccacatctacacattacaaaatttccttggtacttaaaatttacatatttccagggatgacccaagatttcctacggttcgtggtgtactgagaagagggatgacagttgaaggactgaaacagtttattgctgctcaggtgcgttacagtttcttttccagcttgtctgtttgaaatttcaggtacttctattactgtccctttactctttattatctctgttgttctttctattccttgtttgtgccttatgatccaagggcagattttttttttttttttaaaacaaacttttttttttttaaagtttatcactgcttataatagtgaaaaattgaaaatgtcctaaactcctaagctagatttggagaaaggcagctgaagtatttttagcagtgaattatatgacttgactgtgagcagtctgtagactgaacctttacagtgaactgttaagggtaaccaaattagtttgtatacactgagttttatatttcactagaagtaaacttgaaagtatttatcgagttttttttttttttctaaacatgcttagcatgaaataaaggcaaagttctaattaatactgcttgcccttaaaatcatgttgttattgttttttagggctcctcacgttcagtcgtgaacatggagtgggacaaaatctgggcgtttaacaaaaaggtatgtatgttaactctctgccttcttttctcatgcttaagtcccaaataatgtacaagtagaagtcattactgtgctcatggtagagaaaagtttgtgaagaatattaacattttgcagactttcaggaaaatggaatgttttccttttttaaatacacgaagagcattaattaagcctattaactattccaaataagtaacaatgattgaaacaaacaaacttggaattatggggaacagtaatatttttttccttaaattttttatgaacactctgcatttcatttttctgctttcaagctgcgagctctctgtaagaaggtattacttaatgcttttatttgccttaaacatagcttttagcatattacatgttaaaacctgagatgttatatggctttgaagcacaatcacatttatataaaagacttgcttatacaaacgcattgaaaatgcattattcctagtgttaaaaaccatgtcctctggttttcttagtgccaaggggaatattgggataactctattctaccccattcccttgtgtgctgagaggacatagaattctaaaagtatgtatttcattgagttgtattaaagtttcattaattacagttcctttgtcttactgaatccagcttttttttttttaactgtttcttaactgaaagtcaaatgaggaacattgcctattgacattgttaattactaattggaaagcagatgcttggacactataataaggcaaatcattcaaatgccatgttttaaattatggtttctgtgattgtgttctgtaaattcttatttgggattgctgcttgatggtgctgatgtcttgcctcaagatatagttgcttgtttcgcatgtgtcttgaatttgttttattttggtctttcgtgtttagtttttgatacataaaggaattgttaattggttcttgctgttgctgcagttactaataataaatatgagtagaatttgctggcaaagttaacactggtgtacttttcattaacaatacaatttttactgattttaagttttaataaagttaaacatggacacttcagatatctgaaatatattttactatagtcaaatagttctgtagggtctgttaagatgaacaacacattcctctctctatctactttcatagtctccctggagaaagcactttcatctcttctagatagttcttttggtatttattacttatatttcttttttttgagatagagtcttgctgtcgcccacggtggagtgcaatggcacagtctaggctcactgcaacctctgcctcccgggttcaagcgattctcctgcctcagcctcttgagtagctgggactacaggcatgtgccaccatgcctggctaatttttgtatttttagtagagatggggttttactgtgttcgccaggctggtctcaaacccctgaacttgtgatccgcccacctctgcctcccaaagtgctgtgattacaggcgtgagccactgtgtccggcctgttgcttatattgctgaatgaaatatatgtgttactacttttttagctatgtttagacatattagttgacttcccgtgatggaagataaataatttgaccttttactttttctcctaactttttggtttgcttgtagttgattgtcttgctttgtctctccctctcatttgcttattttttgtttttgtttttgtttttctgttaaaaaaaaaaaaaaaagccaggttctcatgcctctactcccagcagttcagaaggccaaggtaggaggatcgcctgagcctgggattttgagaccagcctagacaacatagtgataccccatctctccaaaaaaaaaaaaaaaaaaaaaattagctaggcctggtcgtgcatgcttgtagttctagctacttgggaggctgaggtgggaggatcacttgagcccaggaggtcaaggccgcagtgagtcctgatcacaccactgcaatccagcctgggtgacagggtgagactctgtctcaaaagaaaaaaaaaagaaaattaattttttttttttcctctccccacccctgcgtactctttttttcttttttctttttctttttgtagcggaatctcaccctgttacttaggctggagtgcaatggcacaatctgggctcactgcaacctccacctcccgggttcaaatgattctcctgccttagcctcccgagtagctgggattacaggcacccaccaccacacccagctaatttttgtatttttagtggagacggggttttgccatgttggccaggctggtctcgaactcccgacctcgtgatccgcccacctcagcctcccggagttctgggattacaggtgtgagccaccaagcccccctgcatacttttctgtctccacaagatgtgcaaatttcccaccaagatattcagatgccttaggtatactttcagtttcattttggagacatttgccagagccttctgtgctgctctgtaacctgatttggattcatggcccattggtttctgaagcatagctatcttcctaggtctcttcagcatcttcctagggattccctttgcttttattctgtaatggacattacagaacattgccccattcttggatcttcttttttttttttttatattaccttcttgctttcctgaaggtaatacgtcattctttggagactcagtccagctccctgacaaggggaggatgggatgaagaaaattttgaaaccttgtatctgacctgtgtttttagtctgaaatttcatgatgataggccatggtgagggtctgttttcatccgcatcattggaagaacatgtgacttccagtctagaaactcattccttcagttctgggaaattttcttgaattctctccctttccctttccctttccctttccatcttttattttctttctcttgtcttgtcttttctcttttgttttgttttatttttttctgagacggagtctcactctgtcgcccaggctggaatgcagtggcacgatctcggctcactgcaacctctgctgcctgggttcaagcaattctattgcctcagcctcctgagtagctgggattacaggcttctgccactgcacctggctaagttttgtagctttagtagaggcagggtttcatcatcttggccaagctggtcttgaactcctgacctcttgatccacccgcctcagcctcccaaagtgctgggattacaggtgtgtgccactgtgcccggctttgaattctttttctttcttctctattgtgtatttcttctcctggaactcttcttgggaagatgttgggcctcttggactggtactcttgtttcgtgttctgtcttattttccttcttgtcttttagtttatcacagatctacttaatttttatcttcccacctttctgttgaattttatttatgctactatagttccagtgtttctcttgttctctgaattttcaaaataactctctattcttgtttcatggtattaatagtagggttttctgcagagtagtgtctcttctccccaatttgtttattttggtttctttcacgttaaagatatttctcagatgtctggttagagccttggttatctgcttatgtttaatgtggggaaataaagagtgattggaagcctgaagaatgagagttgggctttcaactgagcttcactgtacaatgatctggctgggctagtttgttggagaaattccatgtcagtaattttatatcttttctcaaggattaggcagttttcccagaggggcttcattgaatcgccttcctgaagtgtgaagacctggctgccaggctttggagccaaatgggggaagactgctgagggttttataaatctactatcatacattcacttattcccattgtctctcgtgcagtaccctttcctttggctctttctggtatctgccagaatctagataccctcttattcacagagtaaacttccagtcttttgtcaaggtaggggagaggcagttgcctggttatatggagtggggaggggatgcttctatgtttttcagcttccagaattttgttgctgttatcttttttgtttttttttgagatggagtctcgctctgtcacccaggctaccgtgcagtggcgtgatctcggctcactgcaacctctgcctcctgggttcaagcaattctcctgcttcagcctcccgagtagctgggattacatgtgcctgccaccacgcccagctaatttttgtatttttagtatagacagggtttcaccatgttggccaggctggtcccgaactcctgacctcaggtgatccgcccacttcggcctaccaaagtgctgggattacaggcgtgagccactgtgcccagccttctcttcttttattatattaatccttctggatttgttcctttaaacaaaacaaaacctttcatttcttttaagttgggggttgggaaagagtgaaagttgatgagtattttcagtctgccttttttctcctaaatcctgtgagatctttaatcattaaacaccgtctttaaaacatagcattgtttttagtcaactggtagtaaaaaggaaatcattgtgatcattactttttgtttctattgctggccttcatgatgtcttcatacactgaaacccattcccttcaactcttgaggtacatacccctcttatttagagttcatggcactctcaatctctaattactgctttgttgttttctagcttgctctgtctttcttctcaagctctgcaggtaagatttaagtgaagcatcagtgaactaaatttagcgccgtggagttgtgaagtaagtgttactggcagagctgaatcatcattctttggacattctcctactcttcactaacttagcattttttttttcaaagcaggttctgttttaaaaaaaataagctagatttatttgcatgattctttggagaaagagccttattttaggagtgaattgtacgtggtaaagaaaagaagggagaaatggatgaaggggaaagagatgtggggtgattagttatctcaatatcccttcgacaataccgtgatccttgttttctcagcctgagttttcatcttgataggaaactagtactttatttttctgtatcatagttaaatggaatatatctataaatagttttttccttgatagtggtaggagacatttcaagagcttactttgcattaacctcactagttttcttctagcttttatttaagtgttaagattttaacttttcagtcaaggcagaagagtcacaggtttaagatgttcattttagagctgttgtcaatctctatgaacccttattgactgctttagttttaaaatgtatgtatttcagtagtataatataatttttcccaactctcatctcaaccccttgcatctgttctcagctaataaagtatgtagagacttctctccccactccacaaatcaggagacttccttccagtgaaagttttcttgaaaattaaaccccaataaataaaacaaaaacatagctgttctggttgaagtatgtgaaggggatctggaggccctctggtccttcccccttcacttagtgctaccagaattaaaccccaataaataaaacaaaaacttagctgttctggttgaagtatatgaaggggatctggaggccctctggtccttccacctccacttagtgctaccagggcacctctttgaaatatttaggactctttggagtaatttgaaaaccactgatccagagacttttagaattgcatatttttagagctaaaaataccttttaagtctttgaatccaagtttcccaaatatgcctgatcctaaccatcctatggaatgcttgttaaaaattagatttctgaaatttacttcagaccaagttgtctcagaatctgtgctaacaactgccccaagtggtgattaaaattagtcaagtataggaaacatcctgctccttttggcagcggaggaaacagctgcaatgaactaagtttcttaggcggggttgtctagttttagtttttttaaagaaattatgtcttactgacttaaatactgaactgagtagtcagtcacgaattaaatctttgattattccagcccagtagaagctgaaaggagaaatccttagctagtaagaatgaactttaagcctcaaggaaggaatgaaacagtaaacttgaaaaaggctggtactgatttagtattagcatgaaatataagcagatgaggattagcagatgaggagaagttaaatagcttttcaaactttgcgtgaatgacctctctgaggatggcttcctctctgagttcattcagaatttccacgatatcattctttttagaagctgaaaactaccttcaacactgacaaaaaaaaccaacccaataatggcaacaatggaaaaataaaaacaaatttaattataccactgttttctgcattcttctaatgagaaaaaataacttccattacttagctgtttgactctgctttcatctacatttttctcacatgtgctttatatatagtgtctaaacattgctcttgtgattggtcatcatgactaattttacactgaacagtgaagtgagaaaaatacatcagctccagaaggggatgctactgatgatttggaagtagaataggttagagcataatgtgtatgaccatttattgaggcaatctgcaaatatttattgattacctatatgagacagaccctagctaggtactgggaatatactgagaatatactggtctatatatactggcctctacatatagcatgtaaaccagtagaaatgtcatttatacttttaatctatagaattgccttattatagtgaccgaatgctattctgcttttgatggtgatgtgttaccctaacactgattaaagaaaacaatactgaaacaaaaatatccatattctcttaaaatgggcttgtccaaactataaaattgaatatcacatttacctttaggattaagatataaccccactggaaaacttttccttgccttctaataccagattttaaaattattttcaaaataactctaatattatgctttaattggtttcttttcacctgccagtagctattcttgtgaaagaagtctaaatccttcatgtagtcttggtttacagttgttctcttttttctgcttaatggtaaatatcagaaaagagttaacagttgaaaaaaaattagtaaatgcagtaacaagaaagccagttagtattcctgtgctattatttattttgcttatggcgctctataagatatcgcagtgttttaacatgaggatgtatttgttgcaggttattgacccagtggctccacgatatgttgcattactgaagaaagaagtgatcccagtgaatgtacctgaagctcaggaggagatgaaagaagtagccaaacacccaaaggtcactcttacagtttcaccaatgtgtttctctctgttaaaagaaggagcaggaaataaaaaggaaaatgtgctttcatggcagtggcatgattttgagatgattttctttctttctttctttttttttttttttttgagacgtagtcttgctatgtctccaggctggagtgcagtggggcgatctcggctcactgcaacccctgcctcccgggttcacgccattctcctgcctcagcctcctgagtagctggaattacaggtgccccccactacgcctagctaattttcgtatttttagtggagatggggtttcaccatgttggccaggttggtctcaatctcctgacctcgtgatctgcctgcgtcggcctcccaaagtgctggaattacaggcgtgagccactgcgccaggctgagatgattttctattcaacattgtcaggatttgatactaatcgaagtaaatcttttttggattttttgccttaaaaaagtttattttagtaacaatccatagtacatcacacagaactgttatgctcagttggtgcttattttttattgtgtagagttagcatattagtgtgtaataagaatttatctcttcctagagtaatcctgaaagatgagttataattcaagctcctatctttatatggaatctgaagtgcattctctattaactagggtattccctgtcacctttgtctttaagccaaaacattagacctactactgttgaatcacagcttgacttcagagtctcttacactgtcatttcctctgtttggaaagtataagtgaagggtccatctaaattctgaatagaattttttttttttttttttttgagacagttgcgctttgtggcccaggttggagtgcagtggcatgattctggctcactgcaacttctgcctcccggcttcaagtgattctcatgccttagcctcctgagtagcttggattacagatgtgcgccactacacccagcaatgtttgtatttttagtagagatggggttttgccatgttggcggccaggctggtcttgaactcctggcctcaaatgatctgcttgcctcatcctcccaaaatactgggattataggcatgagccactgtgcccagccctgaatagaaatcttaaatacaagtaccatagagtacttttttgttaagctgtggtcatcccagatccttatgactgcttagttgacaattttgaagcaaaacaagattttttttttttcttaattttgaaatgggccttgctctggtgctcaggctggagtgcagtggcctgatctcagctcactgcatcctctatcttggtctcaagtgatccttccacctcagcatcctgaatacctgggactacaggttcatgccaccatatctggctcatttttgtacttttttgtagagacaggtttagaccatgttgccaaggctggtatttatagaggcagggtttcaccatgttgcccaggctggtaaaagagttgttttatttcagctttacaagttgtctataaataactttattatatactgaaaattacgttcacagactaacgcatatactagtagccaagcttataactgtgttcgtagactaactcacatataagatgatgtgcattgcaaagagctatacatattctaaattgtagctttatatgattgtcttcccatgtatgtcattatctactttttaattttaaagatttgaatcctaataagatttggggtgcgcgtttagttgattggtttggctttgtctttctttatatctgattgttttgaccaggtaagtagtagtatctgacctgccatatcacctaccatacagttagtataaatctgaagcatattgaatattttaaaatttgaatcttgagaataaaagttttgaagggtgcttattttttaaaatgacagttgtggtctgatagtttagattaaattgctaggttggtggcttatgcctgtaatcctagcactttgagaggtggaggtgggaagatcatttgaggccaggagttcaagaccagcctggtcaacatagcaagactctgtctctacgaaaaataaaaaaattaaccaggcattatggttcatgcttataatctcagaggtaggtggatcacttgagctcaggagttcaaggctgcagcgagctgtgactataccactgcactccagcctgggtgactgatcaaagccctacctcaaataaaatttaaaaaattaaattactaagtactgctcattgttaaaaataagaactaattgttaaggaagcacactcttaaattgtgactggattactcagtttgctctgtggaattttcattataacatttccgtcgcaaagtattttttatttagcctgtcagtattctattctgagcttagtatgttatctgttgttaaaacatactgatttttctgaaatgcattggtgagttcattgaacagttgttaaacacatgctggttaatgtttatttcaaaagatcttcttactttttttttttaattctgccaaataaaaactgaaattatggcgttctttttattctccgcatctctttttctttccatatcatacacactagaaaggcagaaaatttacttatctatatctatatagataatactttctttaaagtttgtcttctaaaatctgaaaggtccataatttcctgctaaggtggcatctgttgtcctataatgtcccatagccactgctcaagaatgacttattttctcctttgctgcagaagcagtgagattcttttatcttttttttttttttttttttttttttttggtgacggagtctcgctctgttgcccaggctggagtgccgtgatgcaatctcggctcactgcagcctctgcctcccaggttcaagtgattctcctgcctcagcctcccaagtagctgggactacaggtgcatgccaccacgcccagttaactttctgtatttttagtagagacggggtttcaccgtgttagccaggatgatctcgatctcctgacctcgtgatctgctcacctcagctgggattacaggcgtaagccaccatgcccagcgaagcagtggccacccaaagtgctgggattacaggtgtgagccaccatgcccggcgaagcagtgggattctaaggataggaaacagattctagttgaagagatactaaatgataaagtatactgtcttagctgtgaaatcaatgagtcttgtaggctggaagtaatcttaggggcaagctacctcatctaattccattaacattagtggtcaggttgctgatctgatgtcacagagctggaattcaaactattgatttctattgaggccgagtatgtattgtttaaatgctaagaacagaattgggaatatgtttatgttaaaatacatagatggagaaagagtaaagcattttcttcctaatacagcaatgaactgctaacagtttagtaacacagaagacttttgtatggttaaagaatagaatgaatgtataaatttgcatactgggttcaataagttgttgtttcaacagacactctgcttttctttatcaatcagaatcctgaggttggcttgaagcctgtgtggtatagtcccaaagttttcattgaaggtgctgatgcagagactttttcggagggtgagatggttacatttataaattggggcaacctcaacattacaaaaatacacaagtaagaactttttgtttgttttcaaataaacataggagaaaagtattttatttgtgtttacttattaaacattaccaaattcagacccatacatgttgctgactagtaaatctgcccagacatagctactgcaaattctggacacaagttaaatttttttccatatatctttcagtttactaacaggctatcaagatgtcttttatttgtggtgttgaaaattactacatctggatataaaaaatagttgtaatgctttaatgagaaattacatgataaaaagggactctatacagttgcatgacatggggatcttttagacagaatttatatgtataacataatctttttactaaaatttactttaaaactgattggttaataattaatttgactttctagttactatagtgtgctacacttaggaatatgatcttcagattctataaatgaaacatagtatgcttaagactgatttatgcaaactctgaaatcttaattgcgtagttattacatatgattgcaagtaactgccaaatgtttttaaacatagtaattcaaattttataatgcttgatgcaggtgactttaagttaataaatatatacatgttcctcatcaattgtatgtgaatctgttctctagttgattattagtatctcgatgtcagtgattatgttgtatttattaaccaatatatgtctggcatgttagaagctcaaataaatgtttgatttggaatttttccaaagaaaatttcttatccatttattacaaaataaaacaataaattattttataataatataaaattattatagaacaaaataatgaatttatggcagctgtggttaatatttctttgaatacttttaatcttatatctagaaatgcagatggaaaaatcatatctcttgatgcaaagttgaatttggaaaacaaagactacaagaaaaccactaaggtcacttggcttgcagagactacacatgctcttcctattccagtaatctgtgtcacttatgagcacttgatcacaaagccagtgctaggaaaagacgaggactttaagcagtatgtcaacaagaacagtaaggtaaccttccaaagaaaccatatttcaccttttaaattttcctttagaattaaaaaaattaattttatatatttcggatcctcagataaaatggataagatgtgtagaattttatttaaatcaaatgatgtaagttggccgagcatggtggctcatgcctgtaatcctagctctttgggaagccaagatgggtggatcgcttgagctcaggagttcaagaccagcctgggcaacatggtgaaaccccgtctctacaaaaaaaaacaaaaaaaaaaacaaaaaaaaaaacgatgtaagtaatgtttccattttatagatgataggaagtgaaacacagtgaagttgagtaacttacctgaggacaaacagtaaatagtagagttgggattcaaatctgaccctcgtatttaagccttacgccagcatgcctttcacctaagtctattacatgcttcttgcatcatatttcatatttatagcagggaaattatttcttctggaatgctaatcaagttatttaaaaggttttttgaggccagtttatgaatgttaacttttaaaaatgtgataaattgaattgtcatttaacacttcaccgtttcattgtgtgtcctcaagtagtgaactttttaacatatctgtttaaaatgggagtattttagttagtggaaactgcttgcattttagagttattttactactatgattttgagaaagtgtactttggtttatatcatctttacagcatgaagagctaatgctaggggatccctgccttaaggatttgaaaaaaggagatattatacaactccagagaagaggattcttcatatgtgatcaaccttatgaacctgttaggtaagtaaatgtaactgaacgtctaaatgaaaatgcttaaagttgttatagtgagtaatattttagaaattgaactttcactaaaataacgtacctaacagttttctttctcagtctctcagttttattttatatttaacattttagacaagtaatttattttaacaagtgatctttgaaacaacacgcacattgaacattaataaattattcatttctgaaattaaacctcttataattaactttcctgtagcccaagtataaagaacaaaatttcagtctgtatattacctatctttgggtgaaaattattaccattatctttttctttgtagtgtattttcactagataaatggtacaaacagcatacatttagagggaagaaataaccagtatttgtatttttttttttaaccatgaagtaataggattattagaaggagaactctatgtaaatttttgtcccttttttttcttttctgtttgtctctgctatttttttaagtgatatctctgtaactgtgtagtcaaaacgcctctcctgagatttagtcttgtgaatctaactgctttagatatctgtgaatagattctttcaagcatttcaaactcaacgtgttcaaaattccaggatctaggtgtcatctttgacttatgcttccccttcatcccttttttcactcagcaaactctgtcgtttgtgttgcccatctggtccatctctgtggatccactgctctgccttatttcaggctataacattgcttccttgattgccaaaacaggctctcaggtatctccttgcctccaatttcatcctttttctgttcagttttcacatgcccaccagtctgaaaatttaagagtaacagttttatcacatttctctactgttaaaaaatctctattagtagggcagccactatgacttatgcctataatcccagcactttgcaaggctgaggcaagaggattacttgaggccaggagttcaagaccagcctgggcaacatagtgagaccccatctctacaaaaaattataaataaagaattaaccaggcatggtggtacacacctgtaatcctcactgctcaagcaggtgaggcggcaggattgcttgagcccacaagttcaaggttacagtgacctataattgcaccaccacactccagccttggtgacagagcaagactctctcaaaaacaaacaaacattgttgttagtttcagagtaaaggctaaacttttgagtttgatatgcaagatttttcatgttacggcgtctcttgagccataggtgttggagttttctcgccctgatcccttctttttaacatatgtaccaaattgcctggggcttttcaaaagcacttgatgccttttcctggaatggccttgtggctttttcgtcatatgagtaaccttattcattttaatatcacatttcctttagtcacataagctcacgcatgcatacagtgtagcatagtgcctaatagttgctaagccctccttaagtatttagtaatggtggtggtaccaccaactaaaataacagagtaggttctcattttattcttagaaagtttttgaacttttcaacaaatagtgctagaagaactgaatagctacacatgaaagagtgaagttgggcactttctcatatcatatacaaaaattaactcaacatttatcaaagacctaaatgtaagagctaaaaactataaaactcttagaagaaaacgtgaatgtaaatctttgtaaccttggcaatgctgttttggatataacacctaaatcacaatcaaccaaagaaaaaaaataaattggacttcatcaagattaacatatattgtgtttcaaagaaagtgaaaagataagtcacagaatgggagaaaatatttgcacatatgtctcttaaaggacttgtatccagaagagaacccaattaacaatggatttaagtagacatttcttcaagcagatgtacaaatgtaagcacatgaaaagatgctcagcatcattagttgttagggaaattcagatgaaaatgacaatgaaatatcattgcataccactaggatggctgaaataaaaaaagacaataacaagggttagaaatgtggagaaattggaacccatatgtattgctggtagggttgtagaatggttcagccactttggaaaaacagttggatgattcctccaaaaattaaacacggagttaccatttgatccatcaattccattcctgcgtatttgccaaagaaaaataacatgttcacacaaaaatgtgtacatgaatgtttacagctgcattattcataattgccaaaaagtggcaatagattattgctaattactataccctttgaaattgagaaattcttataaattattatttttttaagagacagggtctcactctcacccagacttgagtgcagcggcttgacctccccaggctcaggtgatcctcccacctcagtctcctgagtagctggggctacagatatgtgccaccacacctatctagtttgtgtattttttgtagagacagggtttcaccatgtttcccaggctagtcttgaactcctcggctcaagagatccacctgccatggccccccgaagtgctgggattacagatgtgagccaccatacccacccttaaatattttaaaataaataaatgttttacagaaatttttctgcttataagcagattaggtgtggtatgtagacaaattttcttgaagtcaagagtatcattaacattcactaacgccctttctagtggcaggcatagcagatataattttgccctggacatagtttgttcatatggacgaaagttcatagattggaagtttgtaataaggactgtcaattttttttctttttttttttccattgaggcagagtttctctcctgttgcccaggctggagtgcaatgatgcagtctcagctcattgcaatctccatctcctgggttcaagcgattctcctgccccagcctccaaagtagctgggattacaggcgcccgccaccatacctggctaaatttttgtattttttaagtagagacaggtttcaccatgttggccaggctagtctcgaactcttgacctcaggtaatccacctgccttggcctcccaaagtgctgggattagagtcatgagccaccacggctgaccaattttttttttttctttggagacagaatctcactctgtcacgcaggctggagtgcagtggtgtgatcttggctcactgcaacttctgtctcccaggttcaagtgattctcctgcctcagcctctggagtagctgggactacaggcacccgccgccacgcctggctaattttttgtattttagtagcgatggggtttcaccgtgttgcccaggctggttttgaactcctgaactcaggcaatccacccgccttggcctctcaaagtgccagtattataggggtgagccactgcgcccggccaagactgtcaatttttatttatgcatttgttgtttgtaaaactattctgaagagcctctgatttgaatagtaagacaatggactattttatacttcaaaaagcattaactggacaggtgcagtggctcacacctgttatcccagcactttgggaggctgaggtggccggatcacttgaggttaggagttcaagaccaggctctactaaaaatacaaaaattagtgtggtggcatgtggctggtaatcccagctacttacaggctgaggcaggagaatcacttgaacgcaggaggtggaagctgcagtgagcttagatcacatcactacattccagcctgggcgacagagtgagactgtctcaaaaaggaaagaaaaaaagaaagaaaagcattaacttagtgccattgaatttatctaggaattcagtgtttattgctgttcagataattttgttcaaataaactattttgtccctttattttctttttagcccatatagttgcaaggaagccccgtgtgttttgatatacattcctgatgggcacacaaaggaaatgccaacatcagggtcaaaggaaaagaccaaagtagaagccacaaaaaatgaggtaatgacttttacggatatgtgtataaaaataaatggtctttctatcccagggtttagaatatatttctttacagatgattatctttcttactgtggagactgaagaagacagttaagtcttgctctttgcattttgttgttatcctttcatgtaagattttaaaatctcactctcacccaaggctggagtgctgtggcgcgatctgggctcactgcaacctccgcctcccgggttcaagcaattctcatgcctcagcctcctgagcagttgggattacaagcgtgcaccatgacgcccggctaatttttgtatttttagtagagacaggcttttgccatgttggcctggctggtcttgaactcctgacctcaggtgaaactcccacctcggcctcccagagtgctgggattataggcatgagtcaccgtgcctggccagaccccttatactcttaagaatgatttgcttatgtgggttatatttatcagcatttatcatactaaaaattgagaagttttaaaaggatttaattcatgtaaaaataataaatccagttacatgttaacatacgaaaagtttttattaaaaaaaattttccaaaataaaaattttagttaaaagagcggtatggttttaaatttttacagatctctttaatatctgacttaatagcttctaaaaacctgtacaaacagtcatgagagaatgagagcgaaaaagacaaaatacatcgtaatatagtgaaaatagctgtgactttgcagatcccctttaaaagggttttatataccccttggggtctgtggaccacaccttgaaaattgctactatatattattcaataactcatggagtaagcatgagatgggaaatttggttgcttttccctcattggttccagttcccatctgtgcctatcattttttacatatcctagaaagataactggtgttatgctataagttagtatgtgttcttgaaaaacttcatgttctgcaaaatcacataccgaaaataacagccgatttttcaagaaaaacagagttgaggcaaaccactaaaaacctatgtatcccatgtggtttcagtcagatggtggctgggtagcagtcatcaaagactcaactgggctgtattctatttttattttattttatttgagacagagtattgctctgttgcccaggctggagtgcagtggtatgatcttggctcagtgtaacctccacctcctggcttcaagcgattttcttgcctcagcctcccaagtagctgggactaaagtcacgcaccaccatgcccagctaatttttttatatttttagtagagatggggtttcgccatgttggccagactggtcttgaactccttacctcaggtgatctgcccacctcggcctcccaaagtactgggattataggcatgatccactgcacctggcctgggctggattctaaaattgtttcctcacctggatgccaagttgatattggtgttggctgggagctcaggtggaatagttgactgcaatagctgcaagtggcctctctagcatgacagtggcagggtaataagacttcttaactatcatttaaggcctccaaaagtgagtgtccagtagatgaggtgggagtagcattgcattttaggatttagacttgtaagtctcacataacatcatttctgctgtactctgttggtcaaatcagtaacaagctttctcagattcaggaaagggcacagagatcccccttcttggtgggaggaaagtcaaaaaatttgtggacatgctttgaaacctgcacacttttgaatagaaattcaatattcaggtacagttgactgccacttatacccaactttgcagtcagagatcctttgcagctttaaacctgaaggataataatgcttttccctgtgatgtgtagatctttgaggatatttttctccaatagaggctgatactatcaaaattaaattctcatccagggcttaatgttatggtaaaaaatgttttttaagcatcatcctcattaaaggaaggcacttatatgaaaggtttttgggtttttcttcagattgtcaatgtatttctaaagttttctctttaattatgaaaagcttgttcctgcatgcttctttatttgacataaaactggaatacacagggaaaaaatcacacacaaggcagtgtgatttttttttttttttttttggtgttacactcatatgttcccctgtttactaaccatgaatgagatgatttatgttgcaaattaaatgtagcagaacaggccaggcgcagtggcttaagcttgtaatcccagcactttgggaggccgaggtggacagatcacgaggccaggagattgagaccatcctggccaacatggtgaaaccctgtctgtactaaaaatgtaaaaattagctgggtgtggtggtgcaggcctgtaatcccagctacttgggaggttgaggaacagtaatcacttgaacccgggaggcggaggtttcagtgagctgagatcacaccactggactccagcctggcggcagagcaagacactgtctcaaaaaaaaaaaaaatgtagctgaacaaatatatatttttgatatagggtggctacatgaattgtattatttatttaatgtatatgcatttatatatgcatattagtgtttgagtgtacatatagaatctcactaaaaataaatatgagtgatttaaggaattatggggaaggaattttgagcgatgggttttttttactgacatgcccactttgagagcctaacgcctgtgtaaaatgcaactctgatacagcttgagatgcctgttaagtgtctaggtaaagatgtcttgaagacattgaaaatgctgggtctgggatcaggacagaattctggaatagagatgaaaatttttggaatttgtacataagactgtgaatatggataagattattctgaaaaattaagtggcagatcatttaaaagaaaaaagctgaaagaaaggtataatgtgagctgggttttaatgttagaagggtttcagtagggaagaatgcagtctaggcagcagaaagcatgaataaaaatagtatctttattcactcttcagggttgattttagtgaacatagctctagattttatacacaaatagatacctgtaaatttataattttacacaaatgaaactgttccacaacaatgagttacaattatatcacagagtttgatggagctcttgccttatcaacaatctagatgtatttcatctctaaaaaaattaatagtgatacctaatgcttattgatattcactttttctcagcctttgtgactaagggctttacacagattactttttattttcccatcaacttgatgggttaagtatggttatcccccttttatagtaaggaaacagcttaaaataactcaaagttgcacagtgagtatgtggtagagcagtgatttattctcaaacttgatggatatgttataatttctttagtcccctaatgacaaagatttagggtattttcaggtttttactatagtaaaaatgcttcagtgagtatgtaggtacctctatctttgtttacgcctgtcatttttcattaggataaatacttaggagattattcatttaagctttttaagggattgaagtttaaagtttctgtttttaattggaaacattataaaacaatcagtttgaaataattttgtgggaaaacatttaatatgaattaattattttacttttggttttctctcttggtagacctctgctccttttaaggaaagaccaacaccttctctgaataataattgtactacatctgaggattccttggtcctttacaatagagtggctgttcaaggagatgtggttcgtgaattaaaagccaagaaagcaccaaaggaagatgtagatgcagctgtaaaacagcttttgtctttgaaagctgaatataaggagaaaactggccaggaatataaacctggaaaccctcctgctgaaataggacagaatatttcttctaattcctcagcaagtattctggaaagtaaatctctgtatgatgaagttgctgcacaaggggaggtggttcgtaagctaaaagctgaaaaatcccctaaggtcagtatgttagagaaagtcaagaccacattttcagtgtgtgaattcaaactgcttagagtagtctcatcttcttataaaacatcgactgctcatattttgatgtaataatcaacattgattgatacctgctatgtgccaagctctgaaaatatatataagaagctcataatctagtggaggggtgacttactggggaaggaaacatacagactcagtgtactcttatgtgatgtgactgtaatcctttgtgatatgtataagttgctatgtaaagggtttgtgttcttaagtggcaacaaaggtggaaaccatttataaaggatatttaaaatcatcctgaagtagaagcagccattatgggggaacaaagatcacaacaaggcactctttaagtgtggaaccatggttctcaagctttactgtgcaccagaattactggcttggtaaaacatggattgctaggccctgccctttgactttcttctgcagtagattcagagcacgtggagaatacgcatttctaaaatgtttctcaggtgatgcagatgctactgtcccagggaccatgctttgagaactcctggtgtagaggacagtaccagcagaggtagaggtcagcaggtacaaggtgtattcaaggaataacaaatggattgtcaagaggtttttgacctgtgattatctccagcttttcatagcagagccttcaaattatatgacattttgactgaagtataaattatattcttgtttcagtatgtccttaggcaaaacatttagccaagtaggtgtggcacctagtgtgaaatgggcttacttgatgtaggtaagagacaaagggaatggcatctgtatagactgtgaaagatcgtatttaataatgaaggtatgtagttctcctcaaacagcagcatagtttaagacatgatcagataaatagtactgcaacgaaaaacaattcagcccctgatgagctgccagaaattgtagaatttaggctgtggcacatacacagagaggtatggtacaccactaggcttgacttgtgtggcgggaaggggatttgttctaaaatgtcagatctgttgtcctgtcagggtcctaggctcaggctggagaattcagtaagttcttcaccttatcaacaagttgctggcatctgacatgaaacactgccacctaagatactttgattcatgaatatttgacctcatattttgaggtcttgccccaggagttaatatttttctgtctctccattgtgaactgttgagaaatcctttattaggtcagtgcaaaagtaattgcggttcttaccattacttttaatggcaaaaaccacagttacttttgcagcagcctaaatagcctgttgagatcccgcagaaccatgattatctaaaacagctttgcttcaaggaataaatgctgctggatgtatgagtttaggatataaattccagatgtttcttacctcatggggaggttgggagcattttgcactgtatctgttggacactaaatatgtactcctttttaggtgtaatttggagggaagggctttggtcttcaaatttattcattgtataagtagaatatattgagattctgtgccaatttttggtcagcttaattatgggtggaatagtaacagaagcaaccgttgtacttggagtgacagtcaactatgaatccatcacccatccttttgggttaatgggttacatcatgctttcataaaatatcactgttgaggttatgaaaagtcagcttaaggtaaaaagatctaaatttctttggtaattgggcaggtacttttattaggtattttaatactaatgtgatactgaaataaatctgacttcagtttagtctgacttacatttattgaatgcctactgtataccatgtctgtgtttcaaaatatagtaagtcttaatattgttcataggttcttggaaactgagactttaagcaaaatggtgcataacaacaataggctaattgagataaacaagaaattaagtaggccaggtgcggtggctcatgcctgtaatcccagcactttgggaggccgaggtgggcagatcataaggtcaggagatcgagaccatccttgctaacacagtgaaaccctgtctctactaaaaatgcaaaaaattagctgggtgtggtggcgggtgcctgtagtcccagctacttgggaggctgaggcaggagaatggcatgaacccaggagggaaagcttggagtgagctgagatattgtgccactgtactccagcctgggcaacagcaagactctatctcaaaaaaaaaaaaaaaaaaaaaaaaaaaaaagaagaagttaccacggcatatttctgatctcaaaaacatcgcattacacaaacttcttgtgtttttttattgttgttgttgtcttcattttttctttttcttttttaatattttgtcttttctttttaaaattattatttttgcattacacagacctctaataaagacccaaacacttctaattgaaacaaatgtgagctgtatatacatttaagaaagatgaataaagacaagataattatttacccatttattctagttcagggttttgggtggccagagcccatccttgtagctcagggctcaaggcaggaaccagccctggataagacatcattccattgcagggcacactcacacacactgacactcagaccgggagcatttagactcaccagttcacctaatgtgtgcagctttgggatgtggaatgaaactggagttcccagagaaaactcacacagacatggggagaatgcacatgctccacacagacagtggcttcggctggggatcatgttttttttctctaaaacgttatgatgaaatgacatcaaacaaaacaatgttattcaaggacctgctgtactccgtatattttttctccgaatgctaatagtagtaaatgtttcttctcttctaaagaacgaacccagttactaggaatggaacgcatttagcctgcatctggcactgtgtactatacactttttagtcctcccaagagccatgtacaaaaatattcaaagaatgctactttttctatttgcttgttatagcaacagaggagaaactgaatatgaaagtaacttcctgaaatttgcaaagcctagattaaaatattgaccgattcccatgttatttaccttgagaggtggtgacagtggggtactccattgaaagcgctagagagttatagttttactagcttatcattatttagcaagtctgtgcttgttttacattaataatttgcctaagcttcttaactattcagttttctacaaaggtggttattttactatgtcatgttaaatggtaaggaaggtgaccagctgaagttttaggttaccagcttcaactagacttttcttgctctgttttttgttttgtttttaatcttctctttcctgcttcaggatcagatagatgcttctatgaaagaacttttaagtgtaaaggcaaagtataagcaaaaagacgggcaagtaataaaaacttgaagtccatcaagtctaccatcttttgctcctcttattctttttctcctgctcagtaggttgctgcataaaataatggatcaagttggtgtagtgtgaggtgcataacagagaatacaccaaagatataataacactgaatactaagttactttaaaaactaaagcactttaaaacaatttttttttttttgagacagggtcttgctctgttgcccaggctggagtgcagtggcttgatcatggttcactgcagcctcgacctcccaagcaatcctctcatctcagtctcctaagtagctggaagtacaggcacatgccagtatgcctggctaatttttgtattgctcatagagacggggtttcactgtgttaacaaggctggtcttgaacttctatactcaagctgtccgccctccttgacctctcaaagtgttgggattactgatgtgagctgctgggcctggccgtacgcctgttctttgtaaatgaattttttttttgagacggagtcttgctctgtcacccaggctggagtgcaatggtgagatcttggcgcctccgcctcctgggttcaagcaattctcctgcctcagcctcccaagtagctgggattacaggcgcgtgccacgacacctggctaattttgtattttgtttttagtagagacagggttttaccatgttaggctggtctcgaactcctgacctcaggtgatccacccgcctcggcctcccaaagtgctgggattacaggcgtgagccactacacccggcctgtaaatgaagttttattggaatacagccacactcatggtgtacatatcgtctatggctgctttcatgctacagttagagttgaatagttgcaaccaagactcacatagtctaaaatatttattatatagccctttatagaaaaagtttgctgatccctccatggaagaaagagttttgagaaccattgtagttaacagttgtttaaaaatcaagtaacaacaaaataaaatgattattaaataaaaataattcacaattgttttgtcactaatgttctctctctatgccatacccagtctatgtggaggggagttgaatcaccatttgcttctgtagttgcagcattttaattcacggcaccttgtattttatgtccccaataattcatcttgccaatctttgctcttttattttttacaccaatgttattgttttttaaaacccaaaccacagtttatcaggaaaggacatacatccctgtacccttttgtccattaagcaggttgttctaggaagccgccaccctgcactctcaccccagatagctttaagatgtctcaggccaaaagataaatgttgcagggaaggaaacaagaaaaaagcctatctttttcttgatgttgtttgtaattcttatttgggatgtgtgtagtgaattccagctatatctatttagtacttaatgcaaaattgattttgatctaaacaaatataaatacatcttacatcagattatggttcaggatacttcacaagacttacatcagcttggggatcttctggaaaatcttcagaatttgtgttaattgatttgtatcagagaaaaatagcaggtaaattgtgatttaggtaaacgaatcagcccagttgataagcaggagaacaggtgttgtgttctaatttaggtttgatgtcaggatctcggctctaccctgtgctgtattggctcctagaatcaggtttcagtaatcggttattccttacaggtgtaggtatttaagctatgcacaactggttaattattttcttaaaatgcctctctttgcaacctgtgaacttctagtttacttagtctcctagcagactttaaaaaatataatacaagcatcatcactctcttccctcactcagttggaaggattttctgttctgattacctttcattcatccccctcccaaccaagtgagaatctctgctttcaggagtcatcattaccaacgtgtgtagatatagttctcttagatatgctagtaaggagcaaaggtgagtggtaataaaattggaaaaaacaagtttgaaaaaagtattttttgaaaaaagttttttcatttagaatcgagatatccaggctattttgaaaggttctagtatttcaaatggataatgttccaggtttttttttttttttttttttaaggtcactcctttccccatggagaaatgtttccatctagtggctgctgaaaaaatagctgtttgagtactcattctgaatgtaatcagaatgtaataaaaaaaaattgtccattttctccattttatttaactttccagtttttagtcataacattagcatcacttttacttatttccaattcccatcttaaacctttaccaaagtcttttgtataggttgtttcttttctcattaatccacatcagcaattatttgctgaaaaccttttctgtttgtattggtatatgttaggtaagtttaaaacagtctttgtccactaacaacttaaaatctactagcaatgctctctcagcttctgctgttgtatgatattgtactaaatcatagtataccacccaattcctctttgtaaatgccttttgatccagaaaactagtatattaagagataatttgttctccatccatttgttcttcattgtgtattctaagagataaattcaaagtaatagtcaaacatctctttcgaaaagcagttttcctagcatgttactaggattaaaatgcacatttagatctttgttttctgtaatccttagcaaaccgtagtggtcaagatcacagcctctggaataaactcgggattcaaatactagctctactacttattgtgtaactctggggaaggaacttaatctttctaaacttgacaacttctctaagggttgttttgagagttaaataagataccacgtaaagcacttagtgtagtgtctggcacagactaaatataccataaaatgataatgatacttttcatattataattcaaattctctcaagaatctttaggtaccttctaaatcatcagggaagattgcatagtggtgattagtataattttactctttttggaagaataacctgagtaatttacttagttatctagaatattccatttcctaatgggaggggaaatatatgaatacatagctttattaagagtatctcattgaataacagagtggtttgctcaccttaattttctcctttataacgtttcaaattataatcttggcgaacggggttttttttttttttttccgtgtgaaaagtgtgccatctgactttaagctctaatgaatacctgcttatagtgtaaaatggagcttctttcaaatagtcatcaaatagtcatttttctagaaatagttgcagggaagttccttcttttccatttttattttagctggtggaaatttcccttttttccccccttgattctcatatgtctgattaacttggccgtttttcttgagataaagtagtttctgctgtgaaaactctttcctaaaaacagaataaacaagagacacaacaggagtacaaatcagacaatctactctcatcttctctttgtacattttctcttaattttactacctttgtgtggtacctggtatgacactctaataggcagaaaacgttataaagtagctggacaaggaaatgtgctttgctgcctcatagatgcaaattttgtgaaggtataccattggtatcctgcattcctctgatgcccatttgagtattcttcatggcttctgcctggtttcatttagctatctggagcattattcgaatgtagcagtaaaaattggatagggtgatttggagacacttttcctatctattttgattgatacctccaagttcccagtggtacactggtttgtggtgagatagtagcaccatttcaggtaaggtgtccagcttgggccctttgcctgtgttgctatcattctctgctagagagtcacaagtgtctcggtggggctgagtatatcattcttttttattattatgttgaagtatcagattaaaatatataggtaagtgtctaaaaacttcaacatgctttctcatctcattgtcagtttttaaaattgatataactattcattagttggacccaaacttcctttttttccccaaagttgtatttaatttctgtttaataagctgtggaaagtaaggtttgtataggcaaagccattgatctgatctttgttctgattttgtaaattctgacttcactatttatagacctaggtcttgacactgacagtttacttagatgttctattatttgtctgtttacttaagtaaaatagaaagttacactgttgtatgttgaattgtatttttgtttattcagcttatatataatttatgtttttaatttagctttatcacttattgtaggctgatgatttaacataggtttccccatgattaacttatgggaatgatttgctgataattaaagatttttaaatggcattgaaatttccagaaatttccaaagttttataaatatctctttctctcttttattttaggctaaaataaatgaagctgtagaatgcttactgtccctgaaggctcagtataaagaaaaaactgggaaggagtacatacctggtcagcccccattatctcaaagttcggattcaagcccaaccagaaattctgaacctgctggtttagaaacaccagaagcgaaagtactttttgacaaagtagcttctcaaggggaagtagttcggaaacttaaaactgaaaaagcccctaaggttagtgtgttattttgtttatatgcttttgttttttatgtttcagggtattgtctttgcctcaagtgttttgtgccccatcaaatctggctaacttctactcatatttcagttcttaattctcttaccttgccttttagagaaactttgttgattgtttcttacgccaactagatttgattggatgttttcatatgacaccgcccatcactgacatagtacttaaacagactgtattttaattgttaaattgtttgtttccctccaacctgtaagatccagaatagtgacctagaccctagcacagtgctcaccccattgaaggcccttaatatttaccttgtttttcattctttctcctaaagctctgtcaaactgaaatagtaggttttattttgagctcttagtagtttgtgctagttctttaagtgtgaattctgttatctttttaggagtaggtttttctgtacagattcacatgagtggaagacagttgtagttttgaaatttaactttattagaacttgataaccattatctcatctttataattgtgaaatgttcaacttatgtaatttaatggctcttaacttagattcctatggaatacatgttagataccagtgctttctagtagaactttctgcagtgatggaaatatgctataacaatattgtctaatacagtagtcattagccacatgtggctattgagcatttgaaatgtgattgtggtgactgaggaagtgaatttttaattttatttactttaaattaaattcagccacatgactactatttggataatgcagttatagactgtgctgttttccagtcacagttttgcacaattctatccctgtttatcataatctttataatttcaatagttggtgtaacacctaccccaaacccctctgtccccaaacccctgtctttaattgtgtttgcagatctacttttaaactttggacagatccttttgtagttcctaagtgtgatggttgggttttcacactcatatgtgagatatgcctccctcaaaccttatcaccacctgggcacattccccgtgtgatattggcggaaaaaagaaagctttgagcattgtatttgtttaagtgtgcttagacaatgacttgagttaaatactgtcttctctttttcctcttttgttaaactaaaggatcaagtagatatagctgttcaagaactccttcagctaaaggcacagtacaagtctttgataggagtagagtataagcctgtgtcggccactggagctgaggacaaagataagaagaagaaagaaaaagaaaataaatctgaaaagcagaataagcctcagaaacaaaatgatggccaaaggaaagacccttctaaaaaccaaggaggtgggctctcatcaagtggagcaggagaagggcaggggcctaagaaacagaccaggtaatgaatcgcagaaacttcatttgaagcaaagcagtgaattaattcaattcttaatagtttttaaaacaaattttgactggtttaaccatcacattaagttagagaacgctaaagctacaatgtcagcagatagcatttattgattttccatttagttttaaaaataggtaacacgtttgtttggttcaagaatctcagaatgtaagaagttcctgtgcatgtttcccatctttccggttttccccaccaccgtaatcagtcagtagccactgttaacagtttcttctgtatctgttgagcgattttcatttattattcaagtaaatacagatacacacacacacacacacacacatacatattttctctcctcctttttaaacatgattggtagcctaattatacacattgttttgcaccttaagcagatttttttcagatgaagatcttttgtggggactaagtgagagcttcattctcaatttaaaaattgatagtttaaatataagacaaaactgactaaagacaaaatggttggatagagggctctttaaggatcttccaatctgtataaataatgtacggtcatacaccacataatgatgtgtcagtcaacagtggactacatatatgacattggtccataagattataatggagcatgtatggaaacctgatatatggcacttgatattggcatcgcagatcaagtgggggaaattattgatattcagtaatgttgctgggatatttggttttccatataaaaatatatgtatatcatctaggtttgtgtaagtacaagctatgatgtttgcacaatgatgaaatcacctaacagcgtatttctgaaaatgtattcatgtcattaagtgacgcataattgtaattttttatctgtttccacaattacagtgaactttgtgatgggtttcccttaatggcttacttaataagaagaaaaagctgttactgagatactttggttttacatttgtttagctgagtatcaaattttgctgcctcttagctctcatgtcatatacacaatgtctctttaaacaagagaatgcaacagttatttttccttttgactattaaactgaataaccagagttatagcagggtagaagagaatgtagaacttctcaccttttactttcttagtgcctgtgaaagtgctaggtttcacagagttattttgttgaggtatgtcatagtgaaacaatggagaatgcaaatgcaaatacattaaaatttttagccagtaaaaccttgtttttaaactccaaaaagagaccatctctatcctgaataattgttgatatttcaagaaaatgattattgtctgaaatagtttttttattggagacctagtttattttacaagcatctatctctgcaacttttattctagttaaaagaaaaacttgaggccaggcgtggtggttcacacctgtaatgccagcactttgggaggctgggatgggtggatcgcttgaggtcaggagtttgagaccagcctggccaacatgtcaaagctccgcctctactaaaaatacaaaaaaattaaccaggaatggtggcacacacctgtaatcccagctacttgggtgggggaggggggctgaggcacgagaatcgcttaaacctgggaggtggaggttgcagtgagtctagattgcaccagtgcactccagcctgggcgatggggtgagactgtttcaaaaaaagaaaaagaaaaacttacataaatttggctaatatgcacacatcagtacacacacatatgtgtgtgtatttatagccattgtttttattactttttaggtgttactttcagtgaaacagtgatcttactataattttaactggcataagattcttcttttttagtgggagaataggtgtgaacaggctgtgtctctattacaaatacattgccttaaaaagaaccttgtaaaagagatgtctgcatagaatcatagcttttgttacatttggctttcctagattttgtggacaatatctctcaactttttaagagatgtctctgctgtttttgtttctttcttttttttttttttttcttttgagacggagtttcacttttgttgcccaggctggagtgcaatggcgcaatctcggctcactgcagcctttacctcccaggttcaagcgattcattctcctgcctcagcctcccgagtagctgggattacaagcatgcgccaccacgcctggctcattttgtttttagtagagacagggtttctccatgttggtcaggctggtctcaaactcctgacctcaggtgatctgcctgccttggcctcctaaagtggtgggattacaggcgtgagccactgtgcccagcatttctactgtttttttaggttaaaaacattatcttaggggctaggcatggtggctcatgcctgtaatcccagcactctgggaggccagaacaggaggattgcatgaggccaggagttcaagactggcctgggcaacatagcgagaccctgcctctaccaaaaaataaaaataaaaaaataagccagatgttgtatgcacctgtagtcctagctactggggaggctgaggtgagagaatctcttgagctgaggagtccgaggttgcagtgagacaggatcacaccattgcgctccagcctgggtgacagagtaagaccctgtctcaaaaacaaaacaagaaaacaacaacgttatcttgggaatgaatatagaagagttacaaatacagaaataactcatactgaagaaagactaatctattttgaactttagaggtttatttttattcaacctaaagcagttgctgaatgaagatatttatcttttacttttcacatctgcaggttgggtcttgaggcaaaaaaagaagaaaatcttgctgattggtattctcaggtgagtatgcattcagttgatttttatgttttaagtctgtcaatggctgctttttatgttcagattctaaaatatgggcacaaaggcaatagtaataatgttgtataatgcctttaataatacacagtgtagtcatttaacatgacattatttttcaacatgttaacataaagtcttgaattgaaaagcagtaccatgagatagtgattgattttttttttttaggtgagataaagggattaattcaaagccacaaagatatagtcaatagcagaggcaggattggaattcaagttttttttttttttttttgagacgggagtatcagtctgttgcctaggctggtgtgcagtggtgcgatcttggctcactgcaacctccgcctcctgggttcaagcaattctcctgcctcagcctcccgagtacctgggactacaggcacacgctaccacgcccggctaatttttgtagttttagtagagactgggtttcaccatattggtcaggctggtctcgaactcctgacctcaagcaatccacccacctcggcgtcccaaagtcctgggattgcaggcctaagccacaatgcccggtggaattcaagttttatggagagtttggaaccctgttatatgttgtttttcagtatagtcaggtctgttttacttccattatgacctcccacattaaggggatgttatcaacagtagaagcctccagatttgaattttggttatcatactcttgccacttatactagaattttggttcaatgtaagctttaaagactatttttcttttaaaaaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgttgctgactttgccccagaggtaagtgagcttgcttttttattttttgcaatgttctctgacaaactggaaaatatattttcaacttttaacaaccaattttgaaaaatataaagccatttttattaaaaagttctgtttctacctttatagcaagtaatgattttgttacattaattaactgacttttaatatttagaaggtcagtaagtgcgtacctttcctcacagtgaacagcagcgactattttaacttgcctaaattgatatagcaaaaattaaaacagaggaaatttgcctgcatttgtactgttgctccaaaatgctattgaaaaaaaagtatgaaaaatgattttttcttactaggttgcttgggttacaagatctggcaaaaccgagctggcagaaccaattgccattcgtcctactagtgaaacaggtgagaataggcattggagtgcaagagaatgctcactgaacgttagagacagcctctaaagttgagtctcagcttttgctttgtgatagctataatctctgttgacgatataacatttcatgaatgttgatgaagattgaatgcaaacttaagttgtctagagttttattctctaatattcattgtagagctccttatcattaaattataggatttttaatttaaatactcatttttatgctgtaaatttttaggacttttcaaggagttttattcttagaataatttttattgttggaattgattataatattgcaaatgcaatttttatgccataattatttttaaattttaataatacatttaggtttgcattcatgtagggtgttcataggttgctaagtacttttacgtcatctcgtgttattcttacaacagtgttgtgaggaaggcagggaaagttactgtgatttccattttgcaggtaaagaaaagtctctgaaagattaaatgatttttctgaaattacgtatggtaaatggaaatgctgttggaaaatttgaggttttgggctttacagtgtctttcaaagtgatcattcatctgtagagttcaggattgtctgttcttattgatatttctagtgatacttttgtataatacattattaatattgtgataccagtttttttctctcagactatttggcaaagttttgtttgttttggtttactaattatagatcatgagcaggctattctaagacaggtatcttcactttgcacttcattgcaagagctttcatactctgagtagatgcatcagatataaattaattctgcttctcatacataactgctggattcagcaaattgtttagcttctataaactcagctttccacgtctttaaaactgagttatgataccttcttgtgggttgaatgtgagaattgaacaggtcaatgaatgcagagaacttaacatagaacatgacctttatttgtgtttttaaaaacaaaatgtgaaaaccgtcgaagtacattaactgttatgtgaagaatgtaaaatctgtgaagaatgtaaaatatgatcaagtttagatttgtatccttgagtaatacacttcatgaaatagataatactattcacttattataaacattggaaatatatttacacaaacatacattttatttttcaaatttatttattacattttaattcctattaattatcttgctggtttagctgttacatccctaaaggagaaataaagccttaaatgactgtctctattttcccgtgtctttcagtaatgtatcctgcatatgcaaaatgggtacagtcacacagagacctgcccatcaagctcaatcagtggtgcaatgtggtggtaggtattcaccccctcttgtattctattattattcatgttctttttttttttttttttaaagcacattttgtttttattttcaaaggattgggagtatggaactgtttttgaagtatttaagataaattgtaatttttgattacttattatataaaatggtaataaaaattggaaagtggctgggcgtggcagctcatgcttataatcccagcactttgggaggtcgagccgacagatcacttgagcccaggattttgagaccagcctgggcaacatggcaaaaccacatctctactaaaaatgcaaaaattagccagctgcattggcgtgcacctgtagcccagctacttgggaggctaaggtagaaggatcatttgagcctgggaggcagaggtttcagtgagtcatgattgcaccactgcactccagcctgggggacagagcaagaccctgtctccaaaaaaaaaaaattgaaaagctctttataatgactaaattgttttcttgcctcttccagcgttgggaattcaagcatcctcagcctttcctacgtactcgtgaatttctttggcaggaagggcacagtgcttttgctaccatggaagaggcagcggaagaggtataaaaagttattttccatattaactatgttccattatttttgttcaggttctgcaattttgttatttaaaatgtatgtaacacctgttaaaagcaaaatcaaattaattcaaatgttcatggatttaagtaactgcttattggaatgttattattaaggaaataggctcttttaaatttttaggtgaaaatacttctggactttaatgtgtagaaaaaattatttttcaggaaatttgcattttgatactgtatatctttcttaacatttattttctcttatattctaaacatatatacattttaaaaagttatttgacttctttttacattgcttcattgaatatctttcttaataagttcacactggctgctttaaccttttcataaaaagaggtttttattgttcagattgcttttcccacacaattagtcttaagtagtgcagttttatagatcttaatgaataaatgtaccctaaatttgaacacatttacatttaaaatgttacaggtcttgcagatacttgacttatatgctcaggtatatgaagaactcctggcaattcctgttgttaaaggaagaaagacggaaaaggaaaaatttgcaggaggagactatacaactacaatagaagcatttatatctgctagtggaagagctatccaggtatcaaactgccacacaggattcgtaggtcactgtaagcacagtccatggacagatccaataatttcttctgtcatcacagaagtagactcttaaaaaataagtgtttcatgtactttcgtataataatttcaaacaaatctatcccattcctctgtctccatggttcgttaagtcatagtatgtatcctgaattactactaaaatatgaattcctttttaactgttgtaggtaaaattactgctataaaaggggctgcccagagcaaaatgcttgtaaatagtattttttgactaatcttaatctcttattatggtaattatgcttataattaaaaaccttatttaatgtaaaaaaagggagaaaaaaagtgtagtgccattttaaagcatgtgatcttatagtaatcattttcaagggcataataggttattaaaaatgaagcttatttttctctctctattttagggaggaacatcacatcatttagggcagaatttttccaaaatgtttgaaatcgtttttgaagatccaaagataccaggagagaagcaatttgcctatcaaaactcctggggcctgacaactcgaactattggtgttatgaccatggttcatggggacaacatgggtttagtattaccaccccgtgtagcatgtgttcaggtaaggaaaatattcctgtttatcactcattttataaaatacaagccatatttactaaaggaaatttgaaagggtgattttctgaatatcattcaggcagatttctctgataataaaaacaacgtggaatgcagtctggaccctagtgttttgtgactgtgtgtattatttatttattgtttcttactcttttaatttttaagctacttatataaacatttttagaagtcattttttaaaaacggtttatagtatgttaaatgagctgggcatgcaggctcacgcctgtaatcccagcactgtgggacgccaaggcgggcagattgcttgagcccaggagtttgagactaagcctgggcaacatggcaaaatctagtctacaaaaaattagccaggtgtggtggcatgcactgatagtcccagctacttgggaggctgggggggaaaaaaaaatatatatatatatatatacacacacatatgaaaaatagattaagtgaaatatagtgggtcagatgaaaatgcatttagcacgggtaagtgatttgcaggtaattagtagacattatatataagattagaaatcacacagctgattcgtgttaataatatagccactggtaggtttcgacttctgagagctcattacttctatatctgtttctttgcatacatttgggacattgtgctgattctaggtggtgattattccttgtggcattaccaatgcactttctgaagaagacaaagaagcgctgattgcaaaatgcaatgattatcgaaggcgattactcagtgttaacatccgcgttagagctgatttacgagataattattctccaggttggaaattcaatcactgggagctcaaggtaaattcctaagctttatcttttacccccaacatctgcaatttgagtttagattttcctctgcatgtttttataaaacgaggtttctcattactttcctctattttgatagttgtgagttttcttcttcttcacttaaactgttgagcactgacacagttcatagctttgcaatagtgatacctaaatttaaaatagtttttgtggaagcttatttttattatgttagaataaaaacgatctcgagcgcttgtttatgattaccctcacgtaactagtatactaaaatgtttatgccaggaattcataaaataaataagttatttacatagaccaccagaataacagtacatggacatcacttagctgtgtttgttatagctaatagtgaaacatctgagattaattttattcttgagttttcacaccacattgtttcataccagtttgttgatttttattttgtttattaaagccagtctaaattctgctttattgtttgtaatataactttcatgtattgcacattgtcattaatagattatctgtggccttaattctgatttataaacttacaacatttttttcttatgctgaaagagggaatcttactggatctagaaattaggaatcgagactatataaattgatattataggtgacagtatgagagaatgtattgagattgcagctgcatgctttcaaactatggaagctcagcaatattgggatttttaggtatttatacatctagggttcccaaagttgctaatatttatcatcttatttgtttcacattgcccctgaggtaaatttcctgtgctgaggaatggtaattatattgataattgtttcccttttatgtaatataccagcttctttatatgcttttctaaacatgattttttttccatgtcatttcctttttaattgcactcctttttgcttacttataaatagctattgtgtgatgccagtagcagtttctctaaactaatttctacttaacctgggctataaaatgttaaaggagaaatttactgctggctactagcgggattaaaaagaaaaaaccatccacgttcattcctgaattctttgtaccctttcctcttttattcatttctcatccttagactgacttggctttgtctttgtcactcttcttttagtactctagtgagcctatactatgctggggaggtattcttagtatgagttgggtcttctacagcttcgttgtctgtattcctcaggaaagaaaataaagcacctaagttctaaacttgacgcctcaagttaaagaacattgagaaagagagttcactatctagtgaaggtattagttatactttttaatgccattttaattccatttagtcaaagaatttctaagaaaaaatattttaggagatctggatttatatttatttgacagcgattgaccaaagtgtgtgagcgatgtgtacgcgcattttgaaacttattcagattaataaatgagctataatattgtttgattgtgaggccagaacccagcaactcctgtaattcttctttggtaccccttcctatattatgaaagtataaaggggaaaataatctgagtgaattaactacttttctttttactatgtggaaagagtaagataattctgtgttgctatagaaacaaaacacgaatcttttaaagttaaatttgtaactagttttagaaaaaaactgtcaacaaaatatttgcctcctccatgatttggcttcagattacctttccaactttcacttttcattatcccctttcatatgccgttttctctcttcttcacagacagcctgtttttccacctctgtgtctttacttgtgctatttcttctacctgggttgtaaaatttttttatcatgcaacagtcaccaacttataacaaagcaagtccaatacaaataattaaattttcctgcttgaatcatttgaaaataagatgctaacctgatgctccatcaccctgcaaacatactctcctacataatcacagcacaagcaacatagtacaaccaacatattctcctacataatacaatacaagttagtatagtagtgttcatacattacaatagtctaattctagacccccattcagctttcaggagctgtctgactagtgtttctttatagcagaatgacctagttcagaattatgtgttgcatgtagttattatgtatctttagtctctttcagtctgcagtaatttctcaggttttctttgattatcgtgatcttgacacagcacattttttattagcctttctattagctaattcatattttatggatccatggtttccagtattaagcactgggttatagaatctgttactgacgttatttgttttgatgctcaaagtgtcttcggcttgaccattaggatcccttaaagctggcttttgtgtccttttggcattctccatcattctttaagcacttccttgctgcttggcacaagatgttgtaggcttatcttgtactttttctaccctggcccaggaattagccatatctctaagaagctctggttcttttgagtggagaatggtatttagtgctgggtatgctcattgcttttgagctatcacttctcccgggccttctcagtagatggagctactgaatatgtatatatatgtagatatccatacacacatacagatatgtgtacacttttaccaccatatttccatatctatttatgtatgttgaaaaccaagagtttatatctatactttaaattccaataaaaaaccatagggtggacctggcgtggtggctcatgcctataatcccagcaccttgggaggctgaggcaggtggatcgtctgaggtcaggatttcgccaccagcctgtccaacatggtgaaaccctgtctctgctaaaaatagaaaaattagatgggctttgtggtgggtgcctgtagtcccagctactcaggaggctgaggcaggagaatcgcttgaacctgggaggcggaggttgcagtgagcccagattgcaccattgcactcctgcctgggtgacaagagcgaaactccatctcaagaaaaacaacaacaacaaaaaccaccgcaggatgcattctagtttttctccattttgtgcttgtaattcccttttctgacaatgaaaagcctagctcaaattatccttagtacatgaatttattagattagtcaccctgtatgccaccaatctctcgttgccattgccaccccctcctctgcgtgaatgggctccttatccctcgtgggctctgtcactctatgcaaagctgttctcatgtgcagatgccctcttgcctaactgaggctcagacaccctgctgtgggctaccagtggccctctcctttttcagtgtaggatccagtcctattgcattttgccatcatgccttttagttttctttaatcagaagtagttcctcagactttcattatcatttatgacataggcatttttgtaactataggtcagttttttatagaatgttttttaattcggacgaataatttacttattaatttttaccttctccagtaacttttcttctctcttccagctgaggaatattctctcactgctaactttctgtattaatttttgttgtttatatgtgtgccttatttaccctacaaagcatgaagcttctagaggacaagatgtatttcttattcatcttgtaaatctcattgcacttagcactgtatcttacaaatgcatgtaatacatccagtataatacattggataaataactaaagcaataaaataatgtaatatttagcatacaacagttggttccattgtggtttttttttaaatatcattttgtaaaataagtcttccctaggggtaaataaggacttctagagtaatatttaaaatttttcctatggcatttttggggtgaccacctgtcatctaaattgtatatggaagcatgtaactcaggaaaatcccaagttaattttagaggattattcattcaaaaaaattacttaaaatctactatgtatcagataaggttctgggccctaaaaatgtggtttttccctaagccttaaggattttaatccccttacgggatacacattcacaagattgaacattcccaagtcgtaaacttgcatatagtctgtccttaagttgctttggaaaaaccaaagagtataggggagtggttcttaaactgtggtcctaggaccagcagtgtcagcatcacttggaaacttgttagaaatacaaactcttggccaagtacggtggctcacgtctataatcccagcaatttgagaggctgaggccggcagatcagttgaggccaggtgttcgacaccagcctggtcaatgtggtgaaaccccatgtctactaaaaatacaaaaattagccaggcatggtggtaggtgcctgtaatcccagctactcgggaggctgaggcatgagaatcaattgatcttgggaggcggaggttgtagtgagccaagatcatgccactgcactccagtctggtcaacagtgagactctgtcttcaaacaaacaaaaaaaaacaaattctcaggtcgcatccccaacctactctaataaaagactctggaggcaggaccccaaaatctgtgctttaacaatccttataatcataatgcatgctaaagataagagtacccagaatgaggacttttcaaccagagaataccactgtatcaggaatgagtcaaaaatgtgtcatgttactgatcccctcagtggcttgtagcctcaaaaagtcttcgtttaaccccattcctatgcaaatacgttttctggatgctattttgtgagaaaagttgggaatgctggtctagaaactactctgtttctccatgaagaacttctggggcagtagattttttttttaggtttatgccttcttactggaataggtttctacagtatctcagcagtattacctgttttttttttttctcttgttttttttggctttgcctttgttttttgggttttttataatttatggtagctaaagccatgaattacatctgtatattcaactggagacattcatatatcattttaactgccttttttatcttatagggagttcccattagacttgaagttgggccacgtgatatgaagagctgtcagtttgtagccgtcagacgagatactggagaaaagctgacagttgctgaaaatgaggcagagactaaacttcaagctattttggaagacatccaggtcacccttttcacaaggtagtttcttaaaattgcttatgtctctctctccagatcttccaccacctttgagatctttaccaaggaatttttggggttgccccaattggaagcaattgttccctccctctgaacccccatgctacttaatttgccactctctgggttttttacttgtattatggttatttttctaagtgccacctgcttcctactaggtttgcaacaatgaagtttctgtcccctggactaatttgggttaatttaaatctaggcttttatgagatataaatgtgagggcttcaggcattgactgtcatctgctgggtacacattggcagcacctgggaagctttagtaaataccagtgccttcctagagatactaatttaattggactggagagggcctggaaactatactgttaaaagctcccccaggggattataatatagccaaggctgagaacctcctgactggggttgggaatgagggatagaggaaggccttagggccgccctcacctatggagagagtcatttagaatcatagatctcaaggtagtcaaggcagaggcaccagaagattagtggcttagcgtggcaccctgttttctttctctgcctacctggagcagaaagcagagaggaaagcccactaccactgaggatggaggtgcagtttgggagagggtaatgcctgcatcttatataagggcacttatatattgataaaagatatatatatattcctctgaatctggaaatatttaagaccagggaggtttaaaaaataacatagactcccataggtaatgtgttaatgccaggaaaagaatgatggtcattagagatttaacagcagtaacaaaagttatgatcacctgttgtgtgcttaacacatttcccatgcatttaaggctcacaatagtgcaatgataaggtaactctgatatactgatggtcactatgagtgatagacttgagattcaaattgagtccttctcactcccaggttgtcttttcattaaattgtgcttatgtgtttcataaaactttgtcatatttgtgagaacaattatgtattgttttctaattttgtttggtagggcttctgaagaccttaagactcatatggttgtggctaatacaatggaagactttcagaagatactagattctggaaaggtcagagagtttggaaaacttttcagtataagaatatttaagtaaattgtattttaaggctcattgaatttatgcatggtattaatacctttttaagccaatcacataaaaagatagtacattactcaacatttatatgtacgtataaatatataatctaattatatagtctttgttttacatttatatgtcatataaatatataatctaaatatatagtctttgttttatatttatatatgtcatatataaatatagtgtgtgtgtatatgtatatatatatagtctttgttttctactggcttttctaaagcattacaacattataccattttgggggtaatacttgtgaactgattatgtaagtttttttttccccatgtttgatatgctactttctaaagaacattaattctgtatgtctccttttttctttattgaaaatctgtgttatttcagtttctggtaagttcctaaagtaaccattgttctagctttagagctgtcatatgcggctgcctaaaacaaggtgaaaagtcagtttctttccattccctgactgtacatactcagctctcaattgattgaactttctgaataatgagaagaaaagtgttgcttattctaagcctgtttttcataatgaggggctacctggctccttagaactccataggctttcctaattaggtagttaatggctctttaagatttaattgattttatatattgggtatatgcagttgtttcgagctgaaactttaaagtttcataaagaagaatttcagatttgcaaagttatttaattattggaatgaatcacttatggactttagtattctggtatacatgtttgaatatacaaccaatcctgtgtcctcaggttacaagtgagaaaaccatgggccagtgtcttaaatgaataccccaaactatacagaatttagatcactcttctgactaggtttaatgcattttcctctgtatctttttttgtgttttaaattcatgctgagaatgagcatgaatttatgtaaagctttaatttttatggtcataacgtattaatatgtctcttatttcttgagctgggaaaattaatctctctggctttcattttactattctgtaaaatgagtacaaaatagataatatcaaaatcctctttagatctataattcttcagtgtttagccttctatccttattgggttattgcttttgtaatttttcacctttctggtttctgtagtttttcacttgactcaaacttcctgcttttttttttttttggtacagggtcttgctttgttgcccaggctggagtacagtgccgtgatctcggctcactgcaacctctgcctcccgagttcaagcgattctcctgcctcagccttccacgtggctgggattacaggcgcctgccatgacacgcagctaatttttgtatttttagtagagatggggttttgccattttggccaggctggtcttaaactctgacctcaggtgacccacctgccgtggcctcccaaagtgctgggattacaggcgtgagccactgcacctggccttaaacttcctacttttaatagaaggctagacagtgggtagccatctgtagcactgtgttttttctttcactttatttacgattttctgtggctgagagcagttgatgagaagctgctgaagaagctggaagcatgttgctgttactgccaatgtctcttgggtctccaccttcatagatctctagattttcagctgctttacactgtatttctaatatgtggagattattcacaactttgctattcccctcattaactctccaggaatattttatagggctactacataattgttattgaagacaaacctcattttgaagtagacatgctttaaaaattagcattcacaactgggagaaattttaatacttgttggctgggcccggtggctcacacctgtaatcccagcactttgggaggccgaggtgggtggactgcttgaggccaggagtttgagaccagcctggccaacatggcgaaaccccgtctctactaaaattacacaaattagctgggcatggtggcacacgcctgtaattccagctacactaggaggctggggcacgagaattgcttgaacccaagaggcagaggttgcaatgagccaagatagtgccactgtactccatcctgggtgacagagtaagactgtgtctcaaaaaaaaaatttttttttaatgcttgtctagtctgacatccacaatttattaaaagaaaacccagagctagagattttcaaacacatggcaaatttcaaaattaaaataaaatcctaagtatcttgattcggcctttgttttatgtagtctaagaatgaaaaattgaaaggtttttttttttttccttacacaaaatgattttaggactttaaaaatgatccacttacctatataacatgttaggaacattgtggcataaagtgaaatttgcgtgattgttaattgttgctgttaacaacacattaaaaatcagtttgctatttttgatgttccttttctcctcctgataactatttagataggtagagcaggtgtagtccaggtttgaaatgagggagatataactggagttcaacttcttttcagccactgtgttttagccagtttatgggagatttgagggtactgcaaagatgtctttgttgtgtcttgatgtgctgtgagcgtaggttttggatagtggaaaaacattctttcctatcttttataactgagcaaagttcctagtaggtttgcaaaggtatcatagcctgaaaaaaggttgggagacctatcctttttgcttgccagtttaatatagaactcaaatgttccttctgcagaatagaattgaaggagttataaatactgattacttttccttttcttaattagattgttcagattccattctgtggggaaattgactgtgaggactggatcaaaaagaccactgccaggtaaacctaattaactggcaaaacttttgaaaaattgcaatggaaaggaatagcaatttgcagcataaatgagtggaattcttatttgttattaatttcagggatcaagatcttgaacctggtgctccatccatgggagctaaaagcctttgcatccccttcaaaccactctgtgaactgcagcctggagccaaatgtgtctgtggcaagaaccctgccaagtactacaccttatttggtcgcagctactgagggatgaacgaaagccccctcttcaactcctctcactttttaaagcattgatattagtatcttctcagatacagaccgttttatgattttttaaaaagtaaaagttctaaaatgaagtcacacaggacaattattcttatgcctaagttaacagtggataaaagacttttctgtaaacaactccagtaataaatatcatgaacta

SEQ ID NO: 35690 - DNA, 11461 bp, Homo sapiens
gaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcgtaagtggccaccgcgtagccctgtcctggcctcggttgcgccggactcggaggtgccttccctgtttcttctccctgccgtcctcccggccgctcagccccctgcgccgccctcgccttcccccgcactggttccggcgcgcgccaggccgtgtggcctctgctcagcgtcggctgcgctgctgggagctggcacccgttcggcctgccctgcgcgggccactcgatccctcctggcctccccgcctccggcgtggctgggcaaggccacgccaaggtggggggtggggaggataaaattgtgttctgcgggttctggaaactcaccgcccgcgggagggtttgttgtccatttaactcgtcttagtaaactgtgcaggtagcgtggtcaggccgagggcgcaggggcggggcggcattgacgatcacttccccggactagtgcccagggtcgcaccgccctcccaccctccgttctggaatttgctccctggggaggatgggtgtctaaagccaaagtcggaggacacagctgctggctataggttacaggaaggccaacgtatcatctgagggtgcagtggtatttgcaggcttctgggcacaaaatgtgaaatttaaaaccactagctgccaagtaggtggccgaaagactttttgtccagagccgcctccaatggccaagatatgatttgataacagctttaggaagagccaagaacactctgcgtaggtgtgccttcagagattccagaacttgcaacacttggagggaaggactttctgacgctgttccgctggagtggcctattcttgctagtgatggccgttccaggctccaggacacgtgtactccccaactttgagactctcttgttttccagtggcttgcccctcactgtcccctccgctttctaccttgcttctagcacatgagcttgctgatgatagccaaattgatgacctgtgatctgacttggcagttttaccattatggataggagtagtaaatcggtgttgcccttttttttttttaacagctcctgaatcagcaaactggaagttgcttagttttcatcagaagcattccaggcatgtctagttatattatggttctggagtactagtggtcccactacactgtggggctccaaggcttgacaacagttcttccccagattatatcctttttatatacagtatccagggagacaggcttatgaaattaatcagtgattggacagggctgtgcagagaaccagggacagattcttacacatcatatgcctatccaaccctttataacctcttaagtcccttttccagccactgaatagggaaaagttaagctttgtgaaagataggactaggccagaaaaaggttgagaaatggaatattcaaaccttgaatgcagaaaaatactttagaaatacagcttatggccattcttatacttaggatctaggtagtaatatttctccagcaatccttgggatttttagagttgtgttccttcccatttctacctgcagccctcatcccccatccccatgaaacataaactatttccagaactcttagcttgtatagattaaatattagcataaaacgtatttactgtgccaacagttataaatgctgtcactttttaagctaaccatacttttttggggttttgttaatgtttattggcctctagatccatctagatttgatcaaaagtggtactttatcagggagccatagttaggaacacggtagaaatatctgcatttattaactaatatacaagtctgcctaggatcaggtatagtattccctaccttaccgggaagagaagtttgagccttttatatgtttataacacatggatttttgcctgatttttccaattttctattctgtatatgatcccaaatcagactgtcaatttttgatccaggtatttttgagaagaaaaaattaaaatgtatttctctaccttacccctgatcattgtaaacaactaaagaggttgggtgctacattgggtgagtttaccttatcgctgtttctttaagtggtagaagcagcttcttcatagtacatcttcactaagcaaaatatgtgttttccaggggtcttctggggcttagtaagtgggaaccattctcttgaaggaggaaaccttttgtcttttgaaaatgggtaagaaaatgggagcatgtcactgaattactcttaagtgcagcagtaggaagacttggaggggaaggaaggccaaggtaagacattcttggagtttatcctatttgtagccatgaggtaaactggagtttcacttctgagggagggaaggacgtgaactggcttaaaaccagttccttttgcatgattcagcaaaacagtctttatggactcacagtggaaaaagaactcctaacttttctaatttatcctccttttaacgatagaggaggaaacgccctgttccatttcttctcaacttctggagaccttctgttaagtctcatctaaccattaaatagatcgttttccatagaatctaaggcctagattttactcatagtgatattatctacttcaaaagatatactctatgttcttccttttgcccttcatagtaaagtgaacatagtgcacacctccacaatcttaaaaaaaaatactaactttcctcccagtcttgccatagggccctccatcctttttgtaagaagatctttttccttcttgaaaccttgggagttgagtggcagccgtaagtaggaaggaggtgcccttgtctttgcttgttctctgtgctcagggaaacttcagaaaggtcaacttggcatctaggctagatttagttatctactagtttaggatcctgcctaaatcatctggtttaggatggtttaagttgatggggatgtggagaactgagtgttaaattttccttttcagttgaaagagtagtttctgttgccaagaagaaggaaatggtacttcagctttcttcgtgacagcttgaaatgtgctcaaaattataaaatcttagacaatgatgacttagatattagtatttacctaagaatttgctgttgtagaaatctacattgcaggctatcaaaattctacctgcttggtctgaagaaagaagaaaaagaaactgcaaatgaagagataggtaaaactgtgaaggtgctattgttttgtcagagtataaatattgggtgtcatgtttggcaggtaagatcagtaaagtggttttacaaaagattttatatccacttgcttcagagaagccaagtgtcaactttaatttttacatataaatagaagatagaaacctatttatttcagattacataatttgtttattattgcagtcaggcatttgtttggattcagggcatactgggacatccattattggagctgaatgtcagggtctatgctagaaaaaaatgtagaaaaggataagaagaaataattaagtgttttcagtgaactacttggcttgaatagcacagattgtattagccaaaaaggagtcagggtggcaccataattattaaaggaggcaacaccttaacattagtctttttaaatatgtgtcatcttgaatttcatgtctttgattgaattgggctataagcataggcttctctggaggtaagtagattgaaaagcactcctcaacagaaaagcttaaaagtaaatatcatcataagcattcatttaaaaaagaaagcctgtttttgatccagaagttgtgacttttcattctctgtgatgttggtgataactcttaattcaattgtgaccttgtttttcttcctttcagatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggttagtatcaattggcatgtgctttgagcctgagattataggtcaagttataaattatggagtacttggttttgaggttaaggtacaagtaagccttaggttcaaagttcactaattatttgaaaatttcagttgaaccacacagtgatcacattgctaaatccattggtcagtcaattctcagccctcctcttggcctgccagcagcattcaacccagctgatcactgtacctcctgaaactttttcctttcttgacttccaggacaccacattctagctgttcctgctcactgattcttcatctcccaactcctaatttatgctgaagttaccctgaacttatttcttggacctcatctcttttctgtctgcactctttcccttggtgagctcatccactcacctttaaataccatctatgtgctgtgattctcaaattttcatctctatgccagactcttccaggttcatataaccactgcctacctagcatctctcctgggatgtccagtcatctcaaacctagcatgtctaactaggcctcattcttagatccagagttttactcatctaagctaatggcaactacatttttatagttgttcacaccccaaatccaggagccattctgaattcttcatgttttttcacatcatacatctgatttatcctcaaacttgtcagctctaccttcaaaatatgtcctgtatcatagatagaagactcacttcccagggatctgtgtgacttaccctcacctcttttgggtctcaactcacaggacatttcatcaaagcctttcttgtcctcattatctaaaattataactccttttcacgttcaccatccccttctcctcagcactctgcatactacctatttagtttgtttgtttcttcctagtagagtataaactcagcaggaacagagactcctgtttagtgcactgctggaacaatgctcactactcagtatatcctaggcgatcagtcaatatttgttgaatgaattaactgaaggaaatacctacttctagcaaaagaatttacttgaacagtaaatttggtggtctgaatttaccttgaaaacattttaagaacttgactgcactgtgctgttaagtaataatgataactactttttgagggatgtatactagaaactatgtcaaacgtgcagttgaataaaagatgtattgacttgtgagttaggggtctgtggctgcatcctatagcagttaatgccagttaatcctaaatatctgagactagaagaatcatgtgtaggagaaaaaagaagggcagttatctgtcttgaagtagaattttttttcattccttacacttctcagtgagtggtaactgtagtttttgctatcatttttcattttcgtttttgcagttgaacatacttttttcactcagagagttggagggacttgcccaagactgcccaatggcaatgagatttcaacctcaaatcaatgttctttttaatgcaagatgataaagagtaggatttagcctaatttaggatagaataaagccaaataatttaggataggttctttggtgttcatgggtgtaatctaatgcccatgatgcaagtggcagagtagagaattagtgcacagcaataattaaagtgacatattgccaaaggaagcggttatagcccattatataataccttttaaaggacagacgcatactcaggtttattttacctgctgagcttctgccttagaagttttcagaattgtgattacattgaataggaaaaaagtctgaactatcagaagcagtgccgcaactttgacaaacaactgattatataataatctgcctctagcatgagactatattaattattatttagctctggtgacttcataagcagccagtgacaacagaaagttaagataataaaatgaaggaatgttacaatttgttatcatccgggagcctgaggcaggagaatggcttgaacccgagaggtggaggctgcagtgagctgagatcgcgccactgcactccagcctgggcaacagagactccacctcaaaaaaataaataaataaaaagaatttgttgttatccacttcagagctcattaatgccacatttgtcacatctccgttgagaaatccacaatggttttgtatctgctatgccatcaagcccctgttttactttcaagcctacacacaatagacgttattccaattttaaatcctcttttccattacttgctaaactctatccaactaagttcctcactctcctatcaatagtttatgtacagagttgcccacatgtttcattaatatcgttcctggccgggcacagtggctctcgcctgtaatcccaacactctgggaggctgaggcaggtggatcacaaggttaggagttcaaggccagcctggccaagatggcgaaaccccgtttctactaaaaatacaaaaaaaaattagccggtgtggtggcgggtgcctgtaatcccagctattcaggaggctgaggcagagaattgcttgaacctgggaggcggaggttgcagtgagccaaggttgcggtgagccaagttcgcaccagtgcactccagcctgggcgacagcaagactctgtctcaaaaaaaaaaaaaaaaaaaaattagatatatatatttatatatatatatatttatatatatacacacacacacacatacatatatatacatatgcacacgtatataatatatatacacatatatatatgtgtgtgtgcatatatatatatagttcctgattcctagaatgcctttcttttctctgtgaaaaatcttacccatccttcaagggcctagatagaagtcctgttcttttcttgaagccttttgtaacttttggagtcctacaaatgggagtgttcgtatacttcagtatttaccatccaccatttaacattagtcttgcatttgctgctgcttcatactggaatcatctctaaccaaatgagaagttcctttgaagggaggagccgtgtcttactcatctgtattccacatgtatttaccataatgcttagcccaccttaagtgctatatcaatgcttaatcaaataacaaaactagattttttttttctccaaaagcttccagggataggaaaagtagaaataaatggatgaataaagttttactagggaaggagggaagtgtatcatttttctttagttcagacttgaaatgctttgttttctctttgaatttcaccctagtttaggtttacttctgcctcttcacccatttatttttgacttgtccttcaagtatatattcaactctccattcttgtgtttgctttgttttgtgatttgttttttttttttttggtcatttcttatttgtcttgtaacttagcatctgagtcagggtgctttatgaggtagggaccagatctataagattttctttacatatggcattatttctagatgtgatggatttaacaaacctattgttatctgatgatttttacagtatttgggtacccagaggtaccttgtatttggatctaactaaattattgcaattttaaaggggttgctgctattttctcatagcagtaaaagcatgctgaatttaagagaactgggcatgaaaacagctttggtccatgattacaacctaagtactgtactctgctgttattcctggcaataattggaatgaagagtgttcatctactcactttttaaaattaaaattgcttaaagaaaattactgtgatttggtcctctttcctgtcttgcaaggtgatggctgttaactgatgaaattcagagcatgtgttgggtttagattcctctttccccttttacttgtgtttcaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtaggtcatacaaattcattttgtagttagcttaactgatcaggctgtatgtccgtgtaaatgctggtaccagctagaggagataggggaatatctacgattatgaaataactgtgtattggcgacaatatcactgattatctgtaatgctgatgcaattttcagctaaattttccaactgctttattcatagttcatggaaatctacaaaaaaaaagttgtttatcctaaaatgtcttccagaattgagaaaccttttcatagctctcctgactgctctcctgaccgccctgtctttaaagtgatgggccatatccttcttcataaggcagctctgttttaaatttttatttgttctgtcctccgcccactagaaaacaaacccaatccctcatctgaataaatgcacaactattcaaggaacaatatcaactcccattagtattatttttatgatagtcatccccaattgacacagcctttccctcgattaaatttgcatatcagtttttcttactgggaaagccagaaccaaatagaattcccttctacgtttagaaaataacagggagaagaaaattatctgtattccagccatccacattagcagttggtgtatccttctagatgctttgtttttgtcttgtttttatacccttgaacattattaatgactgcagagctttctaagtggctttaataacactcaaagaactcttcctatttatgcccctctgtgctttacaggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggtaaagatgtttttaaaaagcagtttctctacttgcctgaagggccagtctctaaatggccaacttcaaggtctgtgttacctgtttctagcacgcaagtacactgggaggatttttcctcatggctgagttcaagatttgctgaaaggcccttttcaaggtctttataacaccttttatacacaacacaaactccctatatggctttccaacttttagataatttggaaaaattattggtcagaatgattccttttcctaatagaaggtttaaaaaaaaaaattttatctaacccttccctgatggcaaaatatttatcgcacaatcttaattggccatttccgttaagtcatggctgtaaaagtactggtgtattaatgtcattaagtatttaatttctcttaagcttcattcttttaaacctgtgctagaattctccaaaatttgttcataaacttttcatctttaggacatggataacatcacaagagtatcttaacattgctacatttttaaaataatgctaacctgaatagcaggttttgttttgtttttttctgacagacaaatcacttaaattctgtatccactagttaacttattattacttatttatgtacttattgagcccagatagtagtgaactggggagatagcagtgaataatagaaagtccttgccctcatagaacttccattccagtgagtggagacaaacagtaaacaagtttattaagtggtgataacaggtgctacagggaagaatcaagcacagatggggagaataacagcacaggggtgggagagtgactgtcaaggaatgcctgtctatgaagggacctttggagaaaaacacagagaagatgtgaccaaggcatgtatacttgtgagggacgagcactataggcagaaggagcagttagtgcaagaaactgggcctacaagtgagcttggcatgttggaggaatacaaggaaagctagcatgcttggagaagaagctgcagaaggtggggtgagggacaagagatgagaggaggcaggattccatcacacagggcttgcaggccatgatactcagaattaaatgtaaagtgtggtggccagctgttactgggtttaaaacaggactgtttcttgttaagatgggggaactgctttcctgccaaaagtgccaaagatcaacttggaaaacaaaatcctcacagaggggagagtaaagaacacttgattagtctcattagcacctgtagctacttttctaaagttaattcctgaaggccttgaagcttcactatgagattgaatttcaccattctcaatgtctttcaataggatggggatagtgtgatggtccttccaaccatccctgaagaagaagccaaaaaacttttcccgaaaggagtcttcaccaaagagctcccatctggcaagaaatacctccgctacacaccccagccttaagtctcttggagaagctggtgctgtgagccagaggatgtcagctgccaattgtgttttcctgcagcaattccataaacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactggg

SEQ ID NO: 35691 - DNA, 3725 bp, Homo sapiens
gcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatcatcgggcgcctgctggaaggttggtcggggcgggggaggcccgcgtccgccgcgccctggccccctgcccggcccggaagtggcgcgcgggcgggcccccggggccagcttagactgggcggggacgggcagcgaggttccgtggccgcagctgcccccccgcggacgcgcctgagaggtccggggccagctccgacgcgcggagcagctccccccctctcccgggctgggggcgcacgggttgcctgggctcttggggcgagggagaaacccgggaagcccggtccaggaaggggtcctgcgctgtgaggtttttggtggcagccccctgcgcacgacagtcgcctcccgaggcgctgagggtagctgggggcttcccctgggaggcttgaggccgcggtcccgggaggctcagcagcaacagctgcctgtgggcaaggaggggccgaggaggcctaggcgcccccggaggtatccatggggccacccgtgtcgcccaccctcctcctgtcagggtccagggtcctgacaccccattgcgccccagtgcagggctcgcggcctggcaagaatgtacagctgacagagaacgagatccgcggtctgtgcctgaaatcccgggagatttttctgagccagcccattcttctggagctggaggcacccctcaagatctgcggtgagcccccggcccaggtccccttgccttcctaaaagtggcactggaccccacagagttcctggagccctcctcccttgagcgcagtcctggccctgggttcaggtctagaccttgcatctagcttacccggttccctgggtcacaggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgtgagtggtctgagcgtctggggctgcccgggtcctgaaccgcactctttgccattcagtgggaccttcacattggcctgatatctgacagacacttgatagactgtgcgctccacgaaggcggggcccaggtccgttctcgtgcctgccctgcccctcctggcatggggtctggggaatggttgctgactgaagggctgcccggattctagtgctttcccccagggccctgcctggtgacactccccctacatttgctactaagcacttaggatgtttgcagatgggctctgctgtccagaagctgagataaaccagacctggacttggcccggctcatgggtgggggcatgcgaggagtgccaaccctgaggctggtccagattggaacttagtttccagtggactcgggtgctttagaattacttctggcaggaggccgaggcgggaagatcccttggacccagaagctccaagttacagtgagctatgatcttgccactgcactccagcctgggtgacagagcaagaccctgtttctttacttttttgagacggagtttcactcttgttgcccaggctagagtgcaatggtgtgatctcggctcaccacaacctccgtctcctgggttcaagcgattctcctgcctcagcctcccaagtagctgggattacaggcatgcgccaccacgcctggctgatttttttgtattttagtagagacgaggtttctccatgttggtcaggctggtctcgaacttctgacctcaggtgatccgcccgcctcggcctcccaaagtgctgggattacaggtcttagccactgcgcctggccagatcctgtcttctttaattaaaataaaaagtaactagaattgctcctggaaggctgacaggtggcaggggtggggggtggtttgcatcggtgcctgactctctcctcccagccacggctgaatagcccagggaccctggctgagggtggggtaggcaggcacctcacagccacctccccctgggcaggcaagagacgctacaacatcaaactgtggaaaaccttcactgactgcttcaactgcctgcccatcgcggccatagtggacgaaaagatcttctgctgccacggaggtgagggaggggatggctggggaggaggagcactggccgcatccctcagcacccggcagctctccttaggtctcatctgggaagtcactccttccaggaagtgtcccccataccccactgtgctgggctgcactcacttccttgatgtgtgtcctacatggagtgggcttgtctcctttctcccgggagctctgtgctcctgagggcagggatgcctttgtgcctgtttgggaacttgaaaaagctgaggggaaggggatgacttctgcctgtctaggcgcccaggagaccagtggcgggaccaggagggtggtgggaaaggtggggttcattggccaaggcttcctggagggaggatgtccttgtttgaggaagtgaccttcccccggccccccaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtgggctggtggctccggcctgcggcaggggaaggggagggccgtgcctgcgctcgggactgactgctcccatcctcgcccaggtggtagaagacggctacgagttctttgccaagcggcagctggtgacacttttctcagctcccaactactgtggcgagtttgacaatgctggcgccatgatgagtgtggacgagaccctcatgtgctctttccaggtgagtgtggggaagaaaggagccgctaggccctgtggctcagccccatgagcctgaccaacactgtctcttttagatcctcaagcccgccgacaagaacaaggggaagtacgggcagttcagtggcctgaaccctggaggccgacccatcaccccaccccgcaattccgccaaagccaagaaatagcccccgcacaccaccctgtgccccagatgatggattgattgtacagaaatcatgctgccatgctgggggggggtcaccccgacccctcaggcccacctgtcacggggaacatggagccttggtgtatttttcttttctttttttaatgaatcaatagcagcgtccagtcccccagggctgcttcctgcctgcacctgcggtgactgtgagcaggatcctggggccgaggctgcagctcagggcaacggcaggccaggtcgtgggtctccagccgtgcttggcctcagggctggcagccggatcctggggcaacccatctggtctcttgaataaaggtcaaagctggattctcgc

SEQ ID NO: 35692 - DNA, 20029 bp, Homo sapiens
actgagccccacgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctggtgagtgctgccagggccctcaggcgcttcgttcgcccttttccgccgccgtcagccggtgcaggctcccctgcgtttccgtgcgccgtcttcccggagcctgggtgcccggattccccatgtctgacctctttgctgttcgtgctctccctggttccactgctcttcccaggcgtcttgggaggcgggtagggactgctcgagtgggcggggcgggacggctggagatccttaaggtcccctttctccctgccccggactcccggaatttgcccattgtcgtctttctcatctctgagtataactggagagctggacactcacctgcgcatctgctttgttgttatggctgtgtgatgtcatcgtggcctgctgttgtcatggctgcctgttgctatcgccggccgttgcctgccactggcagtctctgagtcacccttagcggacagggctgcagacctcgcaggtctgttagcagaatcgcagattgcactcttttttttttttttgagtcggagtctcacattgtcgccccggccgcactgcaatgacgtgatctcggctcactgcaacctccgcctcctgggttcaagagattctcctgcctcggcctcaccggtagctgagattacgggtgcccaccaccatgcctggctatttttttgtatttttagtagagacggggttttactatgttggccaggctggtctcgacctcctgacctcgtgatccacccgccttcatcctcccaaagtgctgggattacaggcgtgagccaccgcgtctttatgagaaccgctgcctcttatctgacgattgcagtgatgtacatcgcgcggcaccagctcttcccattggctttcaccgtagagaagaatttaaaaaataattttctcggttttttttagtgatggtacatgataagtgggttttaggaaagaggttcttttatgtcagtacagtattaaaattgtctaaagaattttcatgggatcagtaatattccgtgcaattaatacgtatatgtctatatacttagatacagattttgactttttccatgtaataaatgacgcatgctgttactttggaattctgtaaaaaaaaaaaaaaatgaaaacaacatcatttttgctttgcgaagtaaagatggcatggaaagcatattgcctttgtgatttggtgattggaaatgcctgcattgtcgaatttaagcaacaggtttatttctataatagcctattcttacatgctgaaatgagagagaaggtgctatttgcaagcacatcacgttgagtagtcatttgatgtggacattttattaccaaaaataaaaagccaagttgtatttaaatgtctgtacgtttttcttttgtatttctagaaagctgtgtatgagtgggagacttgatcagaattacaagtgaaaacctagaatgaaactttaatttgttgaactttgaatcagttcgtaaataaatttaataaaggaagtttacagttgaagagccagaagaactataaaaactatgaaagaagaaccaaatttaaattaaagatgaaccacttcctggtttatctacgctgtaaaactattgttctggaacacaaagcaccacaatattttgcagagtaaactcaattgttttatgtaaattctacttcaaagtttactttgaggaacttttttgttttgttttgtttttttgagacagtttcactcttgtcgcccaggctagagtgcaatggcgcgatcttggctcaccgcaacctctgcctcctgggttcaagcgattttcctgcctcagcctcccgagtagctgggattacaggcatgtgccaccatgcccggcaaattttgtatttttagtagagacagggtttctccatgttggtcaggctggtcttgaactcccaacctcaggtgatccgcccgccttggcctcccaaagtgctgggattacaggcgtgagccaccgcacccggcactttgaggaactttttaaatgaagatactttattgacatactatttattaagtcctttactaaagcattaatcggctccctaatttatcttttgtttgacttggatgccattactttagctcacattgagcagtaatttgtctggaaaaaaaaattagcaccattctaaagagattaccaatgaattttcaaaattccttattgaatgtaatcttatattaagttactcttccgggtgttgggaatatagcagtgaacaaaacagtgtcttgcctccaaggactttacctctattggggagaaatagacaataaacagataaacatgtaaataacatgctatattgtgaaaattggtatgcaccgtgtatgataaacagcgtaaggaggacatggtgtgcgggcagaagtggagacttaaaaaacgtacattggtcagggaagtcactgttagggtgacatttgactggaaacctgaagtggggaggaggagtaaatgacctgaaattacttatatctttaaaggctcatttgggctgctctgtggaaaacagaccgaagagggtaggagggaagcagggaaaccagtgaattaatatatattgctatctattttaatattgtacagtaagttcttagagtggtgaccgcttggcccagggcaggagcagtagagagctggttagagtagctggattctcttgtcacctgtttggaaggtggagctaacatgatcttctgaaggatcagatgtaggagtgagaggagagaagatgagaagtccaaggtttttggcttgagcaactagaagcatggagttaaccatttcctgagatgtggaagaatgtgggatgatcaggtttaggggagtttggttttgtttatcttgtttgagacctgccgtgattttgatttatgagtctggagttcagggagctcctgtgtcccttgactgatctaactagtggggcgtgggtattagaattttgttcttggaccttaagaatctctagggaagaaagatgctataggattatggtaatgctattccatcttaaaactttcagtaatatttatcatacctgatcacctgttatgcttcaagtactcagccagataataaattatatctaagcttcacaacaaatttcaaggttgataatattttaattttgtaggtgaggaaacttctacacaggtaaattaaatgccttggccaaagtcacagccagttagtgacaccaacttagttcagtgttctttgcattattgcaactctgttacaataaattcaatttattatttctgttatttagttgattaatacagtctgatttttctaaaccattgaacattttcattgtcttattttttatgtatgaggaggtagtagtttgtgtttaatgtagcatggtttatttgaatatagttcttggaaattttagatctgtagcccatgtggaattaaatttttatatagctttaggtggattttcttgtggctgcatagtcaattatgccagtgctatttattaaagaagacatcttttatccactaaattaaaaagaccacttcatcttactgaattcccaaatgtatcttgatttatttctgatctttcttttgtttcacaatttccttgtctctgttccaattccctactattttgattataatctttttttttttttttttttttgagatggagtttcactcttgtcgcccaggctggagtgcagtggtagcaatatcagctcactgcaacctccacctcctggattcaagtgattctcctgcctcagcctcccaagtagctgggactacgggcgtatgccaccacgtccagctaatttttgtattattagtagagatggggtttcaccatgttgtccaggctgatctcgaactcctgaccttaggtgatctgccctccttggcctcccaaagtgctggggttacagacgtgagccaccgtgcctggctgatgataataattttatagtaacctttactatctggtaacctatgtgttctttttcaaaaaaaaattgtccacaggacctttaacataatttctttccccaaaaaaccctattgggttcctggttggaagtatatttaggtctctctctctatatatattttttatatagatagggtattgaccttaagtttattagattgattagattcatattaaatacttgtgggaaatacatcataggagatgttgtaacatcagtttgttccaccattagcaaagcgatggttggcaaacccagccagactttttcctttagagtttttgaatatatttctccattttctttttctatcctgttgagatacctgaagcttttctaagtcttatcttttctatatggcttgttttctccctattcttctggcaatttgtagaatctttttttgtcttcagtgttctaaaatttacttttcgtgtgcctttgtgtggtctgtttctcaggcctgggtatttgttgggccctttcagtatgacaactcaagtccttcagtgtgggaacttttcttgaattacagcctggagtttgtctaatcagattcccttgttcattctttcagaagcccttgttggatttttggactttctgaactggtcctgaactggtaattttctttctttcttttttttttttttcctcctactgtcttttttctttctttcttttttttttttttgagacggagtctagctctgtcccccaggctggagtgcagtggcaccatctcggctcgctgcaacctctgcttcccgggttcaagcgattctcctgtctcatcttcctgagtagctgggattacaggtgcccgccaccatgcctggctaatttttgtatttttagtagagacggggtttcaccatatttgccagactggtctcgaactcctgaccttgtgatctgcctgcctcggccacccaaagtgctgggattacacacgtgagccactgtgcccagcctttctctcctactttctatctttttgctctactttcttttttctttttcctttttttttcagatggagccttgctctatcgccaggctggagtgcagtggcacaatcttggctcactgcaacctctgcttcctgggtttaagcaattctcctgcctcagccccccgagtagctgggactacaggcacgcgccaccatccccagctaatttttgtatttttagtagagccggggtttcaccgtgttcgccaggatggtcttgatctcttgacctcgtgatccacctgcctcggcctcccaaagtgctaggattacaggcatgagccaccacgcccggcctctttttgctctactttctagaagattttcttttaacagttctgtcgtatgtatgtatttatttatttatgttttgtgacagggtctcactctatcacccaggctggagtgcatggctcactgcagcctcgacctccccaggctcaggtgattctcccacctcagccttctaagtagctgggactgcaggtgtgtgccaccatacctggctaatgttataattttttttgtagagacagggttttgccatgttgcttaggctggtcttaaactcttgggctcaagtgatctgcttgccttggcctcccaaagtgctgggattacaggcatgagccactgcacctggcagttctgttgtttttaatcttggctgtcctgtttttaatttccaaaagctcttgttttttctctgagtatcccttttaaaaatgattgttttattaacgcagtctttttctcttatctctctgaggatattacagtgtttttaaaaaagttttcttcttgtgcgtcatctcttttttcctcctgcttccttttgttgttgttttgtcctggttgctgtatttcatgttaggggctgttttgtctgtttaatgttactgtaacacaataccacagactgggaaatttattaaaaaactgaattcatttctcacagttctggaggctgagaagttcaatattaaggtgctagcatctggtgagggccttcttgctgtgtcatcccatggtggaaggcagaagggagagagtgagagaggggaaaggggcctaactcatccttttatcaggagtccactcctgcgataactaacccagtcctgcaagaacagcattaatctattcatgagggcagagccctcttaaagattccatctttcaacactgttgcattggggattaagtttccaacatgtgaactttgggggacacattcaaaccatagcagggactttcctcatatttttagtaatccttggctccctgctcatggttaattctggggaaccaaaaagctcattggaagctatcagtgtgcagttgcacttttgattttgaacttcacaacagggtgacctaggttgctcttttttggaggaagttcctgatgtcagtgtatttaggtacttcttcttggttagattaccaagggaatagtcatccagtctcccacagaggacaaggggatggctgttagcattttgtgcaccatgtggggaaggagaactgtgctttcagcagtcagagtgcacacagtcacttgggttccctgtttggttgtttttgtccccatgccctttactatgccagatggtccccaatgcaaatcccttcagttttatcctctccagagaatacatctccagacagtttccttagtggggaagagggagttagaacagtgtggagttggggagaggatctgggaatatggcttcctctcaagtagctttcaccctgtagtgtgtattccaggcatctcccattccagagctgccatttcccgttttttgtttttttttttttgtttttttttagggattctgttatgtacatcaggttgattctcagtttccccctttgctgttctggcatttgtctttcacttaggtctagtcatctaccactagtccatttactttctccttccaaaattctgctgtcatctcctctttcgttttacctgaccacagtcattcacatcatcaaaacaatgtatttattatagttttagtagaattttgggaggctgcaaattctgctaatctgacaggttgaatatagggaattgggtactcacaaaatggtagaaagcgatgcctattacatctgccacattgaaaaatagattgttcatgtcaagcttcatgacagccaggaagctgattagaggatactatcagtttgaaaactcatggtctccatgcctgtgtttactagctgaaggacagagcactgtataagtctagggtctgctttccagattttgctcgagtccctctggttggcagaactgaaattgcttttggcaactatagctgcaagaggttttgggattccttttgctttgcaggaaggcatacctgtttgagggtgaagtggatgttgactgagccaatccacagcatcttccatcaataatccacaacatgataaataggaagactttgtccttattttccaataatgcatagaaattcattttttttttttttttgagatggagtttcattcttgttgcctaggctggagtgcaatggtgtgatcttggctcactgcaacctcctcctcccaggttcaagcgattctcctgcctcaccctcccaagtagctgggattacaggcatgtgccaccactcccggctaattttgtatatttagtagagatggggtttcgccgtgttggctaggctggtctcgaactcctgagctcaggtgatccacgtgcctcggcctcccaaagtgctgggattacaggtgtgagccaccacacccaacctaaaaatttcatttttgcacatgaatgccagacataattttattgttttgactcctcctttcaaagtctcttgtcagtatgttttaaattttttagtttgtgaaatagtttaaatagttttgatttttaaaattatgaaatacctaaagtatttaaacatacagaagtgtacaatgaacctacacatagtcatcacccagttttattgaatctttatattttgccatatttgctacaaatcccccactcccagtaataaaacattaggaatagagctaaaatctcttttctttctctctccctagactagatacttatttgaatttggtgttaaatccttcccatacatgttttcatgttgttattatatacatatatagacattaacagtatgtagtactgttttgccttttttaaaggtttatgtaaagctgtcatacaaaacattctgcaacttgtattttgtttaaaatgtttttgccatctatctagtttgatacatgaattctagttcactcattttaactgctatgtaatattccactgtaataggtcagaatgtgttaatttcttcacctgttgatggacatttaaagcattaaatgtgcttcaggaacatgcttatattcttgccattttaattaaccactattattattacacagtagtacaatgtttcaggttaatgaactttttgttcttttgatttagcaaaaatgatgtacaacttgtgctgtagaagcatctggcctgaaatgcagggagatcttaaaagtgtgacctgaattttgttcagaaggcctgaatgttgttgggatagttttgagaaatagattcatcctctcttagccatcctcagaaggcaagaaaggcatttcctatgacgagagtttcgttaggatgaacctttctttctctgacacgatacttactttgtgttcctctgttttcttgctgtttcagacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacaggtaatatccactacagtaatggcagtctaaatggggtttttattcagtaaattgtttattgggacattattcagtcttttgagggtgcacctacggaaatctcagatcagcctaaaatatgtaagtaaatcaatcactcttcctgtggaagaaatggcctccaaaagaaatgaactgattttaaagcctgaaaatactcattttagtttttgtatcgtgacctccttctaagatatttgtaaattttcacaactttttatatacttgagggtgagggataggggatatcttatggttgtcattttcctgtcgttcctcaaagaataccaacctacccttaagacaaagttaagataattaggaattatagatcgtaaatagtaggggttcatatatctctattgtgcttctagcacttgattttaaaattgtcttagaactgagggtggttacttttgaaaggaagcatttcggcaggtttcattgattgcctttgggacgctggtgttttgtatacgagcagagcatctccttgaagttccaaaactgaatatgctttagagatagattttattaaatgaattcagtttaaatcactagttacatatttctactttgtattctgactgctttcaaaattgatttaagacgactggtcacaaggcaagaaacttatgttgacgatttcccctctccatcagaatgatattcttgtttgatacaacctttatgcgtggtctttgcaattcagagaggaagttgatgtgtactgggtgatacttacttcacaatattttcccccagtactgctaagttgaatcatagaattctctgggttatagcagaagtctcactccactttacttatgacttttagagtcttgatgggaaaaaaaggcagtaatggtgatgtcattcattaagcatgtattaattgcaatatacaaaaatgaataaggtagaatgaagaaactgtcttactagtagaagaggtaagacaggcactcagattacatgtaggtcccaacacaacattataaagtcacgtctggttggagccattgggacttaaaggatgagacatttgtgctgtgttaggaaggaatgataacatttttagagaggaaaggctagagaagggaatagcatgagcaaaggagtgttgagcatatcatacattggcttatgtttagtagcaggagagaggccatttagtagcaggacagaaactccttctattccaagagttgaaatttaaatacagtacttagaagctacttgtaagtacgcatgattaaggaagtggtagttaacatgaaataccaatacaagtttagcttgttttatttacctaagtcaacaaacctatgaatcttcctccaaataaaattattttaaaaacagtgtagtaacagcaacaaaagaaaaactgcatcttatccaaatgaaaaacttttgactatcaaaggacatcatcaagaaagtgaaaagacaacctacagaatgggaggaagcttagcaaatcataattggtgagggacttgtatttagaatataaaataactcttacaactcagtaagaaaacaaccaaggtaaaaatggcagagcatctgaatagacatttctacaaggaagatatataagtaataaataagcacatgaaaagtgttccttattattagccatcagagaaatgcaaatcaaagccacagtaagataccacttcacactcagtaggaaggctataataaaaaagataacaaggctggtgaggatgtcgagaaattggaaccctcatacactgctgttgggaatgtgaaatggtccagctgctttggaaaattggcagttcctcaaaagtttaaatgtagagttaccatgtatgcctcagtcattccactccaaggtatatacacccaagagaattgaaaacacatgtccacacaaaaacttgcatacaaatatacatagcagcattattcataatagccaaaaagtagaaacaattcaaatgtccattactaatgaacgataaataaaagtggtatatccatgcaaagaaatattatttagccataaaaaagtgaaatagtaatacatgctacaacgtggatgaatcttgaaaatgttatgctaagtgaaagaagccagtcacaaaagaccacatattgtattattacattcctgtgaactgtccatttagggaaatccatatagacagaaagttggttgggaggtgtgcggcgggagaatggagagtgactgctaatgggcacaatatttctttggggtgacgaaaatattctaaaattgattgtggtgacagtagcacaactgtgaatatactaaaaccattgaaatgggtgaattgtatggtatgtgtgaattatatttcaataaggctattataaatgaagtaaaatagtgtgaactttgaaagaggaaaataatttgtacaaaaatttgcagaagggcaacagaaccaattaaatctactttagcttgtgtcttttttcattttttttgagacggagtctccctctgtcacccagtctggagtacagtgcagtgacatgatcttggctcactgcaacctctgcctctgggttcaagtcgttctcctgcctcagcctctatttttgaagtagctgggattacaggcgcctgccaccatgcccacctcatttttgtatttttcgtagagatggggttttgccattttggccaggctgttcttgaactcctgacctcaggtgatccgcccaccttggcctcccaaagtgctgggattacaagcatgaaccaccgcgcctggcctttagcttgtatcttaagagttaaagaagcatattgctttttccaccacaaaatatagaatctagaccaaacttgggcatatatttttttataaggtggacatttttggggctagcctgggttctttttgcatttttctaaatatctttaaaaaatacaagagaattacatagaattggaccttggaaagttagtccatggttttataaaatttgtgtagaaaagtttttttctctgaaggttatgtaatatctctgttgctttgtgtagctaccagacattcatatatgatgctgttttgagccttaacatcttttaagaaatctggatttttaaagaaagcatcttgaacaacagtggcaaaaagttgacattttggcagtttgcttaaattttataaattgtagaatacttaatatgttcagatggatatataacatgtatatgtaaagaatagtaataaaacgaatactcatatacgcaatatccagcataagaagtagaacacagataccaccattatctttgaagcccctcattttccttcccttagacatgaatacttaccattgtgaattttgcggatcattcccttgcttcattttgcaattttatgacggatatatagcccaagtaacatttttttttttcttgagacggagtcttgctctgttgctcaggctagagtgcaatcacgatctcagctcactgcaacctccacctcccaggttcaagtgattctcctgcctcagcctccttagtagctgggattataggcgcctgccactgcgcctggctaatttttgtatttttaataaagatggggtttcaccatcttggccaggcgggtcttgaactcctgaccgcgtgatccacccgccttggcctccgaaagtgctgagattacaggtgtgagccactgcgcccggcccccaagtaacatatattaaatgaaaaaaatgtttgtttctaatagtctgtttctatttttcttcacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggtatgtttccctcgcagtggccataaatagagcgggtgtgaggttagtgcatcctgtgcttggttctgaaatagaaaatcgttgcattgggaaaccaaaggaggtttgtcttctcattttgttttttactttcaacttcttttacctcttctgtttggctctctcccaaggtatattgtggttgctatgttaatgcctgattggccgggcgcggtggctcacgcctgtaatcccagcactttgggaggccggggtgggcagatcacttgaggttgggagtttgagaccagcctggccaagatggtaaaacgccgttcttactaaaaatacaaaaattagccgggtgttgtggcgggcacctgtgattccagctgcttgggagactgaggcatgagaatcacttgaacccgggaggtggaggttgcggtgagccgagattgcgccactgcactccagcctgagtgacagagcgagaccctgtctccaaaaaaaaaaaaaaaaaaaaaatgcctgattaaattataaatactcttaatcagagaaacttgatcaactttgctaataatcatttgccctgactcctgtctcacactatacataaaaattaattctttaagtattataaatctcaacgtaaaaggtaaaacaattaagtttccagaataaaacataggagaatatttgttatgaccttaggatagggaaagatttcttaaacagaacataaaaagtactagccataaaagaaaacatgggtaaattagactttatttaaattaagaacatctaatcatcaaaaggcactattaggagagtgaaaaggcaagctacagactgggaaaaatttacgaaacgtatttccggcatatatatatataaaatgtatttccggtagaacataaaatgaactcctgtaaatctgagcaacaggcagacaggccctccaaagaggacttgaatgcccattttataataagagaagacatctacttcaccagtccccagcctttttggcaccagggaccagctttgtggaagacaatttttccacggactaggggggttggggtggggtggggtggggagagaaggttttgggatgattaaagcatattacatttattgtgtactttatttatgttgttattacattgtaatatataatgaaataattaacaactcatgtaatgtagaatcagtgggagccctgagcttgttttcctgcaactggatggtcccatctgggggtgatgggacacagtgacagatcatcaggcattagattctcataaggagcatgcaacctagatccctcgcatgtgcagttcacagtagggtttgtgctcctatgagaatctaatgctgctgctgatctgacaggaggctgagctcaggtagtaatgcaagtgatgggggagtggctttaaatagagatgaagcttcagtcgcttgcttgctgttcacctcctgctgtgtggctcagttcctaacaggccgtggagcagtactggggtcccaacccatgatttacatgttcaacagaaataagaaaaggtgcttagcatcattagtctcctgagaaatgcagatgaaaaccacagggagattatttttagccaccagataaccaccataatggctaacattaaaaagacagagtaccaagtatgggcaagaatgtagagtgactggaactttcatactttgccggtaggagtttaaatggtaaaacaacccaaacatgcatacccaattctattcctatgtacatacctgggagaagtgaatgcatggtgcaccaagaaagatgcacaggaatgttcatagcagttttatttataactgccaaaaaatggaggtggaatatccataaacattagaatgggactgtgtaaatttttcacacggtggaagacacatgagttaagaaaaaaactgataatgcaatggtaggattgactcccatagacataatgatgtgccggacacagaatacatactttgtgatcctgtttagaaaaagttcatgaatggacagaattaaaatatggtaagagaagttaaagtagtgctgatctctgacatagatgggaatctattaggagttgtcatgagggagccttctggggtgccagaaatggtttattggtgtgggtggtggttacatggataggtacatatgtacaaatttgttgtgccacacgtgtaagattagcacactttcttatatatatgtatacatcagttaaaacttcctctgagcagaagatactttttaggtccctttgagatctgacttcccaactgacacaaataaatatctggctgcctccccttggattcctcggttagagactgaggcacagctctcatctggagctcttagagactccacttagagtttgtactgcagagagaaagtaaccctgaaaagtggggtgattttctagtagctgattgagcagggcagatgtcattttatagcaagaccctccccagtcccaaaatctatccctctcctcccatatctatgggaaatgctctccctcattataaaccagtattttacaaatacctttttgaatacaacttgttaataacttgatgcctgagtattattaataattcagtacagatgaaataattgaaatgttacattatctttgcttttgtagactgtcatgtttaagtgaggatacataataaatcatttttattttaaggaccacagaatactggccatggtgcaacttctggttttggcagtgcttttacaggacaacaaggatatgaaaattcaggaccagggttctggacaggcttgggaactggtggaatactaggatatttgtttggcagcaataggtaagctttttgcattgatctcacttgctctttaattcaagaggcttgttttgcttacaatttaactgcatttagttttgctaaggaaaataaattgtggtgacgttagcctattaaataagattctctgggaagggggaaggtacactatatttgttttgatcagtattgtgtatgttattttctttcactgtgtttcttcctgtgtcaccttcatatatattatgagataagaaaaagactgtttagttgacatctgagaaaataagaaggcaggaaagaagacagcatttggggaacagtctggtttggtaggagaatgataaaaataaggctggaaagagcttggggccagattttggaatatgaagtattaatggtagtttaagtttagattttattcgagtgcaaattcagaaagagcattgactccctgtcacttttcccccatagcagtgaccataataatggcagaaatatgaaacggtttttatttcatgttaactctgatataccagaacattcaggaaaaaatacttgataaagatatttttttctgacagtttaggaacaggaaggtatttaaaaattatagccacaagaaaaaaatgcctaacctacttttatccctttaaagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggtaagagcaaaaaatacaagttccttttacctaggagtaaagtacagaaatagtttgggaactttagaagatgattatctgtttagcaaccatggttttatttggtgtacctaccaaaaatattaatagcacagttaactgagatcccacttttaaacattctttaaaaatcaaacagggatttgatttaggcttagctctaccatagaccaaggttttaacttgaaccttactgggtgctagcttccccatatatttaattctgtgatctctagagatcctttaagttctaaactagacttttctaagtagaagcttaaacttaaaattcaataacattcaaaaaagatattgaggtatactttaattttcaaaaatatgattgtaatgtttattggaatgctcagaggatattttgtaaaaagcaaagatacaaaaaaaacaaaggaataactggattaagcatcaagcctaattgggagctgctgggtaaggaggccatgagagattgctctggagtagctttgtctttcaggaaaaggaagttatagaacaatgattaattcttgaaattgatagaaaaatatatttaaatatgttttaaaatgtgagtagaattctcataatgctggtttggatatatattgatacattcaattaaaaaaactggtactacctcctaaaattgaacctatgcatacttccaaaggacagagcagttttgctctcagatatatcgccacagaaatgcatacacttgtgtgctggcagataagcacaagactgttcatagcatccctattcataattgcccaaaactggaaacagcccacgtatccatcagcagtaaaatggatgaataaattgagttatgtttgctgtattgcagtgggttactgtgcaactaagaataagtagttgtgtgcaataacatggatagatctaccaaatataaagaagccagacacaaaataatatatacactatgatgatagcagttacattttataaaatacacatgcaaaaacaggcaaaactaatttatggtgttagagtatgagatagtaggtacttctgggaagaaaaaaaggagttgggagaatatataaaaatatgactaggtaaggccaggcacggtggctcacacctgtaataccagcactttgggaagctgagatgggtggatcacctgaggtcaggagttcgagactagcctgcccaacatggtgaaaccccatgtctgctaaaaatacaaaaattagctgggtgtagtggcacatgcctgtaatcccagctatttgggagggtgaggcaggagaatcgcttgaacgcgggaggcagaagttgcagtgagccgagattgcaccattgcactccagcctgggcaacaagagcaaaactctgtctcaaaaaaaaaaaaaaaaaatatatatatatatatatatatatatatggctaggtaagacatcatgacagaaaaatattcattctcagtggaaagaagacttgcataaaatcatgactatgaactagaaatgtatgggaattatatgaaagaaaatcataaaaaccaaataatgtaaacctgaaaataattgagagactttctagataggaagatttgtcatcctgtagcctgtgtgtgtgcgcacagtgtcttaagtaacgtttaagcatctaaagtccgtaaccctccccacattacgtctcttaccactggagttgtgagaggtagcagggcatggcttatgcgccactggcctctgtctttttggcttagactttgagtattgcctgtaccatggtggccccactatagaatgcattctcttttttggggtcctaactgtcattcccagcaaccatgtgtgagtgtagtaggcttgatgattgggaaggttgctgtgggaggcgatgcactgtcctgcttagcccagttccacctagtggcacactctttcctttcctcctatctcattcatttgctgacaataaacatgtatgacttgtaattttataagcaattctaatgcatttttaaaaactaatgtaaattttacccctctcattctaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatca

SEQ ID NO: 35693 - DNA, 5417 bp, Homo sapiens
gatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggtaccttcgctggcaaaaggagtcctctcgccccccagccccaatttcccccaggggaacctctcttccttcggtctcccggggctggcctcctgggagcggacgtaactccccagacctccgctcccttcccctcttgcccggtcgctcccaaacccggaaggggaactggggaaccctcgccccccaccgtgcgtgcgcttccccgcaccatcagcgaagtttttgcccgaccccagaccccagcccagccccgactgcctcttgctccctcggaagttggggggctaaattccgggcttcctctaggccccgccccgccccctttccccaccgccaccctcccgcctgcccccggggagcacccctcgtgtcctccactgtcgcacccctgccggccctcgccttgcacaactccaaaatcggggagaagcaggcaaggccgcgcgccacccttcctttcgtctccaccctacccacgatttgggtgctgcccgtggtttctggccccactcgccgaaactggagccctcggcgccctattccctttacagatcctcaccccaagcccagctcccaggcgcccgccccccgcccagctttcttttaggcaaaatggaggtcgtaggggctggagggccaggcccactgcgcttcgcagcgccgcaccagcccgcgccttccagctgccagatccagggaccctcccgtcactctcctgagccccgccagacctgcggaggcggttgcaccctcatttctctatggagcgccggctgctatatccctagagtctgggggctgctgagggccctggggggtgatggggaccgagggctgagaacgtcgcccccgcccccagtttcttcctccagccgtgcttccttctgccctgggcctccggcggtgccgccaggcctgggctgctagtaggtggaagaggctttgtgcgggcctgggggttgggtagagtaaggagttctgcccgcaccccccatcccccgattttgagggtcaccccttggcactggcgtagaaagctgaacttacaaggaggggaaatgtcagtggggaagaggaacgccctgcgcctgggggaagtgggagctgggtgggggacgcctgggccggccaagtgcagtgtgtacggccggatcgcacaggtgtcccgcgggcggggaaggactcaggctcccggagcggagccagccgggcccctggggcccgggcgccgagcctgcgggctgggccccccgggtgtccagggcgccgcggccaggccgcctggggccgcccgcccgcgcctgggagagagcacctccgcgcctcggggccggggacctcgttgcggagccgtaattactcgagagcggctcccacgggctttctgcgggcgcggcggggcgggcggtccctgcgctggagggagcagcggctcggggctgccttccccgccgctgtcacccccacccgcggcggacggctaatggggcgcagccggaccggggattatccggggtgagccgtccagaacctattagcgcccaatcggcttttcccaaatcctgtaaacagccacccgggccggttctggggagggcgggaggctgggtcgggcgggggcgatggggccgggggtggggtcacccaccctacaggtctctgccgtggatgcggttgccttggcaacggggctagggtgggggcatttcaccaatgaggtgctctcggtccgggtgacggttgcctaggcaaccccacgaacagcccagctttcccctctggtctctccccccacccgccaccatcgaagctgggggtgtgtgtggagggtgtgcgccttgtggggtgaatttcaagaggcaccgccccttttaaaattaggtgcttggagggcggtgcctgtgcgggctggggcagaagccaggtctgttttcgaagggacacccccgccccccccgccccagttcctgccgcgggtgtcctgcccgggctgtgtccgagggaggggtttcccctgcgcttcctcttgcacttcccgctccgtttccggggggcgggaggaagattggggaagtcggctcttactcggcgacgtctctggtgccggagaccctggttgtgcccggggacggcggccgcgccgccccttccccctccccttgcttaccccttccgggccgcgctgcaaccccgcctttctccccacttccccggcggcctcgggcctgacgtcagccctgcatcccccaggcctcgggccagcggccaggagctgcctcccccagcccccgtcccgcggcccccagccgcccccaaccctgccccacgggcccggcgccatgagtgagctggagcaactgagacaggaggccgagcagctccggaaccagatccgggtgagggcctggtgcggggcgggcgattcatgtgtacaccgcccggtgccctggaccgggttgggtgagggtgttggtgggggaagggggagggagggccccttaatggctcagaatctgaccctgtccactcctgtcttctgttctcttctctccctttcctccccaacctgtcttctctcgcgtctctctggctctgccatcccttacaggatgcccgaaaagcatgtggggactcaacactgacccaggtgagggcacttggtggccagagcgtaactaggggttgaaggggcaaggatcagaggccgctgccctctgcagtcctgctgcctgggcctccccgagcgcattctgtctctacctccagatcacagctgggctggacccagtggggagaatccagatgaggacccggaggaccctccgtgggcacctggcaaagatctatgccatgcactgggggaccgactcaaggtgtgtgtgtgtgcgcgggctggcgctgtgggccgactttctagcaggccgtgggagcagcctcagatctggcggagtaagcaggccaccaaaatacccagcgtacgtctggaaaaacggtgactcccagacatgtccgccagacctggacaggcaggaccatgctggtgagaacttgtgggctgcagctggagactgtctctcaggtggctcacgcctgtaatcccagcacgtggggaggccagggcaggatcacttgagctcaggagtttgagaccagcctgggcaacatagtgagaccctggctctactaaaaattgaaaaatgagctgggtgtggtggtgctcaccttgtagtcccagctatgcgggggaggctgaggtgggaggatcacttgagcctaggagttccaggctgcagtgagctgtgatggtgccactgcactccagcctgcacaacagagagagaccctaccttctcccacccaaagggaagggggtgtgtcttgttttcacgccacccttctgctctccctacaccgttccccaccaggctgctggtcagcgcctcccaggatgggaagctcatcatctgggacagctacaccaccaacaaggtagggtggcgcgggctgcggggtggggcagggccacagggccctggctggctctgaccccggcgcttcccctgctccgcaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactggtgaggggcctggcccagttcgggccctttttggggttggggggtgcactgccctccgtgtggagacctggctgaccagctccttccccagggtacctgtcgtgttgccgcttcctggatgacaaccaaatcatcaccagctctggggataccacctggtgaggctctgccagggctgggcagtctgggcaaacccacacttcctgcctcaggggccaccgtcccagtgctcaacatgcagcatgcaccgtagcctccctctcctggtgggcgctaagggggtcagggagggatgcgtcccctccccacctaaggctctgagaagagcctccctggacccttccacagggttgggctcacgtggtggggcggggagaacagggactctgttcttcgccctgtctcttatcttttctttcttcctgtcacctctccagtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctgtgagttttggggcgagctaggccaggccctccccaccaggctcccggccctgctcctcaccctcaccctcaccccatctgggtcccgtgtcctgcagttcttccccaacggctacgccttcaccaccggctctgacgacgccacgtgccgcctcttcgacctgcgggccgatcaggagctcctcatgtactcccatgacaacatcatctgtggcatcacctctgttgccttctcgcgcagcggacggctgctgctcgctggctacgacgacttcaactgcaacatctgggatgccatgaagggcgaccgtgcaggtgacagctggggcccaggctgggtgggcagggacctggagcccaggcccaatgggttctgacttctctcttcttcacaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgt

SEQ ID NO: 35694 - DNA, 2271 bp, Homo sapiens
attggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggtaaacttcgcagagacgctcgatgactccgcgggtttttgccggcgagagaaaaacccgttacacagagggatgggggtgaagtggcgacggttgggaacgcgcggagacaggatttagaagagtggggggaggtgttttgtcggctgctagcggagcagcctcggatctcgcggcgggcggcgacggttgggtggcgcgcgcagcgccgctgggggccggcgggcggaggcgcgcggccgtggcgagcgcgcggcggggggcgaacgggcggggtcgcccctgcggcgcgccgcgggccggagaccccggcagggtgcggggacgcgctcgcggcgggacgcgccgcggtgggggatgggcgcgccgccttggtaattctatattctccgttcctcctccgctcgcgggcgtgtgcgcgccgcaggctggcggtaaggctggaaaggactccggaaaggccaagacaaaggcggtttcccgctcgcagagagccggcttgcaggtcagtagttgttcgtgcagtctgggagtcatgatgtttttctttgcatttccttttttgttattcatcgctctcgatgggcgttttgtgtatgcgtgggtgatgcggtgtcgcgacttgggctgcccatacgataaatatgggggggaggaatcacgtgtttcgatgtcgggacgcgttgctgcgcccgtgccccttgctttggcgcgcatataatttccccatctctagttctcatttttgtgcatttatgtttgtgtatgcttaaaatttaagttcccagtgggccgtattcatcgacacctaaaatctaggacgaccagtcatggacgtgtgggcgcgactgccgctgtgtacagcgcagccatcctggagtacctcaccgcagaggtaaatgggtgaacgcctataatccggagaaggtttggggggcggggaggcggcaagagggaaggaggaaagtgatgcaagaaaactcccaggccctgaacgcggcgagaggcctaagagaacgctagagggagctggtgttcaacaaggatcctactgagcttgagttctctgctcttggaattaaaattgcgtgccccctgtatatcttgccagtcagatagtgaggaacgattccagttggtagatctgcgtttgtgagggttttattctgttctctgaatcttggccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacttcatacttgagctgcatgtttttaaagatacctttcaagttgaacagtatacactttcttggtttcaaatactgtgattttttaaaaaatcttaagtagaattaattcctgtcactctcctaggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaacta

SEQ ID NO: 35695 - DNA, 26033 bp, Homo sapiens
gcgatccgggcgccaccccgcggtcatcggtcaccggtcgctctcaggaacagcaggtgaggtctccgcggcccggcttcgcgccgtagggtcgccgcgctcctcgtcggccgggggcggggttggagaaggcgggcagagaggccggaaaacgcaggcgccagctcgcgcccaggtccgggccaggttcagctgggatgcgtgagccgatggaggctcccctggcatctgggagtgagtgtccagagaatagcttccctagttgacccacgagccatgtctgtgcccacgaatgtgggagcctgaggccatggggggtccccgagagagagagggtgtctgggcacttgcccatgaacggaccactgcatgcctgagagagaagggccctgacaccaggaacttgtgtggactcagggcgagtggccacctggaaggacacttctcagccagtgtgcccactgggagggggacagcgtgtcccttgctggctcgagtccacagggcaccagctgctttgggcacaggggagctggttctggggctgctctactccatgggggccatggtgaggatgagaccaggccaggttccttggttgggccctgggccctatgccaggttggctctgagttggatgcgcactgccagccaggatataaccaacaatgtccccagattcccgtgccacctggggccaggcaaaataggttaaaatccactggcagacccatttgtaagtgctccgagtgcaccgtcaaggtgggagcttgggaatgggcgacctcacctgccgcacctggacttgccagcacaggtctcttctcaccttgccagtctgcggcttccttccctcctgcgccccctggctacgcaggcctggaaacagctccttagggatcccagctgaacagctcctgggcttgggctatacctcccagtgggagggtctggcctggggtctgagggccaggggtggtgtggtgggcggggtgtgcctaacatccaagaatctactccaaataagggaaaatatgaaagagctggattttggcttcccaggactgcccgatctggtggctttgggatcgggcgacatctggcggttgatactatgttctagggacaagaaccctctacacgcccattccttgtttcctctaaatagggaaaagctagggctggaagacacggcacccacctcctgacactctttctgctggaattgaccactggtcactctgactcagtttccctgagctctgaagattaaggaatgaacccagacaacccagctcaatggcccttagtggagagagagtcaattattgatggaattccgtgcctgggaacttgctttccagtggggcagggggaccagaaggacaacttcaagcccgtcttgaatggggcccgtgcagggaggggtctgtatgggttcccccttcccagccctccctcccacctccaccccagctcccagacgcccaggcgcacttggtgcaggtgtgtctcaaagtggtcaggagaggggacaatatacaggggttggcctcagtactggaaaatgccatttgcaccccctaacaccactactagtgggaaaaaccagtggggccacaggctgccccgaagtgaatgtgctgggcggatcacagccccaccacgtgtcatgtagacacccagggctacaggagagtcaaccatatttgggcatgacgtgctggccaacccagggcctccatctctcactggtctttagcagataaattaattattactagaattgaacaggagggacagatacctgccttcctagaaaaaaaaaaaaaacactcagaggaggaaacattctggagaggggaggtaccgaggactgagagggaggggagtgcacaatggggaggaagccataggcaggctggcttctgactgaagatagtagcagtgagcgtccccagccgtcccctggtcccagtctacatctcggcacagcagccactgcaccatctccagagttatctaccagaaaattttgagtgaagagcccccacagctctggggacacaaccccccaggcccctgatccctgtcctcaggcctcctctgcacctgccaccacacctgaagcccacccagacccaggtgctcagagcctgacaagtcttatgggaacctctgagcaggcccctctgggtctggaatgccactcccgtgtttgccccctgccctggccacgctgggctgaggggactttccgacaggagaggaccccccgcttcagctccccccagtgccccgggtgaactggcatgaagggttaggcgggcacacgtctctgcatgcatcgcacggcgccctctgcccgcgcccactggcgtgcccgtgggcatgcccggaccccttcgaaggctgcttgctcctggagtgccggcggcctcctggcccagtgccccatatcctcccgggtggagggaagcagagagggaggcggtgggaagcagcgggcacaggtgcgcgggcgagggccctacggactgggaaggcgggcccgtggcagggggtctgcggggaccgcgtaggcgcaggccttgccctgcagccgcttcccaggtgatgagcacacaaagcgccctcggcagtgcctggtccggggctgccgctctccaggggttcgctcttagggttggccccttcccgccgctgccgggccggcggacggggatgccgccggggaaccctaggccctgggggcccggggaagggggatgacggcggggggtagggatgtgcagggacggggcagagcccaagtgacttagggaagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctgtttagagagggccctctggccttcagaggcccgttggttctgaagtgtgggttggagctcgtgcgtcccattgtctggggctctgggctctttgtgtccctggaggatgggtcgcccatcggagatggctccaaccaccagtttagatctacccccccacacacacacaggcaacctgggggccagaaagaagcatagttagcaaaactgcacccggggtgagttgggcgtggttgactgagagacctggcttgtagactacttggacgccaacttttctcttcatcttgggccaaactcttgcttccatgtaggccttgcttttctgcgtgtagcacgcaggagttggttggtagatgctccagcgtgcattgtgccagcccagtgtctgtgtcactggactggagaggctggcattgaccaggcctgctgcagcagcccaattcgttctcaagataggggctgcatgagagggcaggccccagaatgggtgactcgggggtgatgtggaacagggagaggagagggatgatgagtcttctcttcttcagaattgagaggccttccagttaccctgcagccctggaatggcccttgctgaacccaagaaagtgagggaccaagacttgggttcccccagccactcagagggcagatcccaagaaccaaagttctttctttggaatgccagttgaggcgaggggcaggcccacccccacaagtcccagcctcagtctagccaagctgagtcatctcagtcctggatggtagggggggcgaccggatgtggggaggcgggccacaccccagctctttagggggggtctcctccctcctcccagctcccctcctccttgtgagctggctggagcaggcctagttcccagagctttgccatataaggcaaaaaaatgttggaaagcagcagtgattaggggagggaggggttggctggcccaggggctggggaaaggggggtgggatggggcggggccatccagccagacagtctcccagccctgggccctggtccttccctctctcttttgggagggggatggggacggagtaggctggcctaacatggacctggtgggcctggttgctccccgtgtgggggtcgttgaggggtctgaggctggactggggtgggggcctgatgggaagccctggctggccttgttccctggccctgcacccttggtcctctccgagtccccctccctgctgccatttggggagagtgaaaggcagcctcgtggggccaggaccaacctgggaactggggaggccactctgagcggctcacctggccctccaggtgctgcctgctgggctgggaagcagctgccatggacagcccagcccctcctcataggcccgccccctagttgactcaccagagaagtattttgtctgattatgggggaggctgacagggcttctaaagatgagccatcctgccttgagcctgagacccagaagtagccttgggtggggcccagagcccagcagggttgccatggtgatggggggtgtcagggacccgccctaaccacttcccctgtggcgagcctgccgaggcccagaggcccgttaggtggcaagtgggtcaggcagtgggtggcaagggggttcccagtgtctcctgctgccaccccggcatctcccgatgggccccagtgagtcagggccatgtggcccaactgctggttcctttgggctctgggcccctcccctggctaggcctgtggcctcccaactccaagcttgagtcttcgaggtggtagaggaagtgggggtggtggcgggggtcacaatccctcacccaaagggcgtttgcccaactcccccacttcccctgcctcaccccacccaccctggaacaacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagccccaccaggggtgcacccgtgtgccaacgtcttccccataagacagtgtcccatctaaacgtggcggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggaggctggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggtaagttggaggctgcagcatgggcacctggggacagacgatggcaaggacggcccaccctgaggctccagggcactgaggggactggtggctgttgtcaggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtaaagagcaggctgtgatggcctaagtctcgccctgctgctcctgcttggggtctggtggggatggcactctgtgtccctggccaccctgcctgggttgtagctctggcagcctggacctggccccctgacagctgggtggtctcccgctaggtgaaggcacgtgggcctggattggagaagacaggtgtggccgtcaacaagccagcagagttcacagtggatgccaagcacggtggcaaggccccacttcgggtccaagtccaggtagagcacccacgggtgttgggggcagggcaggtgtgggcacccaggcctgggcactgaccagcaggccacctgctcctatctgcctgacaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgagccaacctccaccggcctttagtccatctcgatagcattcacgtagcacacgattcgtccatttcaagtggttgtggcacaccatcctgactcccctgtcccacagctcctggtgaccactaacctgctttctgctgtggctttgcctatcctggacatgttctatagatggaactgtgtgccatgtggccttttgtgtctggcttctttcgctcaccacgaagttttccgtgttttcgttcatgtttggcatgtcttggcactttgttcctttataattattttgtttatttatttatttatttgagatggagtctcacactgtcgcccaggctggagtgcaatggcgcgatctcggctcactgcaggctctttctcccaggttcacaccattgtcttgcctcagcctcccgggtagctgggactacaggcgcccgccacccccccggctaattttttgtatttttagtagagacaaggtttcactgtgttagccaggatggtgtcgatctcctgaccttgtgatctgcccacctcggcctcccaaagtgctgggatgacaggcatgagccaccgcgcccatcctggttttttttttttgagccggagttttgctcttattgccaggctggagtgcaatgacgtgatctcagctcactgcaacctctgcctgccagattcaagcaattctctcctgcctcagcctcctgagtagctgggattgcaggcatacgccaccattcccagctaattttgtatttttagtagagacggggtttctccatgttggtcagactggtctcaaccgcctgaccccaggtggtccgcccaccttggccttccaaagtgctgggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcaggtagccacaccctccactacagtcaccgagtccccagcctcctcatgcagcagcctaggggacagctccgagggactttctgcccactctcattccttacctgggagaggacaggcatggaggtccaggagggggttggggagcaattctggtgtctctaaatacccccttcccttctgcacccttcccagggtccagtaggcgtcaatgtcacttatggaggggatcccatccctaagagccctttctcagtggcagtatctccaagcctggacctcagcaagatcaaggtgtctggcctgggagagagtaagtagttggggcccttgtcgcaaaggcctttgtcacatccagggattggctgagctgggtgtcatgtctctctccttcctttcatcgtttccacagaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtaattggggtatgggaggccctaagggtagaacccactgtgctctctgagggccccaaaggtaccccatcttctccagacctgccctaaatccttttttttttttttttttcctgagacagactgtcaaccttgaccctgtttaagtgagagtaaaggggaggagggaaatagaaacccacaaaaagtcatcagggttgaagaatttcttttttttttttttctttctttttttttttttttttttttttttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggtaagggagcccccaggagcccgtgtggctggtgggcctgggaaccccaggaatgaccggctgtctgtttggaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggtgaggaggtggcggccagggcagggctgggactgtctgctcgtccccaccctgtctcatacagccgccatccctttgccccaaccctcaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggaggtaagaggcagggcctgctgcctgtggggagtggcccaggctggatgctgagaacctgtctgactgctcacaacaccaatccctcacagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggtgagctccgggcacaggcaggggaggcaggggggcctgggcggctggagtgtgggctgcgggtggctggtgtctgatctccctgcggagctgcaccaaggagggcagggaaggacagggcccctgtctttggtttgctaaggttgtgactaccttaggatggtggtgacaggcacaggcttccccagacgtgcacttgctgctaactttgagcacgtcaccaaagccttctgtgcctcagtttccccacctgtaatattctcatggggcaggtataggatagaagcttgagatcaccccggtgagctcctcctagtgctggccaggccctggggctgaggatgggtgccaagctggctggccgcgcctgttgtcatgtgggaagtgtgggatgttttagtctccattctggactctgccaggtgcaggcagcccttttgggccatagcagttaagatgcctgaggcccagagactgtccctgtagcagcagcgctgggcactctgggagcgcctgaggcaggcccggggctactcgggcttgggccaactgcctcccctgcctctgccacacaggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgagcccgcccgctgttggccgctgcggcgctcggcacggggcttgggttgtgcctgtgtgcaagggctcgctgcttggggcggcgtgtgggagtgggggccgcccccttgagtgactcacctgacctttctccttgctctctgccctctcacctcagtgtcaatcggaggtcacgggctaggtaagctgcttgctggggccactcccaatgcccctcctgcccagaggggcagcttcctttcctcttggggccgattcccaggacagttccagctgcagctctaggcagggacagagttgggtggggtgcagaagatgaggccgtgggctggagggcgagggcccagggaggcttccggagctgagcatgaccgctccagctcttcccctctctgggcctttatttccccatctgagaactcgggttgcagctgagagctttggggtgaggtgcatcctgagaggcaccccactggggactttggggtctcgggatcttggcacccagggaggcacaagggctcctgcgtgggctgagggaacaaggggtctccccaactcaatgggagccccagccctggccagatccacagacccccatccccaccttccaggggcctctgcgtcccgggccgggggaggtgcatgagcgggtggggctggctggtagtgcagtagcgccagtgtcgactgcttgggcggccagcatggcggggcccggcccagcctcagagccccaaagtgcattctgtggcccgtctccctccttcccccttcccctatcccccagcagtgacgttattcagacattccccaacaggcatggagggtcacctgccccagccagggacacccagggatgctgatgagaggctacaggcctggcacttgggcgaggtggctaaggaaagggtgagagggtggctagagttttgcggcaggagcgagatggctttatagagcaggccgtaggatccgatgtgtgtgtgacaggcgtgtgtgcgcagggcgggggaggctggggagtactgattgcagggccttgggggctttgagggtgggagcaagactcagtaacctcagtttccctggctactgtttgcagaatggagacagggagcccggggtggggaagggggcgctgaagttgctctctggcaagcttgacggccacggggcttcagtgagagccaaattaggaggcatactttgaggatggagtggctgagacctgcggttggctgggagccgggcagggaaagtgggggcagtcgggtacctgtgaggttggggcccaagccactaactagatggcatggggtgcacatgagtgaagcctcccagggcagcgtgggcagccggcagccaggtctggagcctgggagagctgcctggccgcggcaggccagcatggagcctagtgcagcaggagccctcggccgatagtgggacttggtggcagggcccctcgagcttggccttcaagtaggtttcgtgctcctggctgcttccctggcaggaggccaggctgcagggggcactctcactgccaggcctcacagcccacagccccccaagcctccacggcggagacccagatcataacgtcactgtctctcccctttcctcgggcactctggggccctggagcctgctcagctgctctgccctcgcaacccagcagtggtggctgtagcttgggcctcctgttccctgtctccctgggtgctatccccgctctgccaagcctgctgcgctgcgctactcgggtgctaaccccgctgcctcccgcttccccgctcccactcctgtctgcaccgggctgcttttcaccgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcacaggtgagtggggacttgggaaggagctcgggagccaaggaggccagactgtgccaatgagctgccctgacctcagccccactgccccacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggtgggcctgccctgcctctgcccactccaccgccaccacctcacagagagatggggctgggggacacacgaggctgccattccacaaggcccttcttcctgcctcaggaagccccttgcagttctatgtggattacgtcaactgtggccatgtcactgcctatgggcctggcctcacccatggagtagtgaacaagcctgccaccttcaccgtcaacaccaaggatgcaggagagggtgagcaatagctctggtcttgacctgctctgtgcccgggatgccctcaccggggtaagggctggactcaggagatactcctgaatggggctccctgccctgctgccctggccatcggagctcctcagtgcaggccaactggagtgtccccagcatagttcccatgctcacccacggctctctccagggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgggtggcactgggagcagtgacagaaacgggtggcagggtgggcatggtctcccatggctggacgcacactgatggctggcctgtccccaccaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgggtaagcggctgaagggtccagggggttcagaaaggaggcagcctgtggggagccatgccctccctgactgacagccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggtaggcagtggctgcccaccagctggggcgggagcactgtgcatagcaccgaggctcaggggtatccatcccctaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggtgagtgcagcagtgcctcggcagcccccctcactacaccagggcccacaggcagtatgtgactggaggggcgtgggccgtgctttcttcctgcaggcagccccttctctgtgaaggtgacaggcgagggccgggtgaaagagagcatcacccgcaggcgtcgggctccttcagtggccaacgttggtagtcattgtgacctcagcctgaaaatccctggtaggggctgtgggaagcctggggaggggtcctggggctcaagcagccccaagaggaggggtggagcccagggctgctgctcactagcccatccccaccctgcagaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccaggtaggcctgctcacaccccgagtgctcgctctcctgcgttggccagggtggggttgggggtggaggaaagagccggcaggcatgtctaccttggctatgcctggagggggccgaggctggtgaagcagccttcagtgaggacaaactgttctcccacagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtactgggaacccggctggggttggaggaggtggggcctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacaggtaagtctgtcggtgcggctgcacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctc

SEQ ID NO: 35696 - DNA, 19997 bp, Homo sapiens
agcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaaggtgaggccatgggctctcgcactctacacagtcctcgttcggggacccgggccactcccggtggaccctcgtgccggccacccctgcactgatataggcctccctcagcccttcctttttgtgcggttccgtctcctacccagctcagcctcttctcccccgctcagacaggggtccccatcacatgccgctctctgagcgacctctccataggccttcgctggcctcagagcccctccctgcgtgtccttcccctggcggactgccttctcccacatcgtcgaattcctttccccgggttctacggccccgccgctcctcccaccatctctcttttcgggtgtagcgccccctccccctcggcgtacacccttcccagctcgcgtcctctcccgaagcccctctgacgggttcttcgcttccctcttggccttgccttcggtgcagactcccattacaggtctttttcttatctgccctctttcccccctcgagcgagcgtctcttctgtatctcccctccacttggacggccgcccctctaagcttctcccatcccgggtccaggaccccgtaaaatctgagcgggccaagggcctccgcccccaccctccgccccgcggttctcgcggtccttaaccttctctgaccgctccctctcccactccccatttggcaactctctctaccttccctccccaaatcgtgtttagagctcccttgtctccgttgcgacctgggtggtgggagggagggtaagagggatcgcccatcacccactcgcgcacttgtcgcagtgacccggcaggctgacattacttcccacctagccttttcttttcttgccctccctactcagtggcacccaacccgggataactctttactcggttcgcgagatgaggttgcggatgggtggtggctgttatccttgccagacctgaaggcctggttcctgagcaggaaaggttgtgcgctgcacaaatactagcttgctttatctctatgaactggttgcttcctgctgcaacgctgggaggatccaacaggaagggaagagccctagttagccacatacctttcccaaaaggttgggggtgggaggaagttgtgtgctcttttggttacattaaatatttattataagatacggaaacatgtagtgcccttggacagaacatattggagggtcagggttggttagaaagaattgcttattggttgagtccggaaggaatccggtttttttttttaatcaacgaagataaagggtacatttttcaatgagaagagagtacagtagatgctttttttgttcagtgaatgcactctcactctgatgctctttctctgctcctgaattgggaaggtagccatcagtagtgtgccgaacaaagatcattaccactgaggaagaagccattgctattaaagctttactgtggagggtggagtttcaagagtgttaagcatggtgactgtttctgtctttgccattgggtgctaagaatgattgactaaaccaagcaggaaagatttctttgctttcccaatactttgcaaatcttgttatactaactagtctgctgttatactcttatcatctcttactcctctgactcagaatattctactgtatagggtgaatacttttggtatccaccctccccctccatactggaaagtactttcagggtacttagttcattttacaaatacaaaactgaggcctggattacaaaaagtatatgacagcataccttttgccgaaggtatctgagatgatgtgaaactatttgaatctcttgagactttggggttaaaggttaggtttgtgttttgaaatatggtataatggtagtgtgcttttataaaggttgtctttgaagtaattaattcagaacaagatagaccgtcagggtatttctcctgtttggtttgaacttgaatgttggttatacaaggtccttttattttttaacaaagaatattaaatattctgaattggcctaaagtattttaactttttgattagaccatccttctagcaacaattgagagcactgagctttggaatcacgtagacctcggtttagatcctgactcaggtcttatatttactttatgaccttggaaaagttaacttttctgagtctcagttctctactttataaaaaggaaaatacctgcctcttaagattgtgagaattaaataatgagactgttcgtaaaattttaaccatgaggactcaataaatggtaataatgtgaaagaagttactgtggttttgtcagtttttttttttttttttttttttttttttggagacagggtctcgctctgtcccccaggctggagtgcagtggcacaatcaaggctcactgcagtctcggcctcctcaggctcaggtgaccccccgacctcagcctccctagctactctctagctcctaggagtagctgagactacaggagcgcgccaccacgcccggctagttttttgtttttttgtaaagacagggttttgccatgttgcccaggctggtctcgcactcctggacttaagcaatccaccttcctcagcctccccaagtgctgggattataggcgtgagccactgtgcctggcctttgtcagttttttgaaccttaaatgtaggttcaactacaagagcatttaaatattattaaagaaaataaaactaggaacttcgaatgcattttatgtttccatgggttatggtttcattttgttgtgcattttgctgtttaagatagggtgttaaaaattctgctaaggaggatttctactttttttttttttttttgagatggtatttcgctcttgtttcccaggttggagtgcaatgacgcgatctcggctcattgcaacctctgcttcctgggttcaagcgattttcctgcctcagtctcccgagtagctgggattacaggcatggaccaccacacccggctaattttgtatttctagtagagacggggtttctccatgttggtcaggctggtctcgaactcctgacctcaggtgatccgcccgcctgggcctcccaaagtgctgggattactggtgtgagccaccgtgcctggccagatttctacttttttaaagctcttacaggatatgagtcactttttctttttcttttttaacttcaatgctgattatttagccaatttcttatttatacaagtatcctactttaaagtgaagcaagaatgattttatttcaaaatggctttattgtacagagatttattcactgagatggactgcagctgtttctacttagaaggtttacctagcaaatgcaatagttgagggaattggagttagtttgtaactaaccagttcaaaataaagggatattttgattaataggggatggagtggtctaaataggaatgtaatgtggggcgagcaggacaattattctaaattatgtgtttgttcttgaacagtaacctttatttaagcccaatagtgagacttttggtgggagggaattagttttattttatttaaagttgactttttatttttaaaactttaattccttaagtatttacgaacaatgtggttaaggccctgtgggacataagtaagcatcaatcatgatttctgtttacaaatattgtgtggtagacaccaatccacagttagattttctgaaaatatctggatacatagtctattgcttaagacattttcttttcaatcacattggaggtcagtagtaattaaccatcagctgattgtcagtagaaattatcataggaactttgctgtcttgcatcttggtagtagtttttctttcacaagttttggttgagcaactcagattctgctgaatctggaaaaacttgtctagacttgagccttattgtatgcattatatctatatctatatctatatatatatattttttgaggcagggtctccctctgttgcccagtctggagtgccatggcacagtcatagcccactgcagcctcaaattcctgtgctcaagaaatcctcctgcctcagcctcccaagtagctgcaactacaaatgtgctccaccatgcctggctatttttttttttttaagactatcccacttacagaaataaaattttcttttttgtagagatagggtctccctacgttgcccaggctggtctcaaactcctgggctcaagggatcctcccaccttggcctctcagagtgctgagattacaggcatgagccactgtgtcctgccttgaacgcattgtatattaaaaacttttgaggaggttggactatgaatatagttgaaagaatagaaatgtctccaaatttatgaaaactagaatgaaaattaccagttattctctcacgtggtaacttttagggttgaggtactgtctttgatgaattatattttagtccagtaaattagtttgcaagagaaagtataaaactaaatgtggttgaagaggcagaaattttcaatggataattaatatgtatattctgcttttatgcatttagcagcttgatattcagtattaggtatttgcgatgatactcaaatacagcagatgtctagttgataacttttttttttttttttgagatggagtttcactcttgttgcccaggctggagtgcaatggcgcgatttcagcttactgcgatttcagcttactgcaacctccgcctcccgcttcaagcaattctcctgcttcggcctcctgagtagctgggactacgggcatgcgccaccacacctggctaattttgtgtttttagtagagatgaggtttctccatgttggtcaggctggtctcaaactcccgacctcaggtgatccaccctccttggccttccaaagtgctgggattacaggtgtgagccaccacgcccggcctagttgagataactttttaaaacattcatgaattttgagttattttcagattagagtgctttttttttgtagtgttaacattaattggttacattaagagaaaagttcccttgctatctttatgatggtataaggagttgagattggtgagataatgaacataatcattagttaaaagtggaggtcaaaagggaggaaaccaaaacttgaaagtgctggagttggccgggcatggtggctcatacctgtaatcccagtactttgggaggccaaagcgagtggatcttttgagccctggagtttgagacccagcctgggcaacatggcaaaaccccatctctacagaaaatacaaaaaattagctgagcgtgttggcatgtgcctgtagttccagctactagggaggctgaggtgggaggatcctctgagcctgggaggtctaggctgcagtgggctctgcttgtgccgtggcactccagcctgggcgacagtgagaccctgtctcaaaaaaagaaagaaagaaagaaagtgctggaagttttttttttgagacaagttctggctctactcccccggctagagtacagtggtgcacagtccaggctcaccacaacctctgcctcccaggctcaagccatttgcccacctcagcctcctgagtagttgggactacaggcatgcaccaccgtgcctgtctaatttttttgtttgtatttattcatgtattttttgtgtatttttttgtatttaaatttttttttttgtataagtgattcaaaggccatttccttagcaaacatccagccttttgtactaagaggcaacagtgaatgtatcctattaataatagactattaactgaaactgagatttgacttcatatccagaatggtggaccttggaaactagtatatcaactaaccatcctataaaattgaaagtgcattgcttttgtacatcactttaataactttgacattttcttctgatatcaaataaaagcatgtatgtgtttgccacagcatctttgacaccctctagttgactctctagttagaaataaccattctttgtgctgcattggattcactgcctcctgaatgatttcttgctgaatcagctgactgagaaagccagaaagatatgcatttgataatgtactctgtccaagactgtccagaggctagcttatatccactcctgtggcaaggagggaatgtataatggactctctttgccctctgaccagaatgcagtgagctctcagtttttaccattctttccactcgtaccaccatcccagtctctttagtaaggaatggtcttactccttggccttatttttgtatgtttgattttctagtcctgatgtctaaatcaattagctagtttagataagaagaagtcttagtagtcaaaagtaggaacgaatgtaatgtttcctgaaatgctgataccaatttttacaaaggaaaaaatatctagctcagattctataaacgtgtgaactcattttgaactttaaattcagatagaaaatgttttaaaacaacttaactgcctgtttctccattgtttttgaaattcttaagcgtaataccactttgagtgaaaaagaatctccatgtatctagttagtaaataaactgctgcctatagaaatcacaggaagcaaattcatctaatcaagacctattttcaaaaaaatcatggagtcataagtgaaagtatatgccctccttgctttgttgtattttattttatttatttttttaagacagagtctcagtgtgtcgcccaggctggagtgcagtgacacaatctcggcccactgcaacctctgcttcccgggttcaagctattctcatgcctcaggcccacaagtagttgggattacatgcgcccaccaccacacctggctaatttttgtatttttatagagatggggttttcaccatgttggccaggctagtctcgaactcttggcgtcaagcaatccgcccaccttggccttccaaaatgctgggattacaggtgtgagccaccacacccggcacttgctttggttttgactcacagtatgtcagaattattagtttcctaataccccctgtttatctgtagtggcttgggtttttttggcagaggggtctctaactttgaaccaatctgataaatgcaactattaaaggtcattttagtttctgtgatctgtatggtgatgtttataaaccctatgcctcatatgttaaatgtttttcattttgcctaggtctcagtcctgaggtcacacccagtctttgatgaaacgaagtatattcattttgtccttccctacccactaacagcctttgttgttttcatttctgatacattacattttaatatcataaattattcatttagtttaggatttatctttgaagttgttatcttctaaagtagtaagattggcatagcattgacggtaattaatgcctgtcatcaatgccaagggcatctgtgattaaaactgcatgtttaagacagggtaccgtatctgtgctaagcagatgatatgtggaagtcatgcaggtagaaacaggttgaaaagaataaatcggttttattgattggtaactggtcaagaacatgctgttcaaccccctacccccattcctttttaaaagtcatataccttatttttcttgctttatttactctgaagccaaacttcattctgttgaaagcatagtggtgttctgaatatgtttgcctcattcatctgacattgaattctttgtctttccagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcgtaagtctcatggtttttaagttctgtgaaatgggttgccatcgagtgaattagctgacttttggtattggaaaaagaactgttgtttttttcttttaagaattctagtattaggaatccttagaaatttatttataagtatgtttttaaaactcatgatccatattttgagttcttcctggtgtttgcttccatcttgtggttttctgatactaaatatgtttctgttttcagatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcaggttagtgataggaattccatgatatttcttaccattgtgtcttgtggttttgataccttccaatgagagtaataggttataatagtttcagagaggtaaacatgaatgcttagcaagaattgttttgaaagtttgtgatgactgtatagcttttttgctttgagtcattaaaacactaatattttgctgccaaaaaatgaatataaacattgtatattctgtctctttttctgttatgtttctgtgtttacaaaggctgctgtacgtgagctctatgtgagtgaaaggcagaggctcagggagtgtcagggaccaacagggatgcagctgcttaggagctgtaactttttggcttcataaagaattcacgtgtctcttgcccctgttctggtagggacagcatgccagaagacaacattgtgcattgtggctagtgaaagtcttgcggccgggcgtggtggctcatgcctgtaatcccagcactttgggaggctgaggtgagtggatcatgaggtcaggagattgagaccatcttggctaacatggtgaaaccccgtctctactaaaaatacaaaaaaccgggcgcggtggcgggcgcctgtagtcccagctactcgggaggctgaggcaggagaatggcgtgaacccgggagcagagcttgcagtgagccgagatagcgccactgcagtccggcctgggcgaaagagcgagactccgtcccaaaaaaacaaaacaaaacaaacaaaaaaagagagaaagtcttgcctttgcactaatgcttatgctatgaataactttctgtaacagttttttaaatttcccatgcaagaatagctttattgtaaataatatggctacaacatacggaatactatagccaatgtagttgatggagaggatagcaagagatggaaataactgggcacttgatacatttttaccacattttaagtggtgtcattcgtcactagtgagtagtacttagatataacaagtatttattttaattaaggagccaattgacaatttctcactttttttttttttttttttgggagccaggatctcactctgtgacccattctggagtggagtggcacagtcaaggctcactgcagcctcgacctcctgggctctagtgatcttccacctcagcctcctaagtagctgagactgctggtgtgtgtcaccacgctcagctaatttttagtattctttatatagagagagcaaaacctctctccagtgttttgccatgttgcccaggctggtcttgaactcctgggctcaagcaatccgcctgccttggcctgccaaagtcctgggattacaggagtgagccaccatgcccagctctcttgctattatttttaatctattaaagtgtaaatattaaagtgtaagtagggtcgggcatggtggctcatgcctgtaatctcagcattttgggagatggaggcaggagaaactcttgaggccaggagttcaagaccaggctgggcaacctagtgagacctgcatctctacttatataaagaagtaaataaagtaagtaaataaataaagtgtaaacagaatggtgcccttactgtcccagaagttgaggaggtcttaagttttaaaaagttctgttatttttccttttgagggcttgagtatatcctattccttgttttaaaacttaacaagactgaacttttgtgtctcccctcagaaaagaatggtttgtcattcattgaaacttcggccctagactctacaaatgtagaagctgcttttcagacaattttaacaggtaagacttgtattttcagattacaccagtaggactagaagttttaggaaggtaatttaaacaaactaatcagtaactaaactatatatcagccgagagtgactatcatttgagagctactctagcaaaagctgtttagagtgcaaaattaactacaacccttgctcactgagcttcagttgtcctaattcatctgatttatagtgggaaaaatactttgaaaataattcattcacttccattattacttcagtccaggtattccattcttcatggtcacaaagtaatgtttaaatgtacttttatgaggtaaatattgagatcccagctatagaaagatataaatgcccttttttaaatttagtaaaggcaaagctagggaaaaaacatttttaaaaattatagcgacaaaataaaattctcccatgatacagaagaagggtatcccttgcgtattctatattgtatcatgggagataattggtagataaaatcagccaatgattgcatatagaaaagttttaaaaagtagttggaaagagatggagttcatgctgttttggaatgtgaatgaccaggtcagcctctgagataagaagtgttcactcatatttatcctgaaactattagaataaccagatttattagtaagattagtcttaatcttctaattagtactttgatgggttgtttttaaatacttttaaattgtatgttacttttaagaactcatgatttaaaatgtggtcttaatatatagtatagttttacgtggcattgttctaaaaagtctatacagagatatgattgagtttccaattataatgtaacaagttttgatttattgtttgtatgcagcccctgtattagagattaacagattttaactttaacatgttatcttcttttactgtaaaaatgtaagcgtaaagtcaaggagttaagatttggaagcctgacttgggttctagtcctggctcctccacttactgttagttgtacaatcttaggcaagttacctaacccttttaggccttaatttctccatctataaaattcatatatattttgaggagttttgttatttcttttttgagagaaggcttatatttataaaatcttgtgataggatttgacttgacttttgtgacctaaaggttttttgtctcagtaacccttagcaaagaatggtctgtcactgccctagacttcaaaaatgagtacctgtaaagtacccattttgaatactgtaaattacttatctatccctggtatatagagaacagttggcaaattagtagctgaacggcaattaaggcatgagaaaattggagatttatgtacctattttattataattcttttctgttatcagaagaatagtgctggggttggataagcagtctttggaacacagtagctttcctttagaatgttctctgtcaaagtttcactgcagattgttttaagcaagcaagatttgattaaatatgtagtatgtctgcaagtccttgttttctttatagccatttgtgtacattttattaagtcaacatgtagagtactagattgagacccaggagttctagggcattacatttttatcactttgcttctactccccgtttaactaaagtcactgaacctccctgctcctcagagtcatagtcttaaaacatgtgaattaaattaccttaaagatgtgtgagcattttaaggcctcagaaagtctcatctgaaaaaactttttagacagtcctcattgttggaatattttttatgttccatcaaatctcctctgctgtaattctggcccatttattctgatattaagtgaagatgagcccaagtcttccatctgcagttaactattttatgcatcattttgtaacattgagcttctgatccactcaaacatgaactagtcggtacttaaaattgagccctttaagagctgggcatgttgatgcacgcctgtaatcccagcattttgggaggctgaggcaggcggatcgcttgagctcaaacatcctaacacctgtagaacaacacagatgtctgctgccacatgcagtgatctcaaaagttcaagaccagcctgggcaacatggtaaaaccctgtctctaaaaaaaaaaaaaaaaaaaaaaaacacaaaaaaattagccaggcatggtagtgtgtgcgcctgtagtcccagctgaggtgggaggattgcttgagcctgggaggtttaggctgcaatgagccgagatcatgccactgcactccagccttgtgggcagagtgagatcctgtctcaaaaagaaaaaaaaagatgaacatatagttgcttttcttaaaattcactctagattgaacttttgttacagcttaattgttgcttgaaagcaaagaagactttagtttcacttgctaccacttttcctttctatattcactgtttcctcagcttcctgcataaatctcactgttggtctgtaggatcagagatcactgcatgtggcagcagacatctgtgttgttctgcaggtgttaggatgtttgttctaaactttcttcctcctgtatgccagtggaagtgtgaatgcatagagaaaacagtgaagaggacagactctttattgcacttgattctaccttaaatgttaacagtcttaagggagtatttacgttgtgttttgatattgctgaaagaaaaaatagctttaaaatttctaaaaattgagatggagcccagtctggtcttgaattcctgagctcaagccatctgcttgccttggcctcccaaagtgctgggattataggcatgagccaccatgcctggccaaaaattttaagttgtaaaattatatatcagaaaatttacattgttacttcagagttaattgtgttgttggtttcagaatagacccatggcattcttgacacccatgaatttgaaagtgactccatgagatgattttgctgatggtatttttttagaggtagtttactagtatgagagtgagactggtagattgctccgcctctgaatttcagtacagctttgtcttttctcaggttcactaaaggatgtttttaatacataccttttacttttttattttaactttgcattttgacaatttcaaatttaaagaggttgaaataatagtaaaaagaatttgcaaatatccttcacccatattcctcagatgttaatattttaccacatctgctttgtccttttctttctcttcgctctaaatatatacatattttttcggcaccatgtgagattaagtggcagacatgatgaccctcatccttgagtacttttcagtgtatattttgtaaaaacaaggatattctcttttatagccacagtataattatcaaaatcagagagttagataatagtgccacatcagtgtttaattacagaccttattcagattttgccagttgttccaataatacccttattagccaaagaaagtccaagatcaggtcatgcgtttcattcagcagtcatatctctttagtctcctctaatctcgaacagttcctcaatcttttgtttattgaccttgacatttttgaagggtacagtccagttattttgttgtgtacctcattttgggcttttctgatttctttcctcatgattaaactcaagttatacacttttggcaggaacaccacagaagtgttctcagtgcatcatatcagcaggtttgtgataattggatgtcctattaattactagtgatgttaactttgaccacttggttaaggtgatgtctgctaggtttctccatgtaattaatatgtccaggatatctttttagcatgaacactaaattcttttttttttcccctgagtcttgttctgccaggcaagactctgcctcctaggttcaagcaattctcgtgtctcagcctcccgggtagctgggatcataggcctgagccaccatgctctctaattttgtattttaagtagagaccggttttaccatgttggccaggctggtctctaactcctggcctcacgtgattcgcctggcctcctaaagtgctgagattacaggtgtgagccaccgcccctggccttattctgcttttggtatgtcagaaaatttccataaaaaaaaagttagagatgtattaactgaattactacattttccaaaattaagaactaatttctcagaagttgaaaaacagtaagctgtagtcaactgaatatgtaaactaacaaaaacagacagcaagtgtatcttttcttagattcttttgtgggggaaggggagtggctaaaatttatgtctgagaaggttgacagtggttcaaatgtgaagaggcattaaggaaagacaactaggattcaataaagacaggctactaaaattaaaattaaaaaaaaaaaggatatggaatctttatttagattttgtttcaatgaaaaaggatgggatgggagggtgccaaggctaaagaaaaggatttacctttcagtcattcaatcagatgagtggctaaggaataaagataattaacttgcatctttaagctttccctctagtctcaaactgggaggctcttctttttcaagtgtaaattatgtgtgtaaattaagatgaaatatgtaacccactgtaagttttaacttccttataaattgttttgaagattaaattaggggaaccaaaacaaagaaaagttcttacataaaaaacaaatatatgtaaaactggaagagagggaaaggcagacttctcaaagaacatagagaagtaaataattaaagagatctcattacaaagcaagaaatttgagcagtgttggtgtgttacaagtacagcatactgttttttagaaatagattactgctgcacttactccagttaccaaaaaggatgtctgctaataaaaatgccaccaaagcaataaagagtgattggctttaagaggttccacaagtaatttacatacttaagtctcttgtggctgggtgtgtcattaaaaaaaaaaaaaaaccaaaccaaaaacctgataagaaagtaggaagcaggtaacttctagctgtctgattagagaaggttatttcattgggagttttgtgggggtgggggggtatgctaaactagatctatttccttctttcaaaggcatgttctcctttagaaccaaatgaatataccaattcctatgcagtcgcccccaccgtttttttttttttttggagacagggtctcacactgtccccaggctggagtgcagtggtgcagtctcaacctcactgctcactgagtgagactctgtctcaaaaaaaaaggcattctcctacataatcacaataccatatgtcgtatccaagaaatttaacatttatacagttttttttttttttttttgagacagtgtgctctgttgcccaggctggagtgcagtggtgctatctcactacaacctcccctccgggacaagcgattctcctgcctcagcttcccaagtagctgagactacaggcgggtgccaccccacctggctaattttttttttgtatttttagtagagacggggtttcaccatgtttgccaagatggtcttgatctcctgacctcgtgatccgcccgccttggactcctaaagtgctgggattacaggcgtgagccacctcgcttggcccatttatacagtttttaatgtgcaatccatattcatatttcttcagtatactaataatgtcctttgtagatttgttttttaattaaaaaattcaagatccatttaaagatcacatgtataggagccaagggaagtgtccctattgccctctgaaggtttgctgaaagctatctgatacagctttggacctttcacgaggtccaaacgataggtagaggttaggaagaaaaagaatcctgctttatcatttttatatcatttagatttctcttgtaggagatctaaatagaaacctctgaaagtttgctggaaaatcaactcacaaaaggcattttaattggagaaaaggcatacgaaatttattaacatgtacactgtacactggttttctctggggagaaccagagagatgacccacctcccaatggcattcagaggcttatgccattctggcaaaacaggttatgggaaggaggagaaaaggaattctgttgaggggattactggggaggatgaacggatcagtggacagaaattaattggtacattatctcgtgaaagagtctgtttaagtgtggttacattcttgatcttacagggaggggaagaaaaaacaattgtcccttttagtgggtctggatctcaggcagatgaaggaacttcagcttcatcctgtgccagggagagaggatgagggggagaaggtcagagagaccttgaggcttctttagttcagcatatcaaaacgccattttggagtatgggtttctgagccttaacagatggaattgttttgtatctgggatgttgaataaagtagccacaggttactattgagcacttgaaatgtggctagttagatgaggaattggattttaaattttatttaattaaaatagatggctactctcttggatagcacaaatttagaacatttatccccatctcagtctggatttatctcattatttcctcatgattaaattagttttaaatatttttgtcaggaatacatggtgtcctttataggaatacattgtgtctttcctagtacatcgtattaggaggctaattgtgttaatttgacacatttttagaattatcttgctttttgagagtagtgtttttggagggacaactgggagagtaaacaaaaataaggtacattctctgttcttaaggactttataatctagtcacagggaacaacttttaggcagtgcagtataagaccaaacgtgttacatacagatacttattgtggaggaatttagtgacattcatgcggttatttatttatcacaacacatgttatatgttgcagtacagcagtaagacagacacagttttgatccttacagagtttaacacttagtaaaagaggcagacactaaattatttttgataagtgtcatgaaataaaaatagagtttacatataacatcttaagttgcctattttgtatcattctttaattacaatttaagttttgttcaggaggtcactgataaacacattatctttttttcccttccaagaatcgtttgggattttagcatgtttgttaagatgtactctgccgaatgcgtctgatagtgcaaatttatttattttttgtgtggtacaatgtcattgtgtgtaggcaatttttgtttgtttgtttgttttttggggtaaaggtagactgaaaatactcttatggtttactttgaatctaagtccataaacaatgtaatgctattggcttacctcttttttttttttttgagaccgagtcttgctctgttgtctaggctggagtgcagtggcacgatctcatctcacgacaacctccgcctcccgggttcaagtgattctcctgcctcagcctcccgagtagctgggattacaggcacccaccatcatgcttggctaatttttgtatttttgtagagacagggtttcaccatgttggtcaggctggtcttgaactcctgacctcaggtgatctgcctggcctggtttacctctttaaacaaagatttatttgactggtgaacctttccctctgacatggaaaaacctttgtttcttttcttacccaaagggcaattgttaaaataaagggttgaatctaatcagtggctgtttgaaaataaaactttaaatttatgtattctctgttcagtttccttagggactttgatgcaaatatatctcctacctttatgtatcttttatcctaactatgataggtttattcacactaagtattgtggtttcttttttccttcagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggatta

SEQ ID NO: 35697 - DNA, 20534 bp, Homo sapiens
gcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagtttgccatgcccgagaatgtggcaccccggagcggggcgactgccggggctgccggcggccgcgggaaaggcgcctatcaggaccgcgacaagccagcccagatccgcttcagcaacatttccgccgccaaaggtatcactctcatggcctgacccgcggcgccgcggggttgtgctctgcgctctcatcgtgggcttgagcgggtttggctcatttcccatttcttcgggtgatcctctcttgtcctccctatagaagcagcccagtggagggatccttatttctgtttttctgccgatgatcgccaacccggagtatggaggcctttggacttgccccattttgcatcttaatctcccttagtttttcatcctgcactgtgcatcattcatattggagccgaaagcagttcaaaatgccgaggattgcatgcagtcttcactagggatctgacgcttgagggctgtcgcttattgcttattggaactggtagaatgcacagtatctttcagctttgttattcttatttaaagaactattaaataaacttcacttggcacaactgttgagacgaattgggtgaactctccgagtctaaattggggcggggcccattgtactgggatggatgtgggaaccgacttacgtgtcgtgtttgaaatagttgcggaaaagttacgttgatgtcgtctccgcatgtgcagtgaaacataggcaaatcaagaaacaattatttgttttttttgtggaagtgtgtggcacacgttggaaatcaggaagaccagagtttcattctctgcttccgttacttcatgtcttagtgacctgtaacctctgtgccaaagattcacttataaaattggaggaaaatgtttgctttttagagttaagattaagagaaatcgagttgaaatagaaaaatctggaaggaaaagtcaggacagaggtttagagatcttgcccgagtgtatattgagtatagtagttcttttgggttggagaatagtagtatgtttacagaagaggtgagattagaaagctaggttggggcagatgttaaaggcctggtgtcctggaaagtatttggcttaatctcccccagctatgggatcatttctttttagccatcgtgtaggcttgctgtgaggattcagtgagaaagcatataaagacccacgtatataaagtacaccttacatgtgtttgcagtcatcagcccaagtaactgggaatgtgatggcgctaagataggtaacgctggatgtaagaaaaagtaatagtttctaacttgtcctaatgagttggaaaggtcagaatggccagatttaggagtcatttgtaagtttaggagataatacacctggaaacgaaggtttgtaggataattgtctagggaccatagttgaagcttacatttattagattaggaacagaatgttgaaagataaattttgggtcgggcagggtggctcacgtctgtaatcccagcaatttgggaggctgaggctggcggatcacatgaggtcaggagttcaagaccagcctgaccaacatggagaaaccccgtctctactaaaaatacaaaattaggtgggtgtgttggcgtaggcctgtagtcccagctactcgggaggctgaggcaggggaatagcttgaacctgggaggcggaggttgccgtgaactgacgtcgcgccattgcactccagccagggtgacgagcgaaactccgtctcaaaaaaaaaaaaagataaatttgggggccaagagagtttataatatggttgatattcaacaaacaaaataagtgggaaatttagcaacctttgaaacaaaagcagacaaagaactgaaacaacagaggagggtgtgcatgtgggaaggaaaggccacctaagttatctgtgaagatgacccgttatgtcttaaactcctggcctcaagtgacggcctgccttggcttcgcaaagcgctgggattacaggcgtgagccaccgcacccggccccagagatgttttataacatactgatgatgaccaaaagctatgatttgagagttttggtttttgtttggtttgttaggtttggtttgtttgttgagatggagtctgtcttgctctgtcccccaggctggagtgcagtggtgtgatctctgctcattgcaacttctgcctcctgggttcaagcggttctcctgcctcagcctcccgagtagctagctgggactacagatgcgcaccgccacacccggctcatttttgtattagtagaggcagggtttcgccatgttgtccaggctggtctcgaactcctgaccttaggtggtctgcccgcctcagcctctcaaagtgctggtattacaagtgtgagccatcacgcccagccttgttggattttttagaagagtatcttgctctgtagcatttccattgtggtttgcccttttggcggtgttggcgggccacctatctaccatgttcacattagtgaacaaaagtctttgctctcagagattacatactagacagagtaaacaaataagtgaattatctgtaaattgagcattcctaatttgaaatactccaaaattcaaaacacttctggtcctaatcattttggaaaaaggatactcctccatcagtattttagatctagacagttctgttgctgcttgtcctgttttaggaatggaggaaatagcaattctcagagctcctaactagattgtaccattttgacatctgaaggaagatgagatgaatcctcaaaatgtattctgccataagctgattacaaatactaggccaggcgtggtggctcacacctgtaatcccagcattttgggaggccgaggcaggcggatcttgaggccaagagattgagaccatcctggccgacatggtgaaaccccatctctactaaaaaatacaaaaaaattagctgggtgtggtggcacgtgcctgtagtcccagctactccagaggctgaggcggaagaatcacttgaactcaggaggcggaggttgcagtgagccgagattgcctcactgcactctagccttgtgacagagtgagaccatgtctcaaaaaataataataataatactgtgtacgttgactaacagaagtgaagcatcatacatttaaaagaaaaataattgttgccaatagattatttttagacaatgaattttcttctgtggacatggtgatttgttatgcactatatcctaataagaacacaatgatcatttgaggggaaaaaaactctattctttaagaagtcttgatttcccatactcccagctattctgggaggctgaggtgggagggttgcttgagcccaggagtttgaggccatcctggacaatatagtaagaccctgtctcttaaaaaaaaaaaagttctaatttgttttcttttttttcccccccatctgcagcggttgctgatgctattagaacaagccttggaccaaaaggaatggataaaatggtaaagagttgagtcattgaatactactaattgagcactgctgttcacactacaagatcttgttgaagggttagatgtgctgtttaaaaagtggggctgggcgtggtggctcacacctataatcccagcactttgggagggtgaggggaggatcacctgaggtcaggagttggagaccatcctgaccaacatggagaaaccctatgtctactaaaaatacaaaattagccaggcatggtggctcatgcctgtaatcctagctcctggagaggctgtggcaggagaattgcttgaacctgggaggcagaggttgcggtgagctgagattgtgccattgcactctagcctgggcaataaaagcaaaactctatctcaaaaaaaaaataaataaaataaaaatagtagaaagtgggtggggcacagtggctcgcacctgtaattccagcactttgggaggccgagacgggtggatcacaaggtcaagagttcaagaccagcctggccaatatggtgaaaccccgtctctactaaaaatacaaaaattagccaggcatggtggcgggcacctgtaatcccagttactcaggaggtgggagactgaggcaggagaatcacttgaacccaggaggcagaggttgcagtgagccgagatcgcgcagctgcactccagcctgggcaatggagcgagactccatctcaaaccaaaaaaaaagtaaaaagtgttgggtacctggaattcagaggaaggagaggttactttggagtcaacaggactaaactataattcatattttgtttaatgcttcttaaacaatgagaatgcacacccaaatatagatatctattatgtagttaagtggaaactattataaatccaggtgttgggacttcagtttagtgttccttatggatgtaactttgtatcttaatgtgggtctctgtgagataaaacaatatggaggatcatctggatgatactatagattattctccgctctggatattcaaaaatctatctttcccaaaaatgccattgtcctttttgtaggacaaaaaaggaaaaaagttactgtgttgactgtaagaattgtgttcaccgcatggcatggtactgctttaggggcatccatggtggaaatcgtgtttctgattaataagaaatcattaaagatagcaagtgcttctttataatatttttccttttgtgtgtgtgtgtgtgtgtgtgtgtgtgtgtgtgtgtgtgtgtctacatttcttcacttttagattaccctgcaacaaagccacttttttcttttgtaaagttggactgttattgcgtattcttaaactattatgctaatgtaagggaagagaatttaaaattaagtactttgcaaacagaaattaacttctctattttgaaatgtaaaagtttaataaaactattaaggtgtgacattgaaatataactttaaaattttttttctagattcaagatggaaaaggtgatgtaaccattacaaatgatggtgctaccattctgaaacaaatgcaagtattacatccagcagccagaatggtaagtgtaattttaggtgagtctttttttttttttttttttgagacagagtcttgctctgtcatccaggctagagtgccgtggcacaatctcagctcactgcaacctctgcctcccagattcatttctcctgcctcagcctcctgagtagctgggattacaggctcgtgccaccatgcctggttgatttttgtattttcagtagagacgggtttcaccatgttggtcaggctgttctcaaactcctgaccttgtgatccacctacgttggcctcccaaagtgctgggattacagacatgagctactgcgcccggccagatgagtcttcttttttaagtgtgtttgatacttggtaaacagttaaatttatttgatcacatgatatttaagcacgatgaacacttttcgtgctgaacaggcatatttttaggatacattgtgtgcctaacattgtgctttttggtgtgaggtgataataaaacacaaatcaagccaggcatagtggtgcatgcctttagtcccagccactccataggctgacatgggaggattatttgagcccaagagtttgtggctgcagagagctataatcacaccacaacactccattctgagtgacagagtgaaaccccagaaaaaaaaaaaaaagctgggcacagtggctcacacctgtaatcccggcactttgggaggccaaggtgggaggattgcttgagctcaggagtttgagaccagcttggccaacatggcgagaccttgtctctactgaaaatacaaaaaataatagttgggtgtgtggtgcgcacctgtggtctcagctactcaggaggctgaggtgggagaattgtttgagtccaggggaggtagtgagctgtgattgcgccactgcactccagcctgggtgacaaagcgagaccctgtctcaaaaaaaaaaaagaaagaaacacaagtcaccttatacttgtccacagaaatgattatttttcctttcatatgattattgtgttcttattagggtatggtgcatagcagttcatgtgtccacagaagaaaattcattgtctaaaaatataatctactggaaacagtaattattttacttcttttaccttatactagtccatggaaacttggcatacactcgaggaataaggagattaaaaacataaacctggtgtcaagtcatatgagcaaaaacaaattcattagaaagaaatttctatcagtctggtcgcagtggctcgtgcctgtaatcccagcactttgggaggctgaggcgggtggatcacctgaggtcaggagttcgacaccagcctggccaacatcgtgaaaccccatctctactaaaaatacaaaaatcagctgggcgtggtggtgcatgcctttaatttcagctactcggaggcagagacaggagaattgcttgaaccggggaggcagaggttgcagtgagccgagattgccccacttcactccagcttggggtgacagagtaagactccgtctcaaaaaaaaaaaaaaggaacttctatcaaaaaaatccctctgagttgtgtaaagatggcttttaaaaaattttttttttttacaaagatactgatcaaatttatttataatggaaacaacctggaataggcaaaatatccaatgataagaaaatgtttaaacagtataccacagcatgttaatcatacagccattaaaaattgtttatgaagatttttatgaggaaaaacactaatgaaacattacatgaaaaaagataaaattacgtatatactgtgagcttacttaaaaaatagaaaatgattggaaataaaccaacatactgtatacaaatattaatggtctttgcttcaaaaatatttagttgacacattttaatttctttctgtattttccaaattttgtataattaccacatactattttacaaatagtatgtggtactattgaggaataaggagattaaaaacataaacctggtgtcaagtcatatgagcaaaaacaaattcattagaaagaaatttctatcagtctggtcgcagtggctcgtgcctgtaatcccagcactttgggaggctgaggcgggtggatcacctgaggtcaggagttcgacaggataacaaaaaaattttgttatccagaagtgacaaaagtctctatatataatattgctattaaaatgttgaaaaaaatgattattataggaaaataagcatcttatttggaacataaaataagaaagcattgctaaataaaacaaaacttcactgctacgtgaagttttgctgttttcttggatagtcctgaggcttcatatgttgtgccatccaccagttatgaaaagatggctttttaatgaatcaggttatacttacaaggggtctactcaaataaacttggcaaaagactcttaagttgatactctgaggctgggaatggtggttcatgcctgtaatctcagcactgtgggaggctgaagcaggaggatcctttgagcccaggagttcaagaccattctagggaacataatggggccccgtctctaaaaacaaacgaacaaaaaagactttttaaaaaaagtagccagatgtgttagtgtgcacctatagccccagctactcgggagactgagacaggaggatctcttgagcccaggaggtggaggctgcagtgagccatgattgcactgctatactccagtctgggtgacagagtaagaccctgtctcaaaaaaaaaagtttgatactctagtctcatctggaatgccccttttcttagcttccaattctatagagtacttacgatatatttttgctttctaattagaacttttgagtagcagggcagggggagatgacaacccacaatctgaactggagatcatctactagtctttaattttaaatgaaacccaaggtagacaacaaatcagaagaaatcaggaatcatgttgcatcttcaaattctgtttgtgacactggtgcgattatttgaattaggtgttactgggttctgtcatttctcattgagcaacttggcattttctgttcacttagctggtggagctgtctaaggctcaagatatagaagcaggagatggcaccacatcagtagtcatcattgctggctccctcttagattcttgtaccaagcttcttcagaaaggtgggtaggatgtactttattactgaataaagaaaagtttaaaaaacaaactttaggaaaagccaagttattcataagtaatatgggattgaagatttaatttggaataactaatctttttaccaagaatttttaaagttagattttgctatatttataatagagattagaagaaattttccttggcttctgatatttgctgggctcctttttgaatggaactcaattgaattttgctgttcaaaaatgagtggtagaggccgggcgtggtggctcatgcctgtaattccagcactttgagaggccaaggtgggtggatcccctgaggtcaggagttcaagaccagcctgaccaacagtgaaacacagtctttactaaatacaaaaaattagccgggcatggtggcgcgtgcctgtaatcccagctaaggcaggagaatcacttgaacccgggaggtagaggttgcagtgagccaagatcatgccattgcagtccagcctgggcaacaagagcaaactccatctcaaaaaaaaaaaaagaaatgagtggtagaaatattactaatcttggactcttatacaagaaagaagatttgggagagaaagtcaggattgtctttgctttagtaaatggtatttaattatagtagtgactatccaatcacttattttacttataatgtagatttgtgatattttgagaagtatcggccaggtgcggtgactcatacttgtaatcccagcactttgggaggctgaggctggcagaacaattgagcccaaggagttgagaccagactgggcaacatggcaaaaccctgtctccaccaaaaaaaaaaaaaaaaaatacaaaaaaaattagccgggtgtggtggcgtgtgtctgtagtcccagctactcaggaggctgaggtgggaggatcacttgagcctgggaggttgaggctgtagtgagctgagatcagggcgctgcactctagcctgggtgacagagtaagaccctgtctcagaaaaaaaaaaaaaaaaaaaaagtataaaatttggttttagtcaagaccattaataagtgtgtaatctgttttaagttggatggaagtaaattattagccatagttagcaggttattcaagccactatattacaactgaagcataagtttgtaattaagaatagttaaatttgtgcttgctttgacattgagtagaaaatttttaagccatgtcaaatgtgtagtttacctgttacaattaaataactagactttcacaaattacagggattcatccaaccatcatttctgagtcattccagaaggccctggaaaagggcattgaaatcttgactgacatgtctcgacctgtggaactgagtgacagagaaactttgttaaatagtgcaaccacttcactgaactcaaaggtgagacaaacactaacggatacttgtcaaattagttaaaagtgtgttactctatgattcttgatgctatacggtacataaatactaaatctcaagagtggctaggtaactgttataatctgtataattgaattggtttaagattaagagaggaaatgagccataaggctaacaaaggagttaggatatttaatatatactatatccatttccacttttctgtttaatgcattgtaacagtgttttgataaagctagatattttaatttgcctataagaaaccttttcctccaccaaatcagaaagactgccatagattactggcagtatagctaatttttattgaatatttaatatggtgggcattgtgataagttttttacatttattgtcctcttcaaggccctcagatagtcatatccccattttatagatgaaaagagtagatctagaggagtaacttatccaaggaccgctaacagaaacagctgagatttgaacccaggacaggctgcccatcgtggtccatcccttaactaatacttatgctgcttttcttatttaccaaacttaaagcggtgttgtgcttttaaatttctttggaactcatgtcacttgttttctgtaatatcctgtgtttatcccttccttcccctaatcctttttccttttaaaaatcagtattaagtccatacattcattttgtttgaatgttaggtagtgttagggacactaagtgatactgttggatgtccttagaactaatacagatagtatagcgtaatggttacaagcactaggcattgagtctagactgcttgtgtttgttcagtactgacttcaccacttaactacgctgtttggccaaatgacttaacctcttggcttcagtttctccatctgaagattgaatgagttaatatgtaaagttctaagaccactgcctggcatatgttaagtgattgataaatgttagcaatttttatcaacccctcatcaggaatgtacatacataacattgatgcctcatcacacattcattttagatagaaaatactcacgtaaaattaaatttatgctttttggatttcctgtaaaactttgatattctacagtcccggctattatattaataaaagaaaaaagcaagcatacatgtttttattttgtgcccctggtgacaacctgaatggaaaagacactttatggactgtcttctcatgagtgtttccctcttcatacccacaccccactgcaaaaattataagagtctttcttaagtatctttgtcattgaaaaattaggacttttttctactgtgaaggtaacttttttttttttttaataattctaggtggtttctcagtattcaagtctgctttctccaatgagtgtaaatgcagtgatgaaagtgattgacccagccacagccaccagtgtagatcttagagatattaaaatagttaagaagcttgggtaagcatctctaattacaacttgaataaaaatttgaaaatgagcatcagattgccaaaaataaataaaaacacctagatgaaagtcacaaagctctcttttctctttttggttttgttttcgtgagaatttgtattagtatgggcatctggagattttgtttatgttaccttatgatagtaaggcagcagtggatcaaagagatccaggagtggggcaataataaatgtgaggctgaatcatattttattggactgatgacttttaatctgttcatctattaaacgtacagatgtccactccctcttaactacccctctttgttttcttttatccttagtgggacaattgatgactgtgagttggtggaagggctggttctcacccaaaaagtgtcaaattctggcataaccagagttgaaaaggccaagattgggcttattcagttttgcttatctgctcccaaaacagacgtaagtagaatccaaatgaaattggttctctgtgtttaactttttaataactcaggcatttctttattaaaaatagaaaatactactagtgatttaaagcagatctcaaaagacttactagaattgagacaaaaatagtaattgttggtgccacaagtgacaagtctgtatcctcagttgggatattgaaattgagagctagccatttgcaacgatgcctgtagtcccagctccttgggaaattgaagcagaaaaattgcttgaacctaggagtttgaggttgcagggtgctattccatgacctgtgaatagtccctgcactccactccagcctgggcaacatagtgggaccccatcttttcactgttgctgttaatttacaaattcacacagattagagagggaccctatcttttgaaaacaactagggtaaccattttatattttttggttataaaaaatttacttgcaaaatgtaagataccagtgtacttagttgaaaataaaagactcaagtttgggatgtgtatcttaatccagactcttttctatgcatgtctatataatttattacttgatatagttttggttgaatttatacaacacatagtattttcgcttaaaattctacttttaaacttaaaatatcttacaatgcaaattatgatgttctttttctgaacagatggataatcaaatagtggtttctgactatgcccagatggaccgagtgctgcgagaagagagagcctatattttaaatttagtgaagcaaattaaaaaaacaggatgtaatgtccttctcatacagaaatctattctaaggtgtggggctatttattttgttcatcccttaatgataattttggatctccactagcagtttattttttctgataaaatatatgatttaagcacttactctaagttcgtatttcttaacagacaactcttaggtgaaacgaaatggagaatttttattttaaaagcacaggtaaaatgttaggcctcaatattgtaccatcatttgctcagaccaagggaaaaaatggtataagttcagttaagatgtctaggaaaagcattttaaacaaatatatgacttgtaaattcaaaacaataaaggtgtaattttcttttacaaaaaaaagtaggttttttaaaatagccaactaactgccagaatgttgtgttttggccttttaaaaaacttatttcttcgattattggcttcagggtggagcccttaaggaacagggccaagaaagcatgcagtttttagagtctaaaccacacttctaatagcaattttttttaatttttttttttttttttttgagacagagtctcactctgtcatccaggctggagtgcagtggtgcaatctcggctcactgcaacctccgcctcctgggttcaacaagtgattctactgcctcagcctcccgagtagctgggactgcaggcacgtgccaccacacctggctaattttttgtattttttgagtagagatggggttttaccatgttagccaggatggtctcgatctcctgacctcatgatccacccgcctcagcctcccaaagtgctgggattacaggcatgagccaccgcacccagcctctaagagcaatttttatagaaacatttgagttgggtaaaccaccagaaatctgcatttttttttttagcagtatcattatttttccttgcagttacaagctggaaaagcattattatgttttgataaaaagtgcgtaatcttccttttttttttgaaatggagtttcgctcttgttgcccaggctggaatcaatggtgcgatctcggttcaccacaacccccgcctcctgggttcacgcaagtctcctgcctcagcctcccgagtagttgggattacaggcatgtgccaccacacccagctaattttgtgtttttagtagagacggggtttctctgttagtcaggctggtcctgaactcccaacctcaggtgatccgccagccttggcctcccaaagtgctggggttacaggcatgagccaccacgcccggccctatcttcccttttaaatgtaggatatataatcttacctagaccaaggtcctaaacatcaagccttgttcttttaaaagccatgttgcagaattaattacctagttaaaagtggaatttatttaaaggtctatgcaattgcttgccttgtcatttagaggtactttttgggggaatgctctgcatagtccatagatgaaaagaattctctgaagtttgacagatcacttttttccttctttttttttttttggagacacagtctcactctgtcacccacgctagagtacaatggcgcagtctcagctcactgcaacctctgcctcccaggttcaagcagttttccttcctcagcctcctgaaatagttgggattacagtcacgtgccaccacgcctggctaatttttgtagaaatgaggttttatcatgttggtcaggctggtcttgcactcctgacctcgtggtctgcccccccttggcctcccaaagtgctgggattacagatgtgagccaccgtgcctggccagtattttttcctaatagacgcattcccatttactccattaatgtgccagaatgtactgtggatgttcattttatatagtctttgaagactcagaagacttggttctaatcccaatcatataatagctactgaccttgagtaaattgccccccaaactcagtttgcttatccgtataatagggatagtagtaatatctacctttctagtatcacagagttgttattcacagttcatggggaagtgtaaatttgtggagtctgaattaatacttctaaattcatgaagtattaataaggtttcacttcccaagatgtgctcatttgttaagaaaaatgaggtcaggcacagtggctcatgcctgtaatcccagcactttgtggggccgaggtgggaggatcacttgagccctgagttcaagaccggcctgggcaacatagggagaccctgtctctattaaaaataaataaatgagccgggtgcagtggctcatgcctgtaatcccagcactttaggaagccaaggcgggtggatcacctgaagtcaggagttcgagaccagcgtggccaacatggtgaaaccccgtctctactaaaaatacaaaaattagccaggtgtggtggcgggagcgtgtagtctcagccacttgggaggctgaggcaggagaatcgcttgaacccaggaggttgaggttgcagtgagccaagatcgtgccattgcactccaagcctgggcaacaagagcgaaattccatctcaaaaaaataaaaataaataaataaatggggaaaaaataatgacctagttatttcgtgtgttttatagtgtcattggggacagagtacattttaatactggaattgtactaaaatttccaatagaattggaaatcttaattttgaccttacgaacttagtaaactaaagcatttttcttcagaaataatgattggccatttaagaaacagtaattaaaaccttaaaggcatttgaagagcaaaatttttttaatctagcattgacataatcactgattttgtattttagagatgctcttagtgatcttgcattacactttctgaataaaatgaagatcatggtgattaaggatattgaaagagaagacattgaattcatttgtaaggtaaaacattaacatctgtatttgtggaaaatgtctgataattagataaatgtcttaatttgtggatttgactgttttttccagacaattggaaccaagccagttgctcatattgaccaatttactgctgacatgctgggttctgctgagttagctgaggaggtcaatttaaatggttctggcaaactgctcaaggtaacagtattacacttaaatttttatttgcttaggtttgggtatggggttttaggttgttttttttctttttttgagacggagtctcactctgtcgcccaggttggagtgcagtggcatgatcttggctcactacaagctccgcctcccgggttcatgccattctcctgcctcagcctcccgggaagctgggactacaggcgcctgccaccacgccctgctaattttttgtatttttagtagagacggggtttcactgtgttagtcaggatggtctcgatctcctcacctcgttagccacccgcctcatcctcccaaagtgttgggtttacaggcgtgagccgccgtgcccggcctgggtgtggggtttttttgacccttcaaatacttaatttggaatttgtttactgaagattacaggctgtgccagccctggaaaaacagttacaattgttgttcgtggttctaacaaactggtgattgaagaagctgagcgctccattcatgatgccctatgtgttattcgttgtttagtgaagaagaggtaatgtcagtgttacattattaagtaacattttgaacattaaaactattatattctattttttaaagatataaatagcaaattattaaaaataattttcttttggataaaataagctaaaaatatatttgtgaatttcagggctcttattgcaggaggtggtgctccagaaatagagttggccctacgattaactgaatattcacgaacactgagtggtatggaatcctactgcgttcgtgcttttgcagatgctatggaggtcattccatctacactagctgaaaatgccggcctgaatcccatttctacagtaacagaactaagaaaccggcatgcccagggagaaaaaactgcaggcattaatgtccgaaaggtaatcatttaatctctaatgtagaaaatattgattaatttaaaatattaaaagctttgtagtcatctgttgaatggaaagctctgtaatgaaaagcataatcttggatttaaatatgaggcctgctgcatgttaattaatctatgccattgagtgagaaggaagatggtgacaccttagggggaagtattatttgttcattaaatctgccacttactgactagcttttagcaagttacttagtctgttcctcagtttcctcaggtgtaaaaacagggatgattaatagttccctcataggcctgttgtgagaattaaatgcatttctagttaacaagctcttagatagatgcttggcatatactaaagactgtataaaaaatcattgccctagttagcatgagctaatgtagttgtgtaaggtaatcatatggtaataatatcactttttattaatgttttgttgaggagacaaattaaacacatgatgggaaagaactgacagtccaactttatattgtctgtatggtacagaacgccaaatgatggaactatctgtttagggaaggctttatgaagatgcacttttggttggtaggggatgaggaaattccagatgggtaagcagtggttttacaggtgagaaggaccaagcagttcttcacctgtgtagagctgggattatatattagtggtatagtgggctttaaggttggaaagatcagataaaagctattattaataggcctgacgtggtggctcacgcctgtaatcccagctgtttgggaggccgaggtgggcagatcacctgagggcaagagtttgagactagcctggccaacatggcaaaattccgtctctactaaaaatgcaaaaaaaaaaattagccaggcgaagtggcggatatctgtaatcccagctacacgggaggctgagggaggagaatcgcttgaactggggaggcagaggttgcagtgagccaacatcacaccattgcactccagcctgggcgacagggcgagactccgtctcaaaaaaaaaaaaaaaaaactattaatagaatgaggaggcccctgattattgagccagccattttttttttccttcccgtagttgggatccactgaagtgttttttgtttgtttgtttgtttgttttttctttggagacggaatcttgctctgttgcccaggctgcagtgcagtagcactgtcagctcactgcaacctcctcctcccaagttcaagcaattctgcctcagcctcctgagtagctgggactacaggcgcccaccaccaggccgggctaatttttttgtattttttagtagatatggtgtttcactgtgttgctgaggctggttttgcactcctgagctcaggcaattcacctgcctcagccttccaaagtgctaggattataggcgtgagccacggtgcggggcctaaagatttttttaagcaagaggctaaggacatgaacattttaagaagggaagactggaagtaaggatgcctgttagaggccatcaggagtaatcccgggataaagggaagtaggatgagatttttttaagcaagaggctaaggacaggaatattttaagaagggaagactggaagcaaggatgcctgtaagaggccatcaggagtaatcccgggataaagggaagtaggatggtgcaatgaagaatttaaggtggcaaatatgagactgtagagtagactggggttgatctaattaagaattaaaattcagagatgatttaaacattaaagagataatattttgttttgttttgtttttttgagacagagtctcactctgttacccaggctggagtgcagtggcacaatcttggctcactgcactccgcctcctgggttcaagcgattcttctgcctcagcctcctgagtagctgggactacaggtgcatgccaccacgcctggctaatttattgtatttttagtagagacagggtttcaccgtgttagccaggatggtctcgatctcctgacctcgtgatctgcctgccttggcctcccaaagtgctgggattacaggcgtgagccaccgcacctagccaagatatcataatttttaactactgtgatcattttgctaattttgccaatatttaaaaataagtggccaggcgccatggctcacgcctgtaatcccagcactttgggaggccaaggcgggcagatcatgagatcaggagatgagaccatcctggctaacacggtgaaaccctgtctctactaaaaatacaaaaaattagccgggcatggtggtgggcgcctgtagttaggattgggtgactacagcattaattcagtttttccaaattttaattgaaataacatcccacagtgtagagaaaagcttagtagagtatcatattctaatcttcttagacagaaagaaaactagatttaggtcttgaggtacactggtaaccacgtggctgctgatgtgtattatcacagacactaaaagcaacttgtgctgatttgatttgcagggtggtatttccaacattttggaggaactggttgtccagcctctgttggtatcagtcagtgctctgactcttgcaactgaaactgttcggagcattctgaaaatagatgatgtggtaagtgtttccaggttgcaaattttcttaggaggtcaaaaaggcatatattttttaaaggttttttgttgttgttgttgtttggttggttggttggtttttttgagacaaagttttgctctgttgcccaggctggagcacagtagcacagtctcggctcactgcaacctctgcctctggggttcaagtgattctcctgtctcatcctcctgagtagctgggattacaggtgtgagccaccacacctggccattgtttttttaaaagtttttacttttttttttttttttttttttctgagacgaagtcttgctctgttgcccaggctggagtgcagtggcatgatctcggctcattgcaacctccgcctcctgggttcaagcgattctcttgcctcagtctcccacctcccaagtagctgggattacaggcatgtgccaccacacccagctaatttttgtatttttagtagagacggggtttcaccatgttggtcaggctggtctcgaacttcttaccttgtgatccacctgcctcagcctcccaaagtgctgggattacaggcatgagccaccgtgcctggccaagtttttacttttgataaatatttgctagtcatcaaggtgacagcagttcttaatacaggttttccttttattaattgccttaaacattttccagctttaaaattctgtcattacaggttttgaaatctaagtttttctcttatcaggtaaacactcgataatctggataactgactagcaccattatgatcaccagtattgtggctggaatggaagaagatcaccttggtgttccttgtttggaagattatttcctctgaatttctgggcttggtcttccagttggcatttgcctgaagttgtattgaaacaatttaatgaaaatattaaatatttggtttcaaaaggcagatttatcttctcccaacattctgttatttctgatacttttgaaaaactaataaaaactaataaaagaagcgtaaaaagtgagtttacatgttgaggaaaaaaatggcccaatatgctcatcactgataaatgctccctggccttaaaaactaccaacatataatatatatgctgtcttaaaagttaatgatccaagtggcacctctctgaacctactttggcttgggaggctgcccagttaaaacaaaaataagttaatggtacagaaagagaatgaaaaatgaaagcctccttttatcctatcatcctaattccttttcccagtaataatgactgctgtgttggattccttctgcaaataaaagtgtatacat

SEQ ID NO: 35698 - DNA, 89273 bp, Homo sapiens
gccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggtaagcgggcgtccgggccgatcagggggccggtccgaggccagggccgggctgcgcggggcaggcgcgaccgagagtggttgggagaagagtgctgagaggtcttcggagctcgaggctcggtttggagggctgtgagggggagagcatgtgcccggtttgggggcgcggatcagcagctttgcagtggagacttctgcggctcggaggagtcggggatttgcgcgcacggcgaggccaggaggccgagggagatggcctggaggtcggaggtgcttccgcggtgcctttgaaaatctcccagccgccccgcagcagattaccgtggccaccggcgcttggaaatgtttgtgggtgcatgtcctcgactttctctggtctctcattttggggcagcatccacgtctctatttttctctggattcgcggagtccttccaaatgcgctcctgtgcccgcgccgcggcccaagtgggcaaaggggggcgggaggcggagagcggctcagggacacgatcctaccgaggagccaggacccttcagagcgccccgctgccgggctccagaccccaccgaaggttggagaacccacttcctcgtgccgcaccttgactctggggagagtaggtagtgagtgacctggattgccctgcgggggcagatggttcggtgtgtaggaagcggacggcaacactggatgtccctggcaggtccgggtgtctgtctccgaagaggacagagaagggcagccacgatctgcccgcctgccctcgcgagcctctcggcactgggtgagaggcaactctggccatttcttgctgccctctcgccctctcccggccgctcccagtccagccgggcccggcgctacccgagcgagggttcgagccctctgcgcggccgcgcagaagcaggcagggcctcaacttctgcaaatgtgtgcggctcgccgcctgtcccctttctcctcctgtctccacccgtgcggccccagtggcctggagcttccagccccgcgcttggccgcggcttggcgaggctatgctgcgggaagctggaatccaacgcgcggccggctgaaccgcctgagccgcgggaaaccagcggcggagcggcggtatagaggtgcgaggatgaggaggaccgactcgctaagggagggaggtgactggccgggagggctcactgccgaggttgatttgctcttgttccaacttccactacgggactggagccagaaaccgtgtatcctccggtcgaaagcagcggttcccacctcggggcaccgataaggatttgataaacgggagcgaatcgcgcctgtcctggctcggcgcccgggcccttcactgcgggatcgctaggggaggggattgggccctgctcccctttcctggccgtagtcccccctttctcgtcaccgtcgcgccctcagacccaagacaagtgagggagccctgagactgcagccggcacattcccagggccctcggagcagtcctggggttccatgtcttttgaaggcagcagagcaaggaaaagactcttaagattccagtgcgttttgtaaaaaccaatcataatgctaataatgactgaaccatcgaaaagcaaagttatagacagcgcctgcagacgctttcgggtccggagccggggagggaacttgtgtattttacaactgcgatgcctatcgggaatgtggcaatcgccgaggtggggcctgacagtaatcttgacaaatgtgtgaagtgtcagctcctcctgcgctccttagcgccgggttttgtgcagttttgtaccgtatataccgagaaacttgggagcaggggaaaaatgatttcgacacacccagctacagtacctggttcgttagcggactgttggaaagagagaagaagcgggaatgggagcgggaagaacgttgcgtaattagactcccaattattggcgagagcggccgctttaagaaccactgtggggactgcctgcgaaacgccttggaggccgctgtgtgagctgcggctccgggctggtggccacgcgagggtgtccgccctcttcgacctgcctggatttttgtgctgcagaatggcagggcaaacagcgtgtccttcaccatctagagccccttaaggggttgtccaattcctattgggctaatcagtttgagactcatttacttttcgtgcctgggtctgtttgctggctgcaggcttctttagggaccaagatgtaattaaaatatgtgaaccaatacattgaaagttggtgttgtcatgtaagtgactgctgtagcttttctgagtgcctcacaagggcgatgtgacagtgagggggctctctgctgatgattctgcccactagttcttacattttgtgtttctttggtttagcagagcagtttcttcccccaaatgcaatatgggcagaacatttggaatattcgttctaacaatggcccgtcaagaagtgggcagatgattttgtcccagaatgttcacacgtcgataaatatgttaatgtttaataataaagagtttgctttctaaatgttagttggctgggtgtccttgatagtaccagttttggtggtagtgggcatttgcggtgacatcacagatgtcagaaactgaagcctggtgggtgggggtactgcactttcactcacctttttgtgcacgcatctatcaggaatgcctgagtcctttcactgggaaaaaaatgtggaaattctgggattcacggggtttgaggagtggttcaggcaaatgtaaatgagatccttggataatcagggatcaaagtccagtcccaaagccagacctaggtccagacaccttcccagagtgcttatacagtagtgctcagtacagggctagcgtggaaggggaattggagacacctggatctccaatctccccctccttctgacagctggacttagttgttcctcttctaaaatcaaatcaaactccatcattattccaactctgaagggaaaaaatattgctggacagtttctctcaatttaaacatatattttaaataaatattccctccacacttgatatgtttccattgtattaccagcagcgcaggatgatacagaattgatgtaacacattgttggcttgagtatttaagttttaattcatacagttttcatgaagttcaaaagaatgccatcatttcaagtttttttcagtggtgcttatagggagcctagaattattttataagagaccatggaaatcatctagtcagacttttctctttctggataaggaaactgatgccgagagaggttaaaagacttctccggtcacaaggaaaattagtgctgataagagtcagggctggtcgcggtggctcatgcctgtaatcccagcactttgggaggctgaggctgcggatcacctgaggtcaggagttcaagaccagcctggtcaacatggtgaaaccccgtctctattaaaaacacaaaaaaattagccgggcgtggtggtgggtgcctgtaatcccagctattctggaggctgaggcaggagaattgcttgaacccgggaggtagaggctgcagtgagcggagatagcgctgctgcactccagcctgggcaagagtgaaattccgtctcaaagaaaaaaaaaaaaaaaaaagtcagaaccctggtttattactttcaattaagtatgtattttcctattgttcacaggagagtaccccagccctgaaatatctctagatagtgaggatgatttccgaaggagtgccttccccatcacaactctcaaaccgctgaaccttatagaaaggagatttgcttttctggataattatcaacacctttaggctgcagtagaagtgatgattctgtttgctttttgaaaaaaaaaaaaaaaggaagcagagttgaattgatgctgttcccagtgtctgtaaactttgagaagtatgaattcattgttttagttagaaaaaaatctacttatataggtagacctcattaaacaaaaccaatgcaaggaccgctcctcagtggagcagattgctttttgaggtagagaacattcaagcagctgctagattgatttttgtactgggttagttggcattttcactaggagtgaaaactgtgagactaaacagtttaatttacttagaatgtccctctttctctctgtgtgtgtgtgtgtgtgtgtgtgtgtgtgtgcccgtgcgtcgggggggggggcagtggtgattctcaactttctaggaatttattaagtaaagtgtttagaaatggaaggaaacaattagataattctcagtgctccaggattttaggctcctacatttgaaaatacttgctgtcattaattgtcttgagatttaggcttttccacttttcaggaaatctagtagttttttgggggttttgttttgttttccttggttctgccctatgccaacctgctagtttccctttttattttagcctgatgaatcttcccttttgctttcagtactaaccattgctggtagttcttaacaggtctagcttttaccaatattgtcaagttagcaatattagctcctggggccctagtactctgtacttccacccctctccccaccagtaccatgctgcctgttcacatgatggacaccagctctgatattcaccctaagatataatccataagatgacaaacttgtattcaacaccgactcctactctggctaaaatgctgaagagaatactaagaaataggggatatggtcctggtcatcaagttgcttagtctgattaggaaaaaaaaaaaaaaaaaaaaaaaagagatacaaggaagcttaagtaaaaatataaggggttgggcgtggtaactcatgcctgtaatcccagcactttgagaggccgaggcaggcagatcacgaggtcaggagtttgagaccagcctggccaatatggtgaaaccccatctctactaaaaatacaaaaaattagccaggcgtggtggcgtatgcctgtagtcccagctactcaagaggctgaggcaggagaatcgcttgaacccgggaggcggaggttgcagtgagccgagatcgtgccactgcactccagcgtgggtgacagagcgagacaacgtcaaagaaagaaagaaaagaaagaaaatataaagagctgacagcctacatgcttttctgtagaaatctaatattttgaagcaaaagataagctctgagtagcatttcaggtaataaccgcccccctccccaacacacacataagcacacacaattatttaagagtattatgtgtatttagaggtggagaaatttgttcctagtgtccccggaaccacacagagtaggtgctgaccaccagcttaaagactggctcagaaggaaggtcaaatgggagaaggcagtctttgagggctaacgagaggaaagaaaacacacaaggctccctatggtgtatcccttatcatgtacttcgacaccatacacaggaaggcccctgaaatggaatgtttgctgttctttatacacttgctttgggtggggacatggaaagggagctggtggggctccacagacaacaggggtagtaatttctgttcccctgagaatatcagtggagacagctatgactccaggaaggccaagaagggagagggagcttcttaaccaggctttgtgaatgggtttcagaggctggcgtgtaaatctctgaaaatgtgtgcaagacattatgtatagaagcaacttgttctaaaggaagtctgttcagctctccatagcctttcaaaggttctaggatatggaaaaggcaagcccttgctcttggatgtctgatttggtgactgtcttatgtttcagagtcttcctgttcagatcccagacagttcttgtgttttactgccattgcctctccctgtggtgaagaatggggaggaggaaggtgtgtgtatttagtaaaggttctgaggtgccgcttaatcttccctgtccctggctggcgtgtccgtccacctacatgtctgccctcagtcttggaaggacgggaagccaagtgccctgcacagggtaaatactggtatgattcattttattaatgcttctgaaaaatgactgtgaaaacaaatttatcctcaaatgttccatcatcctcaaacagttatttggatgaccttcatgttctaggaatgtatgtggtcttaatagaaattatattttgcatcaggacaacacaaaaaactgacagtcttatttgtgccagtgccgtcctcagaactttacatggattaactttttaatcctgtgagataagccctgttattatccccacttcattgatgggaaagctgaagtctagaagggctaactgcccaaggtcgtataggtagcatgggcagagctgcattcaacctgagtaaaggaggtccccagagtctatactctcaatgggtgttccatacgcccttcccttactgaagatatctataaagtatttaatactgcttctgactcacaataagtgctctataaatgacaactgcctttgttgttttccttgtaattataattacttttcttttttgtgatttatcacttgcatcaaacctcacaagcagatagggattgaagatctgaaaggccaacatggaactccttgaatttcttatttttcatgggttttcctagaccctgacaagaggtggttctctcctgccccaagaaattcaaagctttccacatcccacccttcgctggtggcaagacttcaataattacttcagccttcggactccattgtgcaggagaacctgttagaagctcttcctctgtggcttctgaagaaccatcaagatgcacaggacttcctgtggctcttttgatcttttgaaattgcaagcacaggaaggaaagaatggatagggggataaagaatagctatgattgttgtgataatagcatgttgcatttctatagagccctttcgctgatgagccctgagccttaacagccatcacactgttggcccctgcactgtgaacctagagggtaccttgagtttttctagtgctgccaaacagaattgcattgacacataccttaatcaagagagaagcaagccgtgttggcaactgtgcatcacagtcgatgtggtggtcatccatgggatgcccctaatagcatctgtaattttcaagtagatgttgggtgtaatttggtgacccttgtctgttcccactgttggaagccccataactgatctgatgaaagcataaagtgaagaagagtggcgagaccctttgtgagatacctggagctgaagagtcaggtgtggaatggacaagaatgttatccacttctaagtgaccttgttttttctaatttcttaagaaatacctgtttgcttgactgccttaggctgtttgcaggggccacttgtacgtcagcaaaactcttactagatgacatcactgccagaagttccacatgtttccaggaggcacatttcccactgcccccactcccccgaacttggaaagattcctcagttttaaagttataagtaatttccatgccagataatgatcctgtgaacagatccttttctcatgtggaaaaatatttcagaaagggtgtcttgtcaatgagaaaaatgaccccattgaaacatatgtttatttgccatgtactcatctgacgttttgtgaattctataaagccatggaagtggattgttagaagtgtctcatacacccctagtgacttcttgaactatccccccatccccagccatggaactctcctattaaaaaaactaagagataagtggtagcaatcttaacaaattagtgattttatctggttaggccgtgtaatcaaacacgtgggcaggaaagtggatccattatgttgtactcatgattgtggtgctgaaggtaacccccattgccctgtaggctgcccccagaagcagggggtacagccaatagtattcttagaagttaatcaattctgtaacgggttgagtgttttggtctcatttttagtccgaggtgccctgatgctggcctgtgactaaggggagtcagtggcttgttatgaataagaggacacatgagctgaatctgagaaagttcagaagcattttataagttgtttaaaatacatccattaaagtatatgattattttttggtaatcatttaaatcattgtgctgtgtgtctacccagacagtatttatctgtctctcgatgttgtattagtatagtattaaaaaaatacacacatttcacttttgataaaaactttgcatactgtcactactttgtataagttttttcctgactgcctctggttagggggcagggagcaagaagaccagcatgctttccttcctttatatttgggaaatggaggtgctgagagaaacaagccacactgtctgaagtaaaacctagaagtggacctggttgtccatggtgagggaaagcccatatgtaccaccttgggctccagttacaaggtaatgagccatgagcacaaaagggtgactcaaaattcaatgccagccattctcattactaatgagcaattacagcaaatatttacaggcctccttcctacctttatgacttcctgttactgaagcactttggagtattgagaaagattgtcctggaaaaatacgtcacacacagttgcaggaaagagtgcctttaagcacacataaaaactcggttacttggctttgtttatgaattccacatagaaacaacagaaaattgtgccttttgaggaactgcttgagaatccttccttctgcatttcaagacaagattttaaaaatcacatatatcaaatatatggggaaatgagacacaatgtttttagagagtgtctagaaataataggactgtgcaagttagtacagcaaaattttgggtcaaagcatgggtcatttgacaaactctctttatgaacattacctctgcaatatttttctaaatgaaaacaatcacacttaatagaattaatcaggatgggagctagaagcatataattcactttccacagattggagtaaatcctcataatgcccctttcctgtgtatttagttaaaaaagcactccagtgagattgctttcgcagtaagtttctgtaaaccactgtacccttgtatttctctcctgtgtttccaagagttctcagatgctattttcgaatggcagcgttcactccagagctggctgaggtcaacgaagctaattttggtgccttggtgcccagggtgaagggagagagaagtcctctgcagagccaaaaggactctctggggcctgggtttggagcagtgtggtgttgctggacacaccacatttcacctttagaacctttatttgtgtgcttgcacaacaaatgtttacccagatattaagataaggaaagtatgaaggtcacatttcactggtgacaagagagcttctataaatgtaaccatatcgttgtgcagcgggagtctgtcttttattctgtacccgggacttagggggaattattggtgggtggggcatgggagttgaggctcttcttggttttctggctttcttgctatcactctgtttgtcttgcctcagctgatgtgcgcctcccatttggtaagggcctttgtcatggccaagacatctaaagaaatcctagtctgtgtggctgggcactgtgtggtcccctgactctctggagtcttccagagttccatggaaattagtgcccccgtgcatttccctgccgactgactggaaggcaccctggctgctgagatcgctttcctggtcccccagaagaggtccacatggtgctgatcctgcagctgttttaggcctcctcagcgggattgtcctatcctcggagcacagagaatcttcagagtgggataggggtttcttttgtggatttgggtttctcttagggatctccaaagattagctagacactcagggcctcagtaaagacatgggtccttggtctagttttcttcccaagggcagccaccatggcagtgggagttcaccttgctgactgcaagggaccccacctcacctctatcgcccattcaccatcattcactgtgcctcctgagttcctaatacacaagcctcctcccacagcctcaaaggcagtgctgcagtactcattcccacttctattccctcacactagctcctccatctggatgcttttcccctctcttcctattcaaatagctcctacttttctattgtgagcccaggcttcccgaaatcttacacaaaatcactaagggagcgtagaaatttccacagtggcactcccactccctgcattactagcttttggttgtttgccaaagagcctgcttatatttccttgttatctaatgacactttatttgtttttgcctttctaacaatatagcatgttcctgaaggccaaggatgtctgattttctgatgtgccctaataccttgcttgcttttttttgggggggggggctctgaaatcatgcttagttttttaaaaaaaataatagaattgctttgttcatgtcccttgggttacttggaaagcctgcctcacaagctctgctttctttattcatgtagatttgacccctttacttatttccctttaaaaagaaagaaaaaggaaaagaaaaaatttgggggaccacagtcaggtcttattgatacataactttatatcagatgcaaacgtcaggctagtattatatcagtgcttcacttcaagaatgccttatacactaatgtgagtacagccaaacagaatactccagcttaatctcaacgttaaaagcaagatggggaagttgtgcaagagggcactagctctcagttcagagatcatcttccctgggaagccttccctgattaactgcacattggttacccctgtgtttatagatggtcttcagtctgtattttgttatttgtatgatgcttttacaacttgcttttgaaggttgggggtggcgtatgtccctgatcaccactcaagtggtaagcccttcaagagcaaagacccagtcattttttcctgttcttttttccccacagaagtcagaatagaggtctcttgaggtgctcagtaattatttgtagactgagtaattctgtctatgtcaggaactttgggagtttggtgtagagaactggaagcacaggtagacactttgctcacatcaacctaacttatcctcattgcttatccaccatgcgtagagcagggtttgtgggaatcatcactgtgtgtagatgtttataggttccctcccaaattcaggtgctatgctgtacggtgaggttacaaagaggcattagatggaccctgcactcaggatgtcctaaaatgatttgtttaagcaatataagatgatttatgttaatggatgtccaagctgcctttacaatgttgccatcttgttaggaagtcacaaccaactcagataaaacattgagcaaacaatggaagattgatagtaattaagtgagagtgagtaagggtaaatagatcttgtgtgttgggaatagttagggaagtgattagtggagattagagggaggtttattggaggagcatgaagacctaggtctgtcttgaagattaggtagaatttggataggcagatgagtatggggcattccatttgaggtgaattgcgtaagtaaaatgagaaggcagcaataaacagagtgtgcaggccaggactggtgagccagttccttccagggctggatctggagctctgttagcagaaaggagatgaggaccaggcctgggctggtgttgggaagtttaggggcaggccttcctgagtcatgttgtgatggaatctttgggttgccttggggccatgggagcagtgcatgcctcttctggcacatgagaagctgctcagggcatctccatcattagccctccaaccagaagcctagctctagtgtgagcatcaagtgggtggttggaggaggccatgatttgtcttctataatattgacctcaaagcctcccctgctagcccttagtaaatcaggcatgtgtgaatgtgcccaaatcactctgatatatgtttctttttggcctgtaccacttctcagggtaataaacgccatgtctgagtctcctagtgcatggagtgggagctggaagaggacagcttgctgtatcctaaaatagcagtgaccctcatccccatgttctctttctgatggtaaagactttgtccccctcattatttgataaggttctctttctgatggtaaagcctttgtccccctcattatttgataaggctctcattctgtccctttctcattctggattctaggtttttgagtctaaccattatggaaagagaacagtcccttcaatatcccactatctgtagggcatgacacagccaaatccaagtcagaccatccctttgatcaatttctaccaataactgttcattgcacaccctgtacaaagcactgcgaccaagctgttccttgaccttctcctttcctagtgtttggtcacaacactccctaaagccctaactcaagttcttgggatgataccaccagaagagggaaaaaaggagccgtcttcctgaagtcacctgggtagagcagctggggatttttccctcctcgagcaggtgtaacctttcccctggaggaatttagaaacacttaaagtcatacctgaacactgtgggccaggccttggccagagatcccaagtcactggagaagattccattccagggaccagtagaggccagcgggtctcatccaagtcactttagctcattctgtccaccggtactttgagggaggctatataactcctgagtacttttggcttagaatttaacctcacaatgacaactgcgtgtttggcctttttttttgagacggagtctcgctctgttgcccaggctggagtgcagtggcacgatcttggctcactgcaagctctgcctcccaggttcacgccattctcctgcctcagcctccccagtagttgggactacaggtgcctgccacgatgcccagctaattttttttgtatttttagtagagacggggtttcaccgtgttaaccaggatggtctcgatctcctgacctgtgatccacccgcctcggcctcccaaagtgctgagattacaggcgtgagccactgcacccagcatatttggcctcttattccttttctgtccctctagtaatcaataaatgcttgtaaaactgggaaactgctgcctggcccaggcaggattggttggttcaatgactcgctccacagtcattctctgctcattgcctactctgtgcaggctgctgagcctcaggcccgagagcagggaagggccctctacagttaggtggaaaggagcctggactgtcagaaccaggaaaagactgcaggtgccagagagctttggagcacagcgcagcccaaactaagggactagtttcaagaatctcctaagaactcccctaggctagaaagtgttgtttacccaaatcttgccatggctagaaatttgagtctagcatctaccttctcacagctccaggtggacctccagaaggaaaaggaagatgtcctaccaagctaacctgtgactagatatctgttagggtgtgaaacctgtgaacatatccacgtcttttcctttgtgttcatttccttttctcttcctttttaaagtaaaacatccttttgaaaagttccaactttgcctttgctgaactcctagcaagtacttttccccaccttggctagtgagatgttgagacatgggcacacctgagggtggtgtggtcactgtggccgccagccagcccaaggccttgggaaagcctggtgagcagaaaacccaggcagaaaggagtctgggtgactgtgagcattgatccctttgttcctgagtcatctcttttgagcacatttgaaaccattttccatacccaaatcaacataatcttggtgattccaggccacctgtatctccttgtatggctccaaatattaccagggcaatgacgacaacttaattcttcttgagttagatcttcagggccaaggcacagtacatgtttattttggagagagacaaactttcacccacttgaatttctttgcctccaaaattagcgttgggatgaccacagggttctgtgtttcttggcttttatcttgccaaacggattgtaaatgctcccgagtcaccttctctttttttgtgtccctggcaaagcctacctccacatggggttcagaggagctctcaagtctctaggagtttgaaagacttttctagatctttctctgatgtgtgtgacctaggacaggtaatttaacctttctttctttaacccctttcctaagtggggttagacatatttgctgctttctcagagtactattatgagtttgaaatgagctagagtttcataaaaccatgcatttttaaagtctattatattttaaaaatcacttttgcaactattatctcaatagaactttgaaaagtttaaagggcagaccttcaaggcatcattattaacaagcacagcaatataatcattaggcacattattgcctgttgatgtgatttggctgcagttggaaggcagccttaggaaaagctaggggactcttgctctcaggcctttaaatttcttacctggctgggattttcagaattattagtttttactaataatgatttttgggtatcagttctatttttgcccataccctgagatgtgaggaaatctgattatacccaagagaccaaggacacttccaggattctagataaagggtctgaccagttatgctcctttctacatctggcctgtttttccctcccctgtggagatggaggtggtttgtgcaagatgtgattctgtcgagaatgggaatatcccttcaactcagcacacccaaatctctaaacctaaagagctacatctgtaccatgtctgctcaggtcctacttgttgctttgcatcttatgagcaagacctaattgtgggctcccaaagaaagcagatgacttgcccaaggtctttaagaggtcagacagctactagcagagaaacagagcgaatgttgacacctaaaagataccttgtccttccggtgttactagaagtgggaaaaaggctttgagtgcaaacgcctggctgtgctacatactgaccatgagatgtgacaggccactcagctctggcctctgatccttcatctgtaacatctttgatgcccctaatgcctaagcttgctcatccctcagccccacccatgaggctggccagttaacttctgccttcaggtctcagcttaaatatcacctccctagggaagcattttctcacctcctttagttaacctccctcctgttctgttttgttttgttttagcagtacttcccacatgttgttatttatttatttatttatttatttatttttgagacagtgtctcactctgtcgccaggctgcagtgcaatggcgggatctcagctcactgcaacctctacctcccaggttcaagcgattctcccacctcggcttcctgagtagcggggattacaggcacgcaccaccatgccaggctaatatttgtatttttagtagagatggggtttcaccatgttggccaggctggtctcaaactctgacctcaggtgatctgcccgccttggcctcccaaagtgctgggattacaggcatgagccacggtgaccagccccacatgtcataatttatttgcttatcatctgtcacctttgctgccccctagtatgtaagcttcatgaaggcagggaccatgcattacatggttactgccatatcctcagggtttggggcagtgcctacacacaggaggtgctccttaaatgtttgttaagtgaaataatctgaggttgtcaggtctttgtcttcaacgttattatttcttatatttgttcagtgcttaattttttttcaaagctcttgatgtagattgaagcttttgtcatttttgtcatatagatgaaacaactgaggcacaaaaatgtgatcacaaaaccagagagtggcagtgcctacctgaacagctcccagacccagactctttccacagacccatgctgtctctcttggcaccttatttttctgtcgtggtgatgttattgtttgtcttatttggcaatgtttacaccggaggagtagaggccattgtgtgttggtggcgtctggaaatacacaagagagtcccaggagaatgccactgtcggttcttaccacaattagcaattgtcaggtcaggggcagtgattgggtcggtgtcactctctacatggctggctctgcgtgttgaaacaccactgcctgtacctccacagatgccaaagggagtgtgggtcctaggactacagccccatttctacccagccctggctatctctccactcagatctaggtcctttctgttcaggaaaacgtcctgtttgtgtagcctgctagacagcaaaggcaagtgccaatcagctggatgatctctctgggcctcagtttccccatcttcacaatggactagtaagtgggaaccagtcaaaattggctcagagatccccaatagggttctagctccattgtgaaataaatttcaagtggagcctcgtcctgactcctgttttcacatgctcccttagagggaaggaaggtggacgattaaagatgattggtcgggagctggaggaaggaactccccattctccaagaggaggttctgttggaatagaggggcagagacttggaagtcgctgttgggcatggcccaacccacttccatgacagcagcaagaccaccaccctcaagaaggaggtgggctggggtacgagaaggtgggctgcccagtggtttctacaaaaagggatagttgtgcttgcaggaggggtagtgtctccatctcctgatgccagggagaaggaggcaggctgctggggtgacggagagcaccctcaactaggtcacactgcactccctctgtgcctcagtttccacttctgttagatggctgatatgatctctgccctgccagttggattggggcttccaaaatatcaactactgcaaaagaagaggttgtggccactgtgactcatatacatgtacatgaacgtatctgaagttttcagggctgatactgatgtgaggcaacccatgcaggcaacccggaggaactgtgtccctcactctgagacagtgagaacggactgagccggaaagctgatggccgtgagaggagcaggtttgaaaatcactgaatgaagtcatgttgtacagagggggcgggggtgcatactgtgggacggaggtgagtcacagtgcataagtgttggggagtcaccttgaacttgggccagaagagtagaaatattgagacttgggtttatctgcctcacatcaggtacatcaagttctggatggctgcccactggccagagacatgaggtggacggctcccttttgctgccctgggaaggccttctgctggcttcggccccactgagcaaagtctgcttgttcactggagttcacacagactccttgccaggcctgcccagaatcctgtctcctctgacttcctgtgctcttgcataatatttccttgctccctgaatggctggccccagtgcaggagcagctcactcacactgctggaccgagggcaggatgtagagggagggcagggatctgcaaacgtcacccaggggtgctctgggctctgagggtggagggcaagaggggcagagccccctcaaattctttggaagattatagcacaaggggagttgggaaggccctgggaccatgtgcacacacatctatctccatgaattgtctctcctgtaaaattatttttaaagttgctaagttgttttcttctgattataaaaaatatacatgttccccataaaaagtcatagtaaaagaaggcatggagataaaaataaaaatcaccaaaattccatcacccagagataaccactgttaactctttggtgaacatacttttctctatatcatgaatattgatatataattacagaatacgggcatacttctaagatattgtaggttcgttccaggccactacagtaaagtgaatatcacaataaaacgagtcacatgatttttttttgtttcctcgtgcatatgaaagttatgtttatattttagcattatgtctaaaaaacaatgtacataccctttttttttttctttttgagacacagtttcactccgttgcacagactggagtgcaatggggcaatcttagctcactgcaacttccgcctcctgggttcaagcaattctggtgcctcagcacccccgagtagctgggatttacagacatgtgctgccacacccagctaatttttgtgtttttagtagagatggggttttgccatgttggccaggctggtctcgaactactggcctcaaatgatctgcctgcctcagcctcccaaagtgttgggattacaggcatgagccaccgcacctggccaacaatgtctataccttaatttaaaaatattttattgctaaaagaaatgctaacaatcatctgagccttcagtgagtcataatcttcttactgggagaggttcttgcctccatatcggtggctgcagaactgattagtgtgacggttgctgaaggttggggtggctgtggcaattccttgaaatcagacaagaatgaagttttttacatcaatagagtcttcttttcaggaaagactctgcagcatgtgatactgtctgatagcattttacccacagtaaaacttccttcataattggtgtcaatcctctcaaaccctgccactgctttatcaacttagttgatgtaatattctaaatcctttgttgtcatttccacagtgttcacaccatctttaccaggagcaaattccatcttgagaagccacttttcttttctcatctgtaagaagctctgactcatctgttcaagttttatcatgaggttgcaacagttcagtcacatcttcaggctccacttctagttttcttgctatttcttccacatctgcagttacttcctccactaaagtcttgaacccctcaaagtcatccgtgaggtttggaattaacttcttccagactcctgttactgctgatattttgacatcctcccacaaattacaaatgctgttaatggtatctagaatggtgaactcttttcaggtggttttcaatttactttgcccagattcatctaggaatcactatctatggcagctatagccttacaaaatttcttgaataagacttggaagtcagaattactccttgatccatgggcttcagaatggatcttgtgttagcaggcatgaaaacaacattaattttgtgcgtctccatcagggctcttgagtaactaggtgcattgacaacgagcacataaacatatgtgctgtcatccaggttttgttgttccactgatagagcaccaataaagtagatttggcataatttttaagaaccctaggacttacagaatggtaaatgataagtggcttcagcttaaactcaccagctgcattagtccctagtaagagagtcagcctgtcctttgaaactagggattgacttctcccctcttgcagtgaaagtcctagatggcatgttcatccagcataaggctctttcatctacactgaaaatctgtttagtgtagccaccttcatcaatgatcttagctagatcttctaaataactggctgccgcttatgtatcagcacttgctctttcaccttgcatttttatgttatggagatgtcttctttccttaaatgtgacgaaccaacctctgctagcttcatacttttcttaatgcagcttccttaccttgctctgccttcctagaattgaagagagttagggccttgctctggattagactttggcttaagggaatattatgcctggtttgatcttctcactaagcttaatcattccttaacttttgatttaaagtgagagatgtgactcttcctttcattcgaacacatagagcccattgtagagttattaaaattggtctaatttcaatattgttgtgtctcagggaataggaaggattggggagggggagagagagatacacacacacacacacaaacacacacacgcacacagaggaacaatcactggaccagtcagaacacacacaacatttattaagatcactgtcttatatgggtgcagtttatgcctaaaaacaattacggtggtaacatcaaagatcactgatcgcagatcattataataatagctataataatgaaagtttgaaatattgcaagaatgaccaaaatgtggcacagatatgaagtgagcacatactattggaaaaatggcatggataaacttgcctgacaaaccttcaatttgtaaaaagtgcaatatctgcaaagtgcaataaagtaaggcataataaaacaaggcatgcctgtgtttcttaaccatttaacacgtgtaaaactgtgctaccatttttattaagttcccatattgtttttgtgttgctgagaaagtttttgagtgttgtaccctaacctcttctttcccgtaagctctgtggtttttagttttgcatagtgtggtgatttttaggagctcatatgccatgttgtagcagaactacttgtaaattcacatgacgtgtcttccctaaattcaacattaattattagttattaatagtattaattgtgaagcacaataaaatgaggtatgcctgcattatcatgttacatgctattgtgaaatgcattttctatatagcaatatatcagaactatctcttgctactaagttacaaagatttaatacatagttgtattaagttccacttatagaggtatcatagtgaaacccttattcattgacatgtccaggctcagaaaacaagctataaccagcccaagcttattttcagacctgaaaagcagcatcttttctatatttctgaccaatgtgttatctgaaaagcggcatcttttctatatttctgaccagtgtgttagctatggtgccccagaaatagctgcaaaataaaaggttaagtgccatgtaggcctttctctaggcttagaataattcacttgattacataggaagaggctgcaatgatgacagcttccagggctgggccagaccttaccctgggtaaaatgatcctccagtgtggcccatatgtatgctttgagccaggagctgctagctgggagaacaagtttttcttcagtggtattcctgtgaccaagatttcaaataagctccatttttaattttaattggttattgtcctcctgaaattttatgacacaatctatatctttaaaaaggcactctttcttctttatacagttgttttcatgatgttaaaaactttaaagaaagtatcattcagatttgctgacagttggaagattattttaaaaatccaactagtttagctgaaaaaggtgctatcagtgtttctgtctcatccttggaaattgtatatttttaaggcttgtgattagctttttctcctccattgctgatcgtggttggaagtgtggcatagatttacagtaaactttgatataatggtgattcctctttgttttggagccaggtgcctgcggtatttgcttattttctttgattcatttttaaattgagttgaatgtttgatttaatcagaagtgatagtatgaggctggggatgattgcttgtggttgggaattgcttgtaaagtttactgtttagtcaagacaaatcgtttcctaaagctctctttttcagatttcttgtctatgtgggaaagcatgataatgccagtcagtttaaacatatttaagagttcccaggcatcttcgaacagaaaaatttgcaacaaaatttggcaacggcagaatgcgaggatttttgcctcattttgtttatagttgtctgctcttcaggcaaatgatctattacaacaatctgaataattacagtctctccttcaatttattcaccctggactcctttttctagaattactggccagactcttattacaccaaattccttgactctattcccgaggaatgaggatgggactaggagtaaaagttaaagagagaaactaattgttgcctgcttttcaaagttttcggtgtgtggaaatttgttgattttgtaattgctcccttagttggtcattacccgattctggtagggtacttgccatgtgtacacatttagggagtgcaaagggacagtaagacttaattggtcctgggaattgttgaacaggactttgttgaaatggctacttctgtacaatgcacatggagcagctgttggcatagcaactcctacgtggaaaagtgcacgccgcttgcagatgacttttgcagtgctcagtgttaatttgataaatggcttttctaatagcagtttgtgggctaatggaaagatcgaagcaaaccttcattaacggaaaggagaatagggattttgaagccactgggtgaacacactggacagccagagctaaatctccattttcagctgtgtctctttttcacagcagatatgcttggagtgtggcagatgaaagtaaattaagaaaactgtctgcccgtgccattatcatcttagattttaagcagggagaggttttggagtcctttctattcaagatacttaactttgtgtgagagtttagtttaagagtactgtagaagctttgcattgtgttgtcgttttcctttgctggtagtggtggggttaaggtggttaaatcgttttttattgtggtaaaatatacataacaaaaaatgtttaccattttaactatttttaagcctgcaattcaatggcattaagtacgttcatattgttgggctacaagcaccactgctcaagaactttttcatcatctcaaatggaaactctgtactcattaaataataactctttattccccacatgctccaatccccgataatcactattctactttctctatgaatatgactattccaagtagattgtatatatagacatataaagtatttgtccttttatgtctggcttatttcacttagcataatgttttcaaggttcatccaagttacaacatgtattcaaagttttatttctttttaaggccgaataatatcctattgtgtgtagacactatattttgtttatctggtcttctgtcaagggacatttgagttgtttccacctttgggtgttgtgaatcatggtgaacatggtgtacaatttgagtccctgctttcagtttttttggatatagacctagaagtggaatttctggatcatatggtaattctgtgtttatttttttcaaaaactgctgtactgtcttccatagcagccataccattgtacattttcacgagcaatgcataagagttccagtttcttcatttccctgctaacacttgttattttctgttttttgttttgttttgtttttgtttttagatatcagccatcctagtgggtgtgaagtggtatctcattgtggctttgatttacattttcctaatgatcagtgatttgtctttataaacatattgcctgttccttgccccccaccccacccccgcacccccacaacagcctgtgtgggaatggaaatcactgccccattgtttacacctgtgaggcaaacaaagactatcaacataatgatatttgggagtgaaaggtgtcagggagagaaggatgaaggcaccataaggttattatatataataactggcatataggatatagtacaggcacctcagtagacctattttcagttcgtgctgtggagcatgtgaaactattttaaatagaggcctttgggacttaagtaacttcaactctctgaatgaggtttaaggcaagcttgctgtgggctggatctatcctgtataatccctactgatttgggtgatgtataggtacccttccctgaaattcttccctgagaataattattgttgtcatctactacggaatcctgggcccactttcttccttcttcttgggggaggaaatctcccagacatcttgccaagcatttgcttaagtctttgaaccgctgcactagctaatttctccacctgaaacaatatacaaacccctcctcttctccacccgctaggttcttatgctggcagctcatatttttacaagaaaaagaagttagaatgtattgagcacctgctataagcctggcactttgctagtcactgtgtggcagatgactacatcagtcatgactgataaaacataacttctatccttgtaagtgccgcaggacttatttgtgactcttaacaacaggggttccaaaccttagtgtgcatcagaactgcctggggcttattaaaactcagattactggacctcatccctagaatttcttactcggcccgcaggtctgaggtggagcctgagagtgtgcatttctaacaagttcctagatgatgatgatgttgctcatccctggaccacactatgagaaccactgctttccatcaagcctgtgaaatagatattattcccatttatagatgaggagctgagatgtagagaggccaaatgacttgcctcagttcttgcacacagagccagagcccagatttgaagctgagaggcctcactccaaagcttctgctgtttccattatatcagggatggcaaaggcatagataccacctgtgcttccctcacttagtccacccccacgacaggcaatattaatcaatcacagcacctctgagcccagagatgtcctcggaatctttcacacactgctcctgacagccaaacctacccgtcagtgggagctgaagtttgcaatttctgtactaacctgtatggcctttctaaaatggagacattaccaaggaatcaatctattaacagctgaaaacaaaccttgtgtgagctccagtcttatctgcctaggagggaagagcgtggtagattgcaggctgtgtgaagcacagcactcccatggcgacctcacggatcataactagagtctacactcagcacacaggcaacacagggccgttacccttgaaaagtgtaaaaatctagacgaagttaatgaggagactttttttttaagctgctatattttgtctaattcatatatgctacattttattctaaaaatagttattctactctttggcactaagtttggtgatggatataaaatagtgatcaataaacagttgttaagaaaggaaaaataaagtaggtgccaaaggcaactgtgtccacacctgatgaggtcttttaacaaatggatgggaggaataaacaagactgaattatgtttttatatatcttgcgcacccaacagttcttagcaaggcccgtgggcagtagatgcccaataaatatttatcatacggaactacaaatcttgcttgtgaaagtacaaagcataggtgtatcctggaggtagggaacagtaaccctgagagcagactggtttaaggccatctctggccaaaccaaaacacattacagaggctctctgagtcccaaagtcatccacagattgatgtcttgcttctcttcttatggcataagagactggtagaaaactgaccaaactcatcaagaaagtaatatttttttttcctctgaaaattgtgaattgtatcagatattgccactattatgcccctaggtcacttgctcatctgttttccacagggaagccaaaacagaattttgcaaagatatacatgagtaatcaaaggaaactgactgtattgggtgtgattctcctgtcttctgaaataacccaccatgatcttttgcgtgtttctgccagcccatacaatgtctggtctcaccaccaacaacaaatatttagtctatggctactgtgtatatagggcaacctcttgtctcatttgctgtttgtgcagcttaaaagcaagggcagggtgaattatggtttttttgtttgtttgtttttgagacggagtctcgttctgtagcccaggctggagtgcggtggtgcgatcttggctcactgcaagctccgccttctgggttcatgccattctccttcctcaccctcctgagtagctgggactacaggcacccgccaccacgcctggctaatttttttgtatttttagtagaaacagagtttcaccacgttagccaggatggtctcgatcttctgaccttgtgatctgcccacctcggcctcccaaggtgctaggattacaggtgtgagccactgcgcccagccctaattatgtttttatatgaattgcacaccccacagttcttagcaaggcccatgggcaatagatgcccaataaatatttatcatccaaaactacaaatcttgcttgtgaaaatacaaagcataggtgcatgctggaggtagggaacagtaaccctgagaacagactggtttaaggccatctctggccaaaccaagacacagttaaagggagcatttatgtccctgtttggctgtgatatgccctatagactggggcaaggctgtggcagcctggccaggatgaaaacgctcatccttgggctgcccctagatgccaaactttttccgtacaagttttcaaggcacattattaaaagcagttacgtaagtggggaactaactgcaccttataaaaggcttaacaggagagacagagtcctccatttggagctgttttgttaaatgttgagaatagagaagtccagaagtggttggtgtttctgctctacactgaaaacgaattgggctggagcccatctcacagcctgcctttctttcttctatctcacccagcttgggcacaggcttttgctatactgttggactgggcagttccccattgatagagatgttgtttaatatttaagtatgttgtgtagctcttaacatcgaaagagaagaaaaaaggtccagtttatctttagggtgagctgacctttccagatggagcagggaaatctcctgaggacaggaccctgggaggaatccacttccctgcttaaaaagcatggtgaggaaggttcccttgggcttgttggatccagtactctccagtgggcagtgctctgtatgttctaggttagagtcttagataatatgggattttaaaaccagtattgtattacattagagtattactgcccttgggaattttttagatagttccttttggggagagaactgttttgtcctatccattgcagatgggagcaagaacatacaaaagagcataaagaaaaattctgccgatgtgggcatttccttgaggctgagggactaggagaggcaccaaagggtgtccttcattcatggtaaaagccctaatagcctcagtgttagaatatcctgtaggcaggcgaaggatgacatgactcactttggtggtgacctcctagtagttcaactgagaatccaggcgggataagatcagtgcagggtaattgtatggtagctagtcaacctttccattgcttagccggagaattctggcttttgtgctggtgatgtcaggcaggtgttggaggaggagttccatgaccattttctctgttcctgccaacaggaaagctccattgggacatacacgctcacttccagggtgttttatattcatccatagctgctgcatggataaaaaatttggcgaaaaacttgaaatcctattaccatgatgatcattagaactcatgttagggctttttgtttttaaaacagggacacaaagaagaaacagaaggctgccatatgcaaggttagtgaaagccccttaccttcaccccatttaaatcctgaagagggaaagtagctaagctgtagtgatcacttcctgcaaagaaaaccataattatggcgcccagttattcttcataaggggaaaccttggaatagcatgggtgctattttgaatatttgagaaaacagtgacattcaatatgaaatggaaatgattctgtgctgctgggattggatcagttccttctaggcatcagttgcccctggggatagcctagttctccctcctgtgtgaatttgggaaacactagaatcttgtagttgttgctgactctcccaccagcagggaaccaacttatgctcttgggagaagcagggggagtggggaatctgcttttctctttaagcttccaatctcaactgcctaataacaagggaattcgactatcaagatttcctggagtggcttaagtatgggcgccaggatgcagtcttctgtacacagtgaaagaaaacgggggtaaaaaccatgatgaataggtgcagagaggagtggctagatcacctgcctgggggatgagcctcccacgtgactgtaaggttgtgcaagaattgggcaacatttggtcagggtggagaggccttgacaaagcatttgtactcccactagattcctatctcctccgtggggaaaaacaagtatttaaagttctacacagtgttttaagaggaagaaatggattgccttactaccctagcatacttcatttgtacatatttggagttctattcactaagcacccactgtaggaagggcactgggctgaagatcccagaaaattaaaggagacacctttgttcctgcccataggaaatatagtctagtgggggccaggaaggggtaagacgagcatacaggtgatcatactcaagacaggagatagtaaataccctgatatggaaatagggaaaatggttctaggggttttggagaggagaagtgagagggaggcggtaagcctgcaggccctggagccagactgcctgggttccagtccgagatttaccacctatgagttgtggtatcttggagaagtcacttaaacacattgtacctctgattcttcaactgcaaaatgtaggtcactgttgtacctatgtcagtagataatggtttactgcccataaacattggtctcagcttcaggaccagcaggggccgtgctgaccttgagctagtgacttacaacctccaggtctcagtttcctcatctgtacaatgaagagattagactggataaatgctaacattttctttattctaaagtgccgtgatttcatggttgaatatgtattaaatgcctgctgtgtgcccaatattgtgttggcataatgaaaaagagaaaaagtaggatatgtggtccctggcctcaaggagctataatctaagtgaggagaggacattaatatacaggagagtattagagaattagagaatattagaaattaaaagctaggtggtatgggcagtgagaacataggaatagagattttagaatggaccagagtagtcaggagatttgatagtgacctatctaatgtttagaaccacagagactttagacaggagctcagacttgtttacaaatcccatgaattctgaagcttggaacactgccattaatatttaaattaaagttgaactgcagaaaaacaaaagttacctatttggaatataaggtgggacaaagtttataaaactccatgtctaaaaccggtagtgtggatggaagctataaagaggctcaaaccagcttcccatatatccttggatgacaattccattagaatatagcccctggcacagagtaggcacacacaaaaattcatctgttgagtgacttgtggaaaaagtgttctgccctgttcagctttgaacagctgtgggcaccctggtggtggtctcagccccacctccagagggcagtgcacagaggaggccccgccagagccctcctgccaagtctttgggaagagcttaatattgcctcatgcctcctgagccagccctctatcaaaggtgaattctctgctcccaaatgttaacctacctccgggggggctacacgtactccctccccagaattgtctgaacttaggttttgagaaaacttggcaacagcctcaaatttttcttccagtctaactatcctatggtccccagagtccatatgcagatcgggctgttagtgaccctggcttacacaggtaaaaaagagacttaacaaaacttggcagagactgctaagtgccaaaagagtggtgtagacagtaagtgaggtcaccccggccaggaaattgggggcacctcctggaaggagggagagctaggagcttgagtgggtcttgaagaatgagtagaggccacgatggcaggtaagacaggtggaggcattaagtacttctgtccccatgaccagttcccccataccactcttcgttaaccaaacatgggaggtggcaggcccatttagatctggtgctttattctaagggaggaaatgagatgaaaatgacagatgaagtgcaagcttgaactccctggcctcaaccagtcactgagaatggctgcccatcccccaaacagtcagtgatggcctggtttgatgggcctgtttatgacctcctggcttgagagcagcagaccacaaaccttcacagagctctctgttgaatttccttcccagtacagaacccagaagtcctagttataaatgtcactacactttatttatgtagcatcctctgtgaaaacatgagtatatatcatatctaccatcagaacgtaccttcagcaatcacttagaacagtggggaggacagatggggtcttcaaggttcagaaaggtgaaatgtacaatatcttcccattgtaactcttcagagcaaatcagaggtgaaaatgttcagaacacaagtctgccttccaggccagtcttctaagcacctttttcttctctttcacattttacccttgtctcattccctgttccctcctcctttttgttcataaaaaaaattatttttttccaaataagcaaaatggagtcaaactttgcatcctcaaaatgtatgaagtaaacattattcctaatgagcctctgggaaagtgctcacctttgaacttggccaaggattatgcagcaaagaaaaagtcttaagaacttgatagagtgttagagcttcctgggtttttaaagtcaagttgcatattacatttcttttccttaataggggcatttccagaaacccttcctggttgagtaggccagtgtctgaaagtgaagcgctaggattggttactgactctggttcagggattgtcatctgggtgcgaggcaaccacagggtaggaggcaccattgctagaatgctctttctttcctaggactcagcacctatgccgacagtccttgcaagacaggaggggaacgtgtaggctatcctatttatggtaaggggaggcctatggaaaaacaggaagatggtcaagggaagctggcagcaaaaaggcaatgagaccgaggagttgtccctgtaagataagctcttttccccttggagaccttgcctattaattggcctgtgctcatctctataggctttctattaaaacacacacacggccaggcgtggtggctcgcgcctgtaatcccagcactttaggaggccgaggcgggtggatcatgaggtcaggagtccgagactagcctggccgagatagtgaaaccccgtctctactaaaaatacacaatttagccaggtgcagtggtgggcacctgtaatcccagctacttgggaggctgaggcgggagaatcgcttgaacccgggaggcggaagttgcagtgagccgagatcacaccactgcactctgggtgacagagcaagactccatctcaaaacaagcaaacagacaaacaaaacacacacacacatccttcttaaagacaaaaacacctctggctgtctgcatagcttctgcctgcctctgtggaatattacacattttaaattccccaactattgcctcacagccaagaagttcacttataggcattgagatgaatcattcacagaatgacttaaatccaactaagaatgtgtaactgctgaacattctgattgaggttccagaccgtttgtgatgccacatgtttgttgtaacaggcagaatcatcagtaatactttgtttctcttttcttgaaactttccctccaagtttccatcttaatgctttaaatcatgacagaatcaaacaagctctgtgccctctgcccctgacccccgtgatggcatgagcttcaccaagcacccccattcccacagagatctgggataaaaggctttacagaatccagaatccagctccgtttctgagctgttatcgcttcatagcacaggctgtctttttctcttcctacacgtagagctaggcacacatagatgggtagtgcactgtccctgaactgaggctctctcaagtccaggctaccttctgcccagcacctacttagtgtagcttatcttttaaaataagccatcctgcaaagagcagggttcccagtggccttgaggtttgtcagaagttctctagaattggcaacttagctgtgacctcagaagtcttggctctggcaaagcaaggtctttgcgctaaaacaggctcagtgcccatggagataatcacctcttgtaatatccacacaatcatctcattgtcaaagcacaaggaatgcaaaaatagaagaaatgccacaatagggttgccccatggttcagctaaaccaggattctgcttccggctgagggcaccttgggacaccttaggagggatggtcccaagcattgttctggagttcagcccctgttggcaagacctgtcctcctacaaccatagcctcacggggcctgattttgccccatctttttgggactcctttaccacctccttgtcctggctaactctcctttgtccttaaattcacaactggggaaacccttgaggagtctttttttttttcctccccattttgggttatgtcatctttcttgctcccagagcacttgctcctgacttctgtagcaatggcctcaacactattgagtgtgtagtatttcttaggcatggttctctgcatacatgtatatattatttattcctcacagaggctctgtaaggcaggcactcatagacgctgaggtttagagaaacttaagtaacttgccccaggtcatagagtaagtgtccaagtcctcaagcccgggcagtcctgctgcatctgcatggcacatgcgcttggcctggtctgctcagtgtgtctccctgactgggctgtcagttcctggagggtagggatctgtcttcccttctctatccccagtgcctggcatgtagtagacactcagtaactgtcaaataaatgaaagccctggctcatcaaacaaagaccagatgtgatttaaattccaaggagccatactttttacaaaaatgctaaaatgccaagaagtactttttcattaaaacaaaacaaaactgttttagctatgtaagggtggccttttagaactctgactgctttagatctttcctctaggtggcatagagttgtggggtttggcagaccaccatgggaaaagaacagatgcatttgtcagaatctctgtggccatcagacgtcactccaatgaagccaaagctccgaggtttaaaaataattaagggaaataactaagcggagagacagaaaagaccacttcttagttgattctggaaaaatgaaccttttctttctaccaaccggcaccgaaattcagagtatcctggacacagctgagagactactcagggagagccactgcagtcacaccccacctccacttaggtctccctacactcactctaatcttctaaatcgtttaatcagacacggcgctgcctctgaggcttcaggactttcaggctgtttttttttccccgggcttaaagtctttctctgctgctgactcacatgttaattattgctttgcataaagtagaattagcagtgctcctgcactcacctgcctgcgtgttatacaactgttttatctgctggacagaactgagtgtgcaggccggcctgccatggtgtcaccagcggccctgtcttcagctgccagggcaatgagcatcgcacagaaaccaaccattgctttagaggctctggggaagaggctgtggggtgtgctctgcttgtcccaggaaaaagagggttaagtgccaagttttgaccaaaatcttataagaatggtccaggagtttcagttccctgtcacctgtcagtgttaatggacagaactggtgtttcacagaaaaaaaaaaaaaaatacgtgtgtgtgtgtgtgtgtgtgtgtgtgtgtgtgtgtgtgtgtatcaacttgttttctctttggctgctgggctggataatgaagtaaagatgacattatctctaataaaagtgatttgcagaaatcactgacgggacctcagtagcagagattcgccattagcaggctagccagataagaggggcagctgggttctgttaaccccctcctcgtctgatgtgtgtcttgcagggaagtcaaaggcggaggagtagagtagagtggactttttgaagtttgggctaatggacagtgttttttccaaagtgtgggctgttctttagccccacttgctgatctttagggatgtcattaggttttcatttttgttttgtttcttaggatttttgtgttagtggctttttccccctggggcttggcccattttctcacctctatgttatatcaccagaagggtggaaccctggccaagccctggcatcctctgccagaaatctgagtccaagcagggcacctacacatgtgaggtgagggctctgggccacgggtgttgggcaacagattgttctgtagtgtcgaggaggtgggatctgaggcagaaacctccctggcctcttaaggatgggacgggtcaggaggggaggggtctgcccttgtccggacttgttcacctgtgtcagtgagagctgactagcagctggctcacgaaacacacccatgatgtggacagcgggcacagccagctacttctgtgtgaaaacatccttagtatacagggatttgtttcctggggacagtgaggagtcatggggtgttaagcaacctagtgatgaatatagccaccatcactcgcctttattaatccactttctactggaagcactaaagcattggaactctgcaatacccccacagctgggggaccgtgactgatttaatcttcatgccagctcaccataccataactgaaagggctgtatgacactattattgttggagtaaggtactttgatacatgagaggtttgacattttgcctgtgccctcagagaaccttaaaactaggactaacaaggtgacggtgccttgcagtcaagtagcacagattgtctaagtgttccaggcaggagtgaggaggagacaccagtgtaggctcggtaagatgctcagaaaagcctctgtggaggtggcaggcctatgttggctctcaaactttagggtttagaaggtcagaaaggaagaagcacttcaggtggaacaaatcaactggggacatggctgggcagcagaaaggggtgcggagtttgggggtggcagggcatagtgtggtctggctggagtaagcgtggagctacaggatcgtaggagctaagtttggaaagggctgggagacctcaaggagcacgtccagcttggacttcatcatgaggatggtggggagcaattttcattttaaaatgggggagcgacaagctgaaaatggttttggggaaagagtggtgggctggcgagctgttccttgccccaagatctgactcaaattttattcttggtcagtggtaaagaaagtgaggggcaagggaaacaaacagaagatggggactaaggtctgtggaaataaataaaacaccaccagagccagaggaggcgtgtgccctgggtgaagtttgtttttcatcccatgggtaacatttatgagttactgttcagcaagaatgccttgcggaggtctctgtggactgagctgaggctccagcctgtggcagcccaggaattgctgccatatttagagcttccaacagagggtttcattttccttggctttggtgccaagaaaagaggggttctcacacttgctgtccagcagggccaaagcatgaccagcaggaggagcatggaggttgggttctggcactgcccaccacctggcacctcagccactaatcagacaacaggctaggcaattatccgggcatctgactttagctacctgtccttttgtttaaagccctttcgtgtgcttggcaccttatggatactcaacaaggtctgtttaatgaatgcgttctccccacccagattctcaatgccttgctccctgttctctagcctgtctcccgaccactggcacctctgcccattcccagtgtgtctttgtcatccctctgccatcctgattgcctccctgtatcctgctcttctttcaaagccaacctccagcagagttctccctgtcttctccagccttgcaggctttctcctcccaaactcctacagccctgactgttcagcccattcttcaggacttggctcttcacctctctgcaagctccctgaggtcaggcatagttgttccacatttcattctactgctcacagccccatcgtaggaagagagaatcattaatatatattgaatgagcagagggaataagccattgctgggggaaaaatacagttttatttcccaaattgctcaatgttatttgagagcatgataataaatttggaaaagacttttagcatttcctgtggcttttgatgacttctttacaaaggaatggaaatgtgcgcagacatctcacttctcatcagagcaagagagggcagaattgggggaaagcaagtgttcgcgctgtggcatgaatcagatcccacaatactagacatgtgaccatgtgaacaggcctcagatcaggattctttataaaggaagcccaggacagattctctaccagctctctcctctttcacttttcctctttctttgctttcctttttttaatagggaggggagaaggggttatgaggatgggggtaggagagtgagggatcccgtgctttctcccccttctcttgctgttttgaaatactttaaattccaggaaccagaagttctggcaacatgttgggattagtaaggcagatcctaggatatttcactattagcatgtgatcaagcatcagtcctgattaaaagtctaaacaaatgttttctttgaaattaaagtgtctgaaataaagaagagagaactgacccttaaaatcatattctgtacttgaaaagagttctgacaactgtctgtcccggttatgtgcacccccgccccccacccgcctttttccatccagaatgtttgacgacactgccaggggaatttctgccccctccttcctgtatatacccagtgctggcctctgaggcagtccagctctgttttctcatgacacagtgattatttttggcattgcagatattttttctaatgttattacccagcccccttcttggttgccttttgtggagcaatcttttgggtaactccctgtaaatttgagggttaattttagttcggtgtggtagaggaggcagtgggagagaggaggaacgacttctactccgaagcgccccacccccaccttaagaggagccggagaggtcctctcacgccctgctcatgaaagagcttgctttcaccagctctgtgctcaccattcatcctttctgccggcgggcttgaggatatggatatccagaggtgacgctgggggctgcacctcggggatggcatcttaatgacttgacttggcgggtgttagaacagccccattcagagtgagttcactccctgcgcagttggctcactcggcctctgtccatagagttctcttgttcacgctgcaggaggaaatggagatttccaagtgggaaggagccttcccgatgctttaactcttcactgaagggaagaggagctgcagagagcgaaataaaatctaagccgccccagctgcagcgcctgggagaggagcaaggctgggctggggatggaggccaaggcagctgggatcactttttctttcctccttgagagggaaaggaaaagagcaaagggcatttttgattgtctttcacaatcagcaaatatttacccagtttgtctgccctagcccaggttccactgaaggatacacgaaagtggaagatgttgtgtctgtgcccttcccctggtacttacagcacagttataggagtagaacgtttgcatagaaaagccaccaagacagggaggcctttaataagggcctatgagtagtgtgggcaggaagtaccctggagaatgttgctaaggggccagggacactgctggaagaagtagggcttgggctggtcctaaggggtgggttttgaagaaataggaaggaataaaatgatacaggtagggaagacttgaaggaggagagggacattaatgtagggcttagtaaaatcccataaagaaagctacaaagagaacaggattcttcctggccagagagaagattggacttgttggactttacgtgcctcagattaggatggcagcaggcagcactaaccctgccagatggcatcttcagtctcaagatcgcacgtgttcctgggtctctttctactcaaagtgtgaggtcacagactagtagaatcagcatcctctgagggttgttaggaaggcagaatcccaggcttcagcccagatcctactgagcctgcactgtaacaagatccctgggtgattcctggccacagcaaaggttgggaagtgctgctctgggtgactccacaggcagctgtcagcagcactagttcagaccccagatttgattcacagaggtgacaaaacaccaacagacacacacaccttgagtgtccgcagggtgactcttcccagatggaaaccgtctattctaattaagagccgggttagaattcttaggaaagatctagaacagtgagcagctttgaggaatccacagaactgaagtcattgacgtggtttttatccgatgtctccagtttgtaccactttgtactactgatgctttagaggacaccaaaagaacaggtgtggggttctttccctgaagagtatgtggtctagttagggagacagaagccacagaagtgaaatcaaggagagcaacacagggccaaatcgtgcgtgtgtaacctctgaaatgggacttggaggagaagtcagtgcaggtgaggctttcctagggaaacggatgcatgggagatcttgaaatatgagcctaattcagacaggcctgggagatggagagagtatattccaggcagggagtgggaggggcagcagcagtagctaagtcccccctagagactgaagtggggcgggaaactgctccccacttgccccacggagtttgcttcatgccgaggaatccgttttacatctcaggccttttcttcttgattcaaccgccgtgcaatttctttgtcaattttcttagctgaaggcagtgttgtaggaacaggatggcagcacaggcagaagggtttgagccaaaccacagatggtgttgttggaagcttgtgagatccaaaggaagaaggctgctgatgggtagaagccctaaggaaaaaaatctaaatcagatctggtaacagcctgggtgtggggaaataccttcaagcccagagaggtggcaccaaagaaaacagtctggtgagaaggaaacaacctgtggcagctgtagactccgcaagcaaagcacaaaccttttttttttctttttcttttaaagacagacttctccaagctgagaactatcccaagggggctggtgtgccagctgaggggctggcctcaggcaaaatggtggccagcgtgtctcactttgctgcttcccagaccaagtgtatgtttcaaaaagctcatcagatttagtatcctagaaggcttcaccctcaagatgcccagctcagctaaatcttttgaacctgagggacttgcttattggccttgtagggaaggtcacccaattacaatcaagaatatgggatttagggtcaaatgatccaggtttgagtgctggctccatcactgggtgatggctgggcatgccactaacatccttggggtctgtctccttatgtgtaaaatgggagtgatacacctgctctgcaagattgattcaggattaaacagaagcaatatgctgagagttctttactaactggaaagagtcacatgtggttgtttcctagttatatagtcagtatctcagcttgcggaggttaattagtctcttagctgaaggctgcatggtgtcaggggtcgggcagtggcagacatcagaggccacagagagcaatggagagccacgcaaatgcctcctgcacccgctggctttctccctgctttttcatgagtgaagacagcaccgagtcttctctatacatccctgcagtggataagatgaggggtgggaaagatggaaagaacactttatttttacagtgggggaagaggtcctgctcatcagcaagggtggccctcttctcagaactggattagagtcaaaggaagccaccagttttagcacagctggtcttctcttcagatgctttgacctgcgtatgcatgaggaagagaagcagcctagagagagctggccatgggaaaaggaggctgagcctggttccaaggctgagactgttgcatgttctgtcttccttccctctgatactgccctctgaagcaccgtgacccatgctttgtgctcagtaatgctggctgtggtcctgaggatgccagtgtagccaaatctgccaactcagctttcatggggtgggggtggggtcactgtgaggtggctacggggagctggcagcaagctggatacatatcttttattgtaagaagtaagcaatacctgatgccaaggtagttgtcatggcattatttataacagctaaaaattagaaaccataacgaaaagcaataagggaatagtaaaatgcattgtggttcagccacatgatgtgatattgctggctattatgaatattttgaaagaattcttaatgggatatcctgttaagtaaaaagagcaaagtattaatttataaatccaatgagatctcagctcgttttcttcatacctttttgtatttttgaagttgcttatactaaatatgcattacccttatcttcaccacggcatttttaaaaaggaaattatgtgttgggaaaagctaggttatatgatggacagataatgaaggtctgtttctaatcgtgccacatggccagtgctgcttgtcagcaggcgctctgttcacagggccttgaaaaagccagaactcggggcttttgttccagttccacatactcccattacctttctaaacctcagtttttccttatctctaaaatgggaatgatggtagctgctcttcctagcctactgtgtgaaatttacaaatttagttacagatttccagattcactcacgagtgttttagactgtagtgtgtgatccaaatgtaaagtggtattattcactaatatgtagaataaagaatgccccactgtcttagcccatttgggcagctacaacaagataccgtaaactgagtggcttataaacaacagagtttcatttctcatggttctggatgctgggaagtccagtgtccaggtgccagcagattcagtgtctggtaagggcccactttctggttcatagctgtgtctccacatggtggaaggggtgagagggttcccctgggcctcctttgcgagtgcactaatcccattcatgaggacttcactgtcatgagttaatcacctcccaacggttccaccttcagataccatcacattgggagtggggatttcaacataagtattttgaggggacgtaaacattcagaccttggcacccactaaggcttgggcttgatgaagctaagcacagggacagttcattatgattattcctgtgtacacacagcttttcccagctgggctggggagtccacgtgtcctccggttacgtaaggagctgggttatctggagccccagatgggctgcttagtaatcgaatctgctgctcttttctacaaggctgcctggggctgagaaggccagaagataagtatctccagtcaacccaagcagaattgaccattagagggccatgctgggtgagccccagacattactgtcagcgctgaatgcagtccaggccctctgctccagggacacagaccgttagagtaggtcagagagctggaggctcagccccagcggagcggaggttgggaggctgaggtatgagatgctttccaggattcctctttcagggaagtggcaagtgaaagcatttgtccctgttttaaccactccagtctcatgtcttctctcttctttgtcccctcttgtagacttttgatatactagtgtggattattagtcttatctcccagatgggctgtggtctctttcaggatagagaccatgcccctcaggagaggtgtgtgtattaaagcatattaatgccttttttctcttgtcaaagtctgtctgatctggccagctcctcctgaatttgctaatttaatattttccattctgaatttgtaactttttgttgttttgctttgagatgggttctcactctgtcacctgagctggagtgcagtggtgcatggctcactgcagcctcgagctcccaggtcaagggatcctcctgcctcagcctcttgagtagctgggaccaccggtgtgtgccaccgtgcccagctaatttctaacttttttagagatggggtcttgctgtgttgcccagctggtctcaaactcctgggctcaagcaatcctcctgcctcagtctcccaaagtgctgtgattataggcatgagtcactgtgcctggcctattttctgttttcactatctaacattgatacctttcctccctttgtgatagattcccctactgatccctgcagcctttggacatcagaatgtacctagaacactgaccactggaacactgccttcatctcaaacatttttgtcactcctttggaatggccctcacagccaagaccattcttttcaataccttcaattgtggcaaagtcttatcttttgagggcacattttatcctatcaaacaaccacaatccatccacagctaagtctggtgactaacggggtgggtaaactggataatattgtttggggtttgaaatgaggtgtgtcctttgaagagttgtgactgattttcttatgtggctctgaagttaattctaaaagacttcccaaaagacagagcgatggccacctaccagcataaagttataggcttctcccaaggtggcttctttgaagggtagccaccttctgtgtggcatctatttcacatgtctcattattttcatctccctcttcctattagccatagcatctggtacagtggtgatcacaccaactcctagataaatgactgtttggcttatgatggtgacttcaaatttgctggacacagtgaatatggacacagtgcatggtagagggaaagagtgtggttaggttttggaagtggacctgggcgtcagtcttccatagacacatgatcacaggcctggaaatctatgttttcataagtcctccaggtgattctgatgcaagctaaaattgagacccacggctctgcaaaactggggccaataacactgcatcatttaagtgaggatcaaatgagaccatttattaaatgcatctggccccagtgctcaataaatatgtttccttttcatcctactctttgagaaaggtgacatagctgtttgcatctccaaaaacatttaagtccaaccccatctgcctccccccaccacacacacacccacccatccatccttcctttaaaaactggctgctttggaaccgtggtcctcagccctggctacacgtggggagcttttaaaactcccattgcccagcctgcacctgagacctattaaatctgaatctctggggatagagcccaggcatctgttttttaaggttcctctggtgactccagtgagcagcaaaactgagaaccaccgactttggttctgccccagttaagtatggggaccagtgactctttctcatctctggaacctggagctgggtgtgtttctcctatcaggcagcccctgtacagcagccacaagcctcatagaagtgtcactagacctctcccaattgcatttgacctttatttcctccattctcagcttcttgcaaattggctccagcttggaatttcaccaccaaccaatagactgatcccagctggcttaattagcctcagtcatctctttacctgctgaaatccattctgtttctaagccatttaaccttatagggtaataggcatattgttttgatacctgaatggccacaggcattaggcatgtgagtcctaatcactctaaaagtctagctaattaggcagccaacccctctgtgttactggtgacagacatcttggggcctcactccaggctgtgttcatatggaagtcaggaaccaagatcatcttgaccaagagcagatcatccttagattcatgacctaagtagcgatccctaagccatgctcggagcaatgacctaaaagttaagatgtttttaagataacgaagctctgggcaaagaggtttttcctggatgaactgtagcatatctctgctgacaatttttggacatttcagttttgttttatcttttgactggctgcctggtgcttaagtggttgttaactttagctgggatcaaacgtttcagaatgtgagtttccacctcggggagagtaactataaatttgtgcatatgaaaatgtccagggggaaaaaaaacaaacccaaaacaaacccaaaacaaaaagaaacacctttttctccacctgcggcatagatagatactgtggcagggttggacctgctgcttttatggaacactgcagagccacatctgataacattcccccaccctcccagcactactgtgaccggcacctgtgtctgctaaggcccacagcacttagtcccttcttcccccgccgaccccatctgaactctgatgctggttcttagtcctactcttaacattccaggtgttctcctaaggtgaatgggtgcacacttaaagacatgaggctcccctcatgaaatttttgtcactgtatttaaaaaagtattagcccttcttcccaaagtatgtgtgagcatccaggttgtgggaaagtatcaacacagcacagggaacatcaaagttgtacagtaaatgatagtctccttgctgccaatggaaaaacttttgatcttggacccagaagaactaggtttgagacaatgtttttagcaaattatttaatctctctaaatctccacatcctcatctattaaatggagatgatagtttctatctctcagggttgtgagaatcaaatgagataacacatgttaagaagaagtgctttctgtaaaggcattattatttgtccttttaggttcagctgaaatcccacctccctgacttttgaaccaagaggctgcctaagattctcaatcttcctttttctggaagctaaggtgttgctgtttctttatttcttgccaaagccactatctcctacagttaagcagtgaaaagagtattcgcctaggaagagcagggttctagccctagctctgccactgattagctgggttgctctaggcaagtaacttacctgctcaagtgtctgtttccagatctgtgaaaggggaacagtgacagtacctgtcttgcctacctcacttggttgcaaggatggaattagatagggatcccctgtgtgtttccggacttctaagtgtctgctcactgactataaacccttaaatggcttatgtaggcattggctttgtgacattgggcaaatgacatattatttctgagcgtcagtttccacatctctaaactgtgtaaacaatacctactttattttgttgttaggaagagtataatgaactaatatatgaaaggtttttgatagagcaccaggcacaaaaagcacagcaagactcatatatcagatgccattgtcagagcattgactccagattgccttttccctacctggcttttcctctctgcctcttcttcgaggaaggggccaatggcagagggaagctttgtgcatgcagatattggcgttaatgccatagcctgtgctgggattgcttttgcttcaggatggcttcccttggcccctgatgacgaggttatgtgttgatgatgcttttgttggagagcacaagggttagtaatgaaatccagcatctttcacctgaccctcctgatccaaaggcatgatgtgtgcggtttcagcatcctgccctcttcccatcttcctttcctgtgccagaatacttgcaattctttaactttttctccacaatcaggtcaggattaaaatgcacgtgggagggactaatataaaaactgccactaaaggtctaatcagggcaagtcctgagaaggtggggaaaggggggtgcaggggtaggtgtcctgaaggttggaagtcagggagagagggaaacagggattagataaaggaagcagagaagggagacatgacgagaaaaatagtttcactcatttcacaatttttctgaaggttcttcttgaccatcaacagctgttggacgattcatcctttaatccgagtatatgatgcttaatccatccacggagctggatagtctgtctttttaaatgaagtatgttgtaaaatcaaaacagtgcttctgccccaaatcttgagggatttgagaggcatgctcacattccatgaatcccaaaatacagattttctgtccaaatagcaggctgcaaagccaaacaaaaggagaagcagcctctgggatctcagatggcaggacagaacgagccagctagagctgattggattgaggccttgaaacctatgaacttcgctggatgcttttttattttatcttatttatatttttatagagacagggtctcactatattgcccgggctggtcttgaactcctgggcccaggtgattctcccatctgggactacaggtccaaatactaccatgcctggcttagatgctttttaaaaaaataaaaaacatacttgtttcttcattaaatacgcaatataggttatttatagaaacacaagaaaatacagataagcattacaaagcaaaacaaaaaccaaaaaaactccctttaacctcactaccatgcaactgctaacatttttgagtagaaggagacaggacagtcattggtggttaagtgccatgattctggggcccaccttcccagtgcaaagcccgacttccccatttacctgctggaggccacaggtaaattacttggcctctatggggcagtttcctcatatgtaaattaggtataataataataataataatgcctacttccaagggcagttgtgtgagtttaaataagccaaggtagtactgcttaaaacagtccttgtaagcactatgtctgtgatacctataataatagttattatgcatctagcctttctcctatataatttataggaagtattatgtataatacatttctgtgaaaatagaattgtcctgtactgttttgtaactttttaactcttatgattgtcttttcatggccatctttttaattagtattagctaacattgattgcttacagttggaacaggcttagtgctaaagattttacataaattatcacatttagtcctcacagttaactctgtagggtaagcactattgttaccattttacagatgaggagactgaggctaagcagtttaaatgatttatttacagagctaacaagcagagaagttagaactccaatctaaacattctggcttttaaatattgcccgtgctagaacttgccatggactttataagaaagtccaggatttctttaggacttctaaaagaggcaggcttcagtgcgtgtcatctttcgttccatcctgcagcaaagaggagaatgaggctgagacagcctggcaacctatgctggcagggcttagagagaaaatgtttgtgcccactcctttttaatccttgacagaacgcacgttggtactctagactgttgggtgtctggctaactgttctggggctgtaatggcattttcagtttttactgtggaaatcactttctggtatgaagcgggatctagggttcagtactactcttaattttttctgattgtgtcttatgcagaaaaagaaccttaaagcagtttttttatcttgttctccagagcccttgacaaagccatctgagccactgatcatagcttccttacccttctctttccatccctggacattcacccctatccccagatattccagggctaggtcccaggcattggtagttaatttaatcagccagtctttgcccagactccacccatgtgaagccctgttctggcctccacagggaatgcaagaggaggactttggttgtgaagacaccaacacacacaaaagcagagctaacaatacaaagcaggttgtgtgtggctcagacaactggtgtgagcccagatcagtctagtaagggagtgtggctgcactgggggttggggccatggggatgtcctggccagaggtatgataggctgacagtaacctttccgggactaaccccttcttctccacttaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcaggtaaggccagcaggctcccctaggctgggcagatgccagccttaccagcatgttcctatatgcaggggacccttctgctgccagagctggaaagtcaccccactacagaactttcacccacagaaacaccatcatgagtgatttattccttcatgttaaacatctctcttccagcagtgacctttaccgtgaatccagctgtgagaggagggcagggacaggaccagggaagaacatgggcacccagaggctgtggagaacacgggctgggagaaccaaggacggcttttgctgacttctcaatttgttgccatctggccataagacccatcctccacactagattgagtccgcaggaagcattctaatccttaacttccagtgccttctccagaacagcaagaaggtgtgcccggatgatcttttccctctgagaagccagttaggccaagtaaatcatttagtctctctgaacattggtttcctcgtgtataaaatggggttaaacatacttcttgcccagggtgtcggtgagaatggactgaaatgatgtccataaagcacctggcctggctgagctcactcacactggggagtccttgacatcacccctccctcggaaaataactggttctcccctccctagcacctctgcaactccaaagttcacaagacatttgctttttctcagttacattcttcaagaaaccatttcctatgcgtcctgaccagaaacaggtgtcttgagtagtcttctggtttcagatcctaggtgacattctcgtcaggggtgtcagttctgtaaggacgctgggcaacgagttgtgctcctccccacctggtctggtgccacaggtggggacagtgtctgacgggtgagcatgagggaggcactcagggagggaaggttcttttgtggttgtttttcagttttccggagtaagcctggtgccttggagacggtggactccgccatcctgttatgaagtggctattctgggaaagagggaatccagtgtgaggctgggaggccagaccagaatgtactattctggtccctgtagtacaggaaggatatgggggacagactttcagaaaataggacgacagctcagtgggcctggggttggagggctaggcctaaagaggcgaaatgtgcagacaagagcaggagagccaagggggaagatatgctccataaatactttcaaagaacaatgcaagacaatggcagatacatgatcctagatgctgcaaagagagaacagtgggctgagccctggcaaggcttggattgctggatataagaaaggctgggagactccatcacagggcatttgtgtacccctccctttaaaaaggcttgtcttactggataactgagggccaagttggctaatgttgcaatcatctttacataaaaagagtagacagtggaggatttaatgactggatggaggccccttccccacagtgagaaccctctcccctgctttcctgctgtggtacttgagattttgctcttagacattaattcctttggattaatcattgcttctttcatcaccactcccaattcctccacccacacaaagccccagaaggggtaatacaggttgagtatcccttatccgaaatgcttgggagcagaagtgcttttgattttttaattttttcagattttggaatgcttgcattgtatttatcagttgagcatccctaacccaaaaatctgaaatttgaaatggtccaatgagcatttcctttgaatgttgtgttggattttggagcatttcagatttcaggttttcagattagggacagtcaacctgtatattaattgtagaatgcctctgactaaatttggactcgttgtgtttctccttatttcacagataagtgaagcacagacaggttaagattgctcaaagtcacacatttagcacatggtgaacctgcacctggaattcaagtccttttgaattttggtccatgggaaaacagacatgggacagcaagagcattttgtaaacctggtcaggcaaagatgctgacaagggctggggtatggggtgtgggggaagggagaaggtaggggaacaaaggtcaacagaagcagctgggggccagcgtgatggggaggaggtcctcacacattcagagagttgtcctgtccttccccctagtgcagggcttcgttttgcatgcttgccctcctgagcctggctgtccatctcagtggttcaaaggttggcctcgaaaaggccacgagttaggctggactccctgagcacatctacctgtgtgtgttctggtgtgagccctcatgtgctgatgggaacccctgtgtgctaaacacacccacagagataggaccagagtggccacagtgggacatcccatatctatcccatctccggagcctgttgaaagttgtggacacaaacttgcctgccctctggctgggctcggccctagaccagctagagcctttagcctgtcagctctggtcctctctgtcccaaggaaagaaatgaaggaaaaggataaaaagtttctacttttggccatgtggtcctgatgtccttgaaggagaaattctcaccaaacgagcacagcccagggaggaggagatggtttctcagcacccgcttttctctgacttctctcccaggctcctgccacacattcgctagactgattgttaagttattttcagaaattgtaagacaagatctttttctttctaaatcgtattttgcttttccaacacatgtagcgttatgaagaggagtacgggatttgtgggcagatagacctgcattggaatcttagtttggctgccttctttctctgcaatgtagtaaaaatttctctttgagctttagtttcctcatctgcacaaagggaataatggtgcttaccctgcaatgttatttggggattgagataacagatataaaaggccttatcctctagcctgccacatattaagctctcaataagttatagcttagaaataaaaattattatgaacaaatatattgatttatattaaatataggcttctggagaaatgatgtaaaagaaaacccagtgtaaattcttactatcctctaacctactttctagcaatttctatcaaaatgcagagtcgtcaaacttttccaaggcaaaacaacccacacattcattatttaagcatttctaacaaaggtgagtaccaattttggctcactttataataggaaatagctggttgcatacctcaaagttcaaaaggctaaaaaataccaggtttttctttagaaaagtttctctttacttagtaacacgtttccctttgattttcacagtaggctgttctgtgtgggaatgttggagaggaaacctcaacgttgagaaattcaggctgtgggtctgggctgccgattgagattcgtatcacaggaagcaaactgaaacaatagctttatgatattagctgccacgctgggctgaggacagaacacactcttacaggaacatcggtggaaatgccacttgattgtcctaaatcctctttcaagatgagccccacaaaccatgagcgaatcagggtcaactctgcattctgagggcattaaaccgcagtgaatatacaaaatttgcttttcattgtaaaactgaattttgggcttgcccaaactcatacatggcgaaatcaaattcattttccatggacctggagatcagcgtgaagcaaggtttctaaagagaagtgtcagttgcattatggattcatcatcatttgcttagcgaagacatcagttataacaagagattatattttcctgatctctagactactaagggaaggatattaaaatgtgagacaagtgattttaaagtttttaaggcttgatatgacctttccatgcaggaaaagtgggacaaagaaagaattgtggaggcagatatatgttctggtaccctctcacaccccactttcagacttcttttcccaggctttcactcctacctccacccctttgtcccacccactccaaatcaaggcctttttctgtcctgtttggaaagaactcaataagctgattcatgtgaggatgttaatgggtgagaacagctaatatacagtctcttctagagatactgactttgttcagatcattcctttaacttaaactaaaaagtctcgtcagtcaacaggtgtttgctgaacccagtcctgtactacatcaagggtaatacagagaggcaagataggatagtaagatacatgcaaagaacaaaggcatgaatctctcctagtggactttcaggactctcagggagcccaggaagatcaggaaggacacagtgccttctgtcaaaggcatcagaggagcccaggcctgctaatggtggcatttaaaggtatggctaaggatccagtaagcgatcccagagtgatttccctgtggcttgactggcactgctcttgcagtctgcacatccgggagggcggggtttgaggggccaggctgtgggtcaggtggaggggaggaatcagtttaggcagagccttagaaggaaggcccctgtggtggtcacaaagtggtaactgccaagcacatctgaaccaggaagaccccatcagaatggctttaagaacagtcagagcagtcctggaacttctcggagtaggaaacaagaggcaaagcgaccttggtggaataaaagtgcagccagcattctgaccagcagcaccgtggggcagcctggtctctgagaccactcaggagcctctgctctgccactctgcctgctctctcccaatgcacagcccctgctgcccaggaagtcccaccccacatgggcggtgctgcctgaaggaaatgagcgttgctccggaaaaagtgctccaaaacctcagcccgcgcatatcctggctgtggggagtcatcaaagcctgtttaccggggctatttttagcattaaagaatcttgttatgctccccaggacgggcatgcactttctcagcagagcacctctggttttaatgagccatctctcgtctttggggtcagaccctgaagggtcctcggaagcaagtaactgagatctggagcccaggatgatttacagacccacttggtggcttattgagcacctactctgggctcctcactttgttctgaccaagagttgatgctggattgtggcatcaccttacagcagtttatctgtcttccccaccagtctgtcgattccgagggaaggaactgcccttacacctttcagtatccctgattctccttaagacaggactgagcacacagtaagtgacacttctggacagattaccttgtgcctagcataaagcagacatgaacacagtagaaacttaataatggtgtagggagcgcgtgcattttcccatgtccgtaacactgagtaggatattaatggtacgtcagggaagacacgatgttcataggggaagaggcagaagggtcttcagcagatttgtgacatgagcctccacggtgaggggctacctcctggctccccagttttcactctcagctccaagctgggagtgacctggccaggttccttcagaagctcccaggagaacaagcaggtgctgtgagggcaactagttccacagagggaagagaccctgtcccggccctgccgtcacagggtccctggggccaacctgctggcttcctggtcctccagccattgtgaccgcagtcccaagacattctgttacccttcgtggccctagattgcccctctccctcccggaggccagctgacccgatgctgctgtagccgatttcgccacctcctggaagcaaatgcactgggcatgggtggaaaccagtttggctgtgttggaactgttaaaaacaggaaattttaagcaggactatttcctctgggactagttaacccaaatagggttgtcttgggattacttcagattttgaagtcagcgttaccactgagatcaaagaaattgaagagaaaatatcttctcggttggctagaaaccacagggttggcctctgtgtatctacagaaggtggtcacctatctggtgtgattgaagtggcgctgaaaacctctcctcactcatctccaaaataagtcaccacctgccagcacagggtaattaaggtcactcgtaggatctttgagttgaggccatagctctcagcatgtggtcctatgagtagcagggtcagcgtcacctgggaactttttagaaaaacagattctcagttctactgaaccaggaacccagcaggggcccgtccagggccagcttcatgggcgtgcagcacaggcagtcttagagggcgccacacttagaaagttctcaggcttggtttaatttttccaatgagaggtctcacatttttattttgcactgggccacgcaaattatgtagcagtgctggtctcagaaatgtttctttcagcctggcctatagatgattctgatgcatactcaaatttgaaagcactgagttaagtcattttctcccctaaagcccctgttcaaatgaagattttagctgggaaagctaacattcacagtggcatcgcccacacctgggacattgcatcatcgcttcagcgggctgatgagctggcagagaacaggtgtatcagcagaaaccccaagcagggatcaggtgtgcgtatgtgtatggtgtaaggtcattcccatgacctgtggttctcccctctccaggctagccgcctgaaccagggtgtgcagaggaaagaatttcccttgtttcaccattttagcagaacagagggaaagccaccggggcattactctgtacaacccaactcttggctctgaagccttgcccatccccggacaggacccactgtgatcctctgcaaaaggcatctgtgactctggcgtgttctctgatcctgtgtcctgaaagatagctggtcccctttgccttcactgaagcctcttggtaggaagatcttgtaatgtggatttgttcttcttgaggaataacagcaggtaacccaaagcttaaatttagaggctccaggaaaaagataaaagagaaacccagttcccttgcagaaaggcccttgaacgacatttcacagcattgatgtgtccctggccaagtggcccataaattgaattgcattctacattccttagaatagtctccatttggaagactccttttagttcagtgaatgttaatgtttgcaactgacatattactctcatccacttgttctgtaaatcaagtgaggcatattttgattgatgtttgcactggataaatacaaattttcataagtaaatgtctttggagttaaataatgaactaggagaagagggctgaaataaagtctgtggtttgtgtataacaaccaaaggcctggggcctaagaggtttcttttggtctgggacaagagccgagtctatatttttcagatagcagaggtatactagatagggcaggatactcaaagtgtgggtggttccgggtggaagttttcctaggctgcacccagcaaccacctgtacggcctgctgagaatgcagttgcctgctcactctgttttgcacctctgggcttcactctctccaaaccattctgtacgccattgccagactaatctccccaaagcagtgctttgagatgcactcctctgatcacatttgcttgacatgtgaggcccctccaggacactgggcctgcctcaccagcccaatctctgagactgggaaatggattctcttcttcagccagatgggcctctcttcagtcctaggactgaagcttgctccaggtgttttccagtgttcacacaatcccgtctggttcagaaggcccttcttgcattccacagagtgaaatctgttttttctaagactcttcaaatcttctttgcaacagttagttgtctgtgatcaccccaaagcgaccccctcgtcctctgaccccttagagctcttcccatctacacttttccttgggagcccagctatgacacccttgaacttttatttagctttgcatctctgagtgctacatattcctcacctgggatctgagcaatttgagggtagtgcatgtcttggagcagaaagaagaaagaatttactgttcttatagttttaggcactttacgtacttatccttacaattcagagatggaaattgttattcccatttagctgatgaggaaagtgatatccaaagaggttgttacttatccagagtcatagcctaataggaggctgatctaggaatagaacctgtgtttaactccaaagcctatgaatggttgagtgtggcttctggattcagctgtcaaagcttgctagctttgcaatctttatacctttggacaaatggcttaacctctctacacttcatctgtaaaatgagattaagaatagtagctacctcgtcggtcactgtgaagattacatagcatgcttagtgcagtacctttcatgtagtaattgcagtatatattagcagctaaaatttgttcctactactacgactaccattatattcaggcatactttgattgatgtttgcactggataaatacagattttcataagtaaatgtctttggagataaataatgaactaggagaagagggctagagggctgaaataaagtctatggtctgtgtataacagccaaaggcctggggcctaaaaggtttttgtggtctgggacaagagctgagtctataggctgtacaggtggttgctgggggcagcttgggaaaacttccaccctgaaccactcacacagcagctcctactgctctcattactagtgccagaagtactgttgtcacaacaagcacactgtcctcacagctcccgtcagggtgtcctctgtgcagtggtgcctgctgccaggcggaggcagacattcagatggttggcagtatgcgtttccagaaaagtccacccaatgcctttgcaccatccctggcaaatgcctatctgtgccagtcccatctgttttcactccacattcatgcaagctgtcccacccccccccctttccagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtgacaccctcctctatctctttcaaaagaagaaatgtttccatttgggggtagaaatgagtggaaggtgctagccacaatcccacttgacctctccctgcaaatgcccacggtgaccctcgctgacctcaggccacacgcctcaggccacgctcccacccccaagcattgggtttggctttgctcatgtccatcctggtagacagctctctactgactcattaacagaccaagtctctgtcatcatcagtagtccccgattacatctttctgtctgtggacctgacactggactgggattatgagaaaacccaattcagtctcctccctgcctccaaatctggaaggtggctcagcttactcttggagtcttttacttcactgttaggaataatgatgcctaaccttgtttttgaaacaggtggagctaacaggacatagtatctttgacttcactcatccctgcgaccatgaggagattcgtgagaacctgagtctcaaaaatggtatccttaattgtgtttacttccttcttgcccccactgggtgggaatctgcctcccctttgtctacgggtataagggagatagctcatggcccttgtgatgcaggaaaaatggatgtccttaaaaaatttaagtatgtagcctgtgagatgagattggggcattgagaggatccagtactcagaaatatctcctgctggccctgcatggtgcctggtgtcccactactaggggacacctttgggttaggacactgtctctaggaggtttcatcacccaagagtcaagcatctctgccaaatgacaccacccaaaccaatgaggaactagtctgtgccaaagtgctcatagtaactactgtagttatctattgctgtctaacaaaccacctataacatagggctttgatgattatctcccagggttctgtgggttcagtgggtgggtcttgtactccatgtgatgtcagctgggctgcagtcatctgggggccagactaggctggggtgatcaggatagctcacacacgtctgggaccttgtggcaggtggctggaaccctggactcagttggcatgctgggacaacaggactgttctctcactctatggagactcagagactctccctctccatatggtgtctctagggtagccagacatcttacgtggcagtttagggctcccagaagcactaaagtggaagctgccaggccttctgaaggctttgtccccagattggcagagcatcacttctgccccatcttgttggttagagcatgttacaggccagccctggctcattgtgggaggaaactacacgaagccatgagtgtcaaaaggcatggcttgttggagctacttttggagaagagctaccacaggaaatggtaccctgatgagacgcaggtcaagtaggttttgatggagaagaggtttaaaaagatgtagcattcaggaccttacccatggggatacccagcaggtgccagtagatgagaggacccacacaggcagaaagcacgttgcaatggttgcaatggcagtggagcttcctgtcttgtaactgtggccattcaacaaaggcatgaatagggacattgttaagaggactgaagctttggtcagaattggggcttaatgactgtcaaggtcccttccaaacctgagattctgtcactggtctggggagattctgtgcatgtctagatgtcctctttaacaacctcacctgtcactgccatggggcttgtgcttgtccagcctgaataacagaggcagtgaggctaagcctacaaggtttggctcttattaccacacacgctgcaaaaacagacacttcattggctcacctccaccctattacagactgagtctgcagtccacatttgggcctgcaaagtacagaatcacaaccacctcctcttctaccactgccacagctccctcacccagctcctctgctctctcttctgcaggccttagaccacctgggtcctagggtacactggcagagagcaccctgtaggctgctcagtgtcttgtctggttctgtggggaaagggctaccagactttctaaagctctctaaaaagaggattcatgttctgcatgggtaggtgcttgaagcctgagaaagcctgagaaaaccaaagactgatttcttctgtactccagaaaccctttggcctttgggttcttagtgtcagttcagccactgaccatagtctgagtttgagtctgtgaccagaagcaagtaccctacttctctgttcctcagagtctttcttttcaaattgatggtattggactaggcaaaggcgacaacctttcagttctcaagtgccatgattcacagccaagtgacctctaattatctgagtagaactttagatctcttgatctgcatattgaggacttgggatcagtcaaactcaatgcaacagcaaatcttcactgaaggtgccagcctatgggtggactcgtgatctagacctaaagggttagtgtgagttcctagaggaaaagaaagccatgaggcagattgtggaaggctttgaaggccaggtggagggccttgaactttattccatagacaatggggagctattgaaggtttctgtgcaggggtggagtgatctgtgtggagcagtgtttagaaagaatgaacaaggccaggcacggtggctcacgcctgtaatcccaggactttcggaggccaaggtgggtggatcacgagatcaagagatcgagaccatcctggccaacatggtgaaaccccatctctaccaaaaatacaaaaattagctgggcgtggtggcgcgtgcctgtagtcccagctacttgggaggctgaggcaggagaatcacttgaacccaggaggcagaggttgcagtgagccaagatcacgccactgcactccagcctggcgacagagcaagattctgtctcaaaaaaaaaaaaaaaaaaaaaaaagatcaaatgtcagcatggggagaatccagaggttagcaagttaagaggcctcaataataccccagcaacagccacaaatgaatccctccagcccccttatacccaacaactggtctggtcctggtggtggggccagatcccaagatacaggtatatctcattgtatgctaaccccacctctgaaaattaaaatggcaagaatcataatttggtatgggagaaatggttttataatcgtgatgaaggaatgttctctcttttttaaaaaaattcactattcagtctgttactgagtggggtcccctaaggatgttgaagttttgttcaagggtgccacagttcctttgacacataactcttcaggaatatgtcagtcaagatcctctggaagtttaagtgcaggggctggtgactgttcctggaggaaggagtgtgactattcgaaacaaggctctagattgttctatgatgctgggtagggggcaggattatatctttgaaagtaggtaccagagatggtggtgtaggcaggatttagacacagacaagtgggattcagctggcactcttcattactttgttttacaaaaagtggaaaatggttctgaatcgggaggctgtttggcaactataaggaagtaagctatattgctggtcttggtgatttaatttttgctgagagagaggatatgatccaggttgagttaatccataaagtggacttgctcaccaagtccactgtaaggagattcgtaccagagttctctctagagccttgatacatatgtcacttcagggacaaagctaatggcatggtatcctgaacacagctattgcagtttgcaaatggggtacaggaggggttaaattcctcctgagagacaggttataaaggaaagacgggagtgtcggagagacatttctaacctgtgaggaaggcttacacccttggagtaactgtggcctcactcagactgtcccttggaatttctgcgagaagacctgggcctgccccaggaaagggtggctgagttagtggctgataggcagtcgttgtgtcgctgctctgaaggcaccactgaccatgttccagatgcaatgggaaatcaaatgatggagcagctcctcccttgtgggagtttatgctccagttgaggagataagcttgagagtgggaaccattagttcacaggccatgatggagctcagtgttgatggcagaccacaggtgctaagagagcagatatttggaaaatataaacaataggctgccaagaaaaactgcagctgggcccctctcatgaatatccatataaaactgacttcagctggttcttcccatccttccacatccaggctctggttttgggaaaaaaagcaaagacatgtccacagagcgggacttcttcatgaggatgaagtgcacggtcaccaacagaggccgtactgtcaacctcaagtcagccacctggaaggtagggcaacatcaggcctgggttggagtcccaggtgtagggtaacggcggtgcaggggatgcctaaggccctacccccacccccagcactctcggctccatgtctgacccttccacgcctgtctcaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacaggtagggggccatgggtgtgtatgctgtgggcagagatgggtcttacctgtgtgtgtggggagttgtgcctgtattaaaggtgtggaactgaacatagacgtggtattgccgggtgcatgttcgtggacctgtgccactgtttcattgcatcagtgcccctcagaggttcccggtactgtatttggtggtctcccattgacagagcctcagggtccatctgcagagctttcctggtgtgcaactcttctcatcattgtggtgtgaacatatttctccatacgtgtatcaggctcctgaggaaattctcaaggcagtcttctgccccaggagaaagagtctagagacttccatctgtactcctgcttcagaggccagtaaggagcatcagcttctgccctggagactgaccctcttccattactgactgagcctttccctccgccttgttccttcctgcatgcaactccattccggccagtgtccagccattttgaagaagatgaaggtagctgagccagatgctaaccccccagtgccaggcccagtgtctcttaggagacacagtagtgattaagagcatgggcttcaggactagatggcttaggttcaaatttagtaataaatgttcagtgttagctcttattatcacctttattagagttgttgaaagagtgcctaagactgcttaggcatgtcatgccatctcgggttcttagctcatttagaagattgaagcaggtggggaagagactggggttgtcataggagggagtatttagataccctacagctcctaactcccccaccagccctgcctctgggactgtggagcctgatgatgggaggtaggaggaggaagatggggagaacagatgcccggagcaatggccggccccagggagggaaggaaatgcagaagactgggcccagggtaggcctggcttgagtaagcgccactggggcttgctgagcagcaccccccgcatgcgcccttcctggcagagatctccctgcctgacctcagctttctgcagcatctagagccgccatgtgtcccagggtgacagttcctgtggcagctctttgccacccccaactctttgccactcttctctcatcttctagggtttctcctcaggaaaccctcagatctcagtttccccttctccaaaatagagataacactttctaacctgtttcatggggtcactgtaaaatgagataatggctgtgcaagcactttgagaagtccagacaccacaacacatgtgaggcttcttgttattgcttatatcttacttcctgtccttggcctcctccaaagcaaaatcttccactaaactcaaggagctgaaaccacttctgaaggcagttagtggctggggggcaggaagaggaagaatctgacccccagatcagcaagaatctgccttgtcttcctcagctagcaggaaaccatggaaccccaggaaaaaaagctcctgctcagcctcccctaggcctacccacttttctcttatcagctggacatcccaagggcatctggtttcttcatgggagggaccctcctctccaggatggggtttctctcctctgattccagaccggcctggtgttggttggtcgccccttcttagagttggccaccacttgtggcacaatttcagaacttttgtaaaagtatccttgagtcattcctgtccttcagttctgaccacagtagggccaggattcacagcctttggagctagtgggtagttatataagtagaaagaaatgctctaacctcatagggagaaaatgtcatgcatgaagccttccgtcctggaacttcgacacagtcaccatttattgtaattgttagtggtggtggtggtggtggtggtagtggtggtggtggtggtggtggtggtggtggtggtggtggtgataatgatggtggttcaagaagaagattgcacttttagtgacaggcactgcaggaatccatgttataggtaaggttatttatcagatgcagtctttgtattcaggtgaacattctgggcagaagacacagctttgtgtacctcagtagtcttgtgagataacatggacaatcccactgcatagcccctgtgtcactggctttgaggtgaagtggctcaagccgacgtagccatatagcctgggagcatatatagtgctggggatgatgaaagtcagatacgtgcttcaccctggtgaatgaagcacatccgtaacataactccataagcactgggaaaaccctactgtcctagaaaataacttggcatccctacataatagaaaagagattttttttaagcttaagattttgatccttgttacagtgagaagaaatcctctggaaggggtaattcagccttatcctttattcattatcttggtttaaatgagtttcaggtaattttctgaaggtactaacctttggacaaaagaagagggggagaaacacaaggaattggatgtctaaatgtggctggagaggaaatgtacatagaaaggggaaagatgctgtgctgacttcttagtttggctcagggctggtagccagagtagcttctggcttaaaggaagtatcaagcctcgtgatttagggctttgtgactcataatgtagagggtgatattgcttataagttctgcgagacacactgcattttcagcaaaatcttgcctttcaagaaacctaattacatggccccaagtctgaattcagtggtgctggagagctgcatgtagaagcatttaaagacatagaatgctgtgtcacacagaagttgtgtttaaccgattagcagattagttaacaagggcacagacatggcttagacagttgatgaagtgactattttaagtccttaatccctaagtgttatatcttaattgctttgatgaggcctgagatatttttggttttggtagcttgttttgttttcactctttgtggtgggatggggagaagcatatgcacatgcacacatatatacactctccgcctcaattcccctttagagacaaatcctgcaaaaaccaatgcctgtccaagatacctaatggggtgaggggttctccattttaatcaggaaattcactaggtttaatgacatctgagacacacaaggtgctgtgattcccacaaaggggattgttttcctacaagaaaagttagaatctgaagaaaatgtatggcagttagaatccacaaaatcaattttgaagcagtttggtacttgtcttatatatactgagaccacagacacaatcaagcaaaaaaagaaaaagggtcatggagaaaaagatgaaaaccgacaggaaagaagggagagaaaagacaactctaattttacattgaactctcaggtcaaatcagttgaatctgaaacaacctattctgaaacatctgaaatagaataaaggaatacagatggttcaaaatgcatttgtcctcctgttaatgagggatcagagtaccatattaagtcctgcattaattgtttttaaaatagtaaatacttttaaaagtaaatttcataacaattcatgtcggtcacatttatgtacctatggtcaactgctctagacaaggggagcaagttgagtagcagggtaaaagaaaaatatcctgattattaatggaattaatgatctcttcttcatttacgactcaaacataggcaatatactctgtttcccgaaatactgagcaaccagttacgaactgtcatttactgtgcatctgctatgtaactgtgtgccagagaccattacatcaaagtaaaagagatgattcctgatcttcaggagttgagagtttgagacataagccatttaatgaaaccacagtgaatggtacaaaatacaacattccatttacccaaaaggaagacaaaagttgttcccaagtagtttaactttaaaatagggtggttcttaaattcatgtggaggtgccatctagtggtgaaagaggtaactgtgaaggaagccaagccgtcagggagatagaggccaggcctttctaattatcatataatcccactgcgattttgtcagttgtaggagtcttcctgtatcttagaaataaattataaaaccaaattatgtggataggagcagtatcaccaggggaagaggtttcaaaattacagtaaaaatttcaaatcaacaaagagggtcatacaatttttacaggtaaagaactttagggcaaccctgttttgtcattgcatttagggaacataggacatattaatatcaggagttacagttgaataaagatgcctacattccaagttctgtggataaatttatggtgaattgtttttctacaaagaagttgagaataagtaaaaatggtgaaagtgagggaaacgttgaggatcctaaagataatgtcagtaaggagaactataaagagccataagtggtaaaacacacacacaaccttcctatgtatactcttacccctacaggtaccctgtaacactccacagacaggatagaaatggatttcccgttaattacagagctggttgtatagatttcatataaccatgtagtatttgaggaaaacacaaggcttaagtactgtttaaagcaaacaaaatctagatgaaaatatattaaaaccaaccgaaggcactgaaatctgagttagtgaacagcgtacatattagtaaggaaacgcagtgtcaaagcttataagcacatatagaaaccaaaatgagataaatcacggggtgctgaggagaggcgatgggcagagtgtggaaggaaagcaagccgacttgaagtatttattagcagatacattctttggaaaacaaataggtggttacaaagtacttaaaactttcatcctcttaaacagtttaaatactctctcaccatcttgcttacatgattaatttacctagcaaatcctttactcgtgtagggaacaggggtaaaaactgcagccagatcttgcgtgactccaggcggtggcatctgaagtcaggcaccgtggcgctgcaccgcacgtggacgggtgctggcgattacatgcggggaagaagagcgagccttctcaggcctgtgggtggatttctttctgccacttgaggtggcagcactcacgctgtagccaagagaataatttttttgcgagcactctgctgtaggtggtgtattttgaatagagcttctaaacagttttgagagtaaagagcaatgaatcattcattttacattttgaaggcacatctcactctgaagtccagtgctcagagagctgacccacgtatttacttggggtaacaccaacttcagaatttaacaaccccctttaaagctgtattttctatttcctttcatccttcctctgcctccttgtggctgactatctatctgcatctctctcctcactgcatccttggtctgctgttttttgactttattattaaaaagtatcctctgttcttatgtttgaaatctggtgaattaagtccttgtacatttctctcttctcttagaacagccctactgagttgactttgaaatttacgggtgacctcaaactgattttctttttcccagtgagtcaggggtccttaattagaaagaaagaaaaaaaaatagttccctggcccctgatggagagagcagatgaacttgtgttatcacagcccagctcggaaggcttgtctggagcctgggggaaatgagcggggaaggcccttgtgtgccgtaggagcgaccttataaacaagctcggttcattaacctccccactggcgtctacgtgcctgcacgtgggggcgaatgaccatgagctttaagttggggtttcctggctttgtgaagtttgacaactcaaatgttcttcaattgtgtttgggatgtggtgtatttcccagtttttatagtagtctgtttaaaggaatgaagaaagacattaaatatttattttagttgacaagataaatgaaagctgctactgggaagatatctggcagttctgaaatctaggtttgtttttccacttccaaaacatgcccattgtatgcctttgaatggatgatacattaattagataaacattttattatgaggcagattataataaacatctactttgaacattttaatttaaagattctaatctcgaaaggaaatttaattccttcagagagtagaaagacatctttcctagaatgccagtaggctcattttggagggtctctagaaaattctagacctgcccaggaacagaagcagtttatctggcaagtcagtgagcctgcagatggccagaccattgttagcagggcttactcatgcagttctagttcccaggctaagcttgaaagtcatccgacccagcagcgaagccatttgatcgtaggaccagcactgttctgtctccttgttccccccagtctccacctttgccaaggtgtacttgggcgccagccccagggtcaggttgccagataatgtatccattgctaatgagttcagagacctctctgctcagggccaagcgacgggacagatccttctgctctgagactggctggctggcacaaatgagctgctaggatctcactggagaaatctccactgggctgaatcagctgagacctaagcctctcagccctgttgagctgctccttgtttgacaaaggctttaacccccaaattctcacccaagcagagaacttgcctcttctctgcccacttcaaaaccagatgacttacagaatgaagaaaggatggatagactatcatgacaggttctgtgtgtgtgtgtgtgcgcgtgcatgtgtgcgcacacacattgagacagttaatcatattattctagaaaaaaaaagtagatccttagtgcccaggttccttagcagtgctgggataaacaggtgtctgtttgtaccgtaggttcaaagagaaaatcaatctactggtcagctgttgaggtttttactaagcacccgttatagaggaagcaaaaggagaaagtggtccctgagttcaggggttgacagcctaggatgtgaggagacaaatgcataattttctgtaatattgtgcatactccttaggacttcacgagagacgttgtgctggaggaactggagagggctctgtggagaagatgaggctttagctggtcctggaggtgtcagggcttggagaagaggggagaagagaaggcataaagcttctgcagcaagaatgagttttccaggcatagggaactgaggggagaggggtcttccatgacagagggtacataacattttacagatgagttgaaaatcaaattgctcaaaagatggagagtaggttctggggggacttggaagttacgcagcatttactgttggtgtggttggcaaaagtgaaagctgtagatacttaaataagagtatggcaggttgcaagtagtattttagggcaatttggtctgacagatgtatgcaagttgacctgtttggggggtgggtttagagcagagacaggaaatgaggagccactgcttctgctttctgcttctgctttcctctccgtgttattgatcccctacaaggataaattataggactgtatccaggagtcatgccttctgaagtagagttgtaataatgagactgtggcatcacttctaacttgtgataggccaagtaaacaagacagtgaagccattatttaaagtctgtgagagaaccaagattttgagagataatatggaggtattatatagcctaggataggacatgatattgggtaaagcggccaacctggtggttcttaggcagggctttgtttattttagtgattacagcacaaaacaaagggtcctaagaatgttaagtgattcttcatggttctccacatttgccctttcctctgcccacttcccatcaaaaccagataccttacagaatgaagaaagggacactgaaatgacagccagtggtgtcatctgagctgcctattagagtataataaggcacatttctatgactatgatttaatatttcttcctctcagcacctccttgcctccctcgtttccttgaaatgtgaggcacaagtagaaagtgtccgagggcacctgaggtcacaggcaggacctgcagaaaagtgaaggtttaagcacagacgggttctgcctgcctggactccctctcacgtgctggttgacacagagacaaaggtggctctacctggggccacataattttcatgtttcatttatactgccttctactagaatgagcttgatgtagcaactggaggccccagttttcattcttgctctgtccctggacacctgtgtaggcatcgagcaaattgtctgcccgtcctggatgtctactccctcatctgcaaaaacttggggtgagccccttccagtggttcttggagaacagacatatgtgtgtaccggggtggtggggagagggagtcctcagaactggtgcttttctctcctcccaaacatggcttcaggaagggcaggaacaacaggggtttggttaaacctgcaactgtagattgagcacagtgttcttttgcttggatacatggtacaacaagaaagtctggattgtgttcatctgcatgtgtgtgtttgatttgccttctggggttagctcctgcccacatgctgtgctaagttaatatggtctttcttccttacatgctgcctttttaaaaactcagaatcacagaactgattggttaccaccctgaggagctgcttggccgctcagcctatgaattctaccatgcgctagactccgagaacatgaccaagagtcaccagaactgtgagttccaggagtgccccttgtggcttccttgtgtctgtggtatgtggccttgagtggggtgtgactggtgagacagaagaccaggtcacttcctccacagagctgctgtcttgtgtggcagacaagacttatgccctcaagatggttagaaaaccaaggctgccaccagcctatagactccttcgtgcaaattagaaaaaggacacttcctccagggagatgcacccgtgccaaggtgcacagctgaggcagtggagggtgggttgagtctcagtcccccataccacctccacggagtgcctgtgtgcagtcagtggtttgcacaccttgtggaacagcactgtagagagtaaaataattcaacatatcatcaacttgggtgcatgctatagattcaagtacatacattcacagaagaggagggcagggggagttgaggaaaggacacttgagttggaccttgaaggatcggggaggcttaggctgaacagaggggaaagtattacgggtccaacttaacacatatgttgaggtaggccacagttctcagagagcttgcttgctggatcaagggagctttagaaaaggctgtccaggcaacccagggatggcgtatggaaactctgctttgcagtttgaaagaagcctgagttatgtaaggactctggaagagggctgccacatagaactttctgcagtggaaatgttcttgaaatgtggctagagaaaccgaggaactgaactttatacaatgtagttttaattaatttaaatgtaaatatccacacttggcttgtagctaccatattggacagagaagttctagagtgtatccttggccatgttcccaattcaggcttcctataggcaggtgatccaggaccgttcccttgaatccatgcgactcatcactgtgcaagggctctgggcctataaccctgtacttggcccactgggggtgatataaattggtagaattgattcctgccctaagtgaccttatttctgaggaaaaaagaggaccgtgggctccttgggaacaaggggctcatatctttaacctcagtatctagcatagcgtctggtacagaacaggcactaaatgcactatataaaccgatgggcaagactgtatttggaaaagaatgcttcaaaacgagtgcccacagtggtgcagacagtggtgctgagaggattatgggaggattaaaaacgggtaaagtaagtctgagaagattcccagtggccctgctggcaatggagaaaacggaagggcagccatttgtccatggctcctaaatccacccatctaccccaaggctaagacagccaagttcagtgcagccagcagagtcacaaccccgcaagctgtatgtgaacatggttaacccactcttaaggagtgagatctttcttttcttttattggttcctctgcctcttcctcatggcttttgggtttgatttgacagtacaacagggcccattatgatatctcagagaagtttctcactgtgctctctggcaaaacacacacgcgcacacacagacacacacacacaaacaacctagattcagccccactcaggaacccagagatggggtaggagtggaggtactcttttatgcctgtgaatgtgaccccaccttagcctgcccaagctttgaaattgtaacatctggttccagccttccctttgggattccttcatgcttcctggtccctgaggggttcctgttttcaaaggcaggtgacagaatcatccaggcactgggacttagcggcccaggctctggcccagccgacccactgattccctagggcctggatttctggaccttcctgactttagatgtaaaactggggaaaagtctagccttccttccaagctaagggtgaagccaaggcaagagacaaatgtaaaaatttctgggaattcttggaggacagtattaccttttatcttgtaggatgggaaagcagaagaagctactgtcaaaggaaaaaaaaattgtgacttctgactaggcatatagaaaggattttccctcttgttcttcttagaacatcttcaatccataaaaagggctaggataaaaatggtttatgttttctgctgactctagggaaaataaggtgctttttactgaatccgtgtatttacttattaggcacactgaaaggtaactcacagcccaaatagaaatcacaggctctctctccccttgatggagccaagtaaagctgccctgagctcagaaacccatagctagcaaagggacaaacccatagctagccaagggaaatctgcttgggttggaaattggattaatgacagttatgacacgagcttgccccttgcccccgacccctgtctctcattcgtccttgaggttttgcaagtcaagtttcactacagactgacacacatgctctagactaactggaggctcaggtttgagacaggtccagattcacacactgggatcccccatttacacacatgtatgtcttagcctgtaaaggtttaccgttgaaatgcctggagaagctcaactagatttagatcattgaaagctgtaatttccaaatggattaataatttatacactgttactctgggcgtgaggttaggggtcagtctccctttgttatatgaggatattatgtgcttttaggctttttatggcctttaatcttattttcctatctattaagtagcaggcccttcaccaaggctggcattaatgaccagatgattagaaagctggcgttaattatattctactgacagagcaggcccttgcctgcaattgttagaaatgcacttaaaacctttgcttgctgcactgtttgatcaaaaagagtaagagccctgaatttggtttgcattaaggaccatctaaataagttaaatacaggcacttgaaattgtgcaagaatcattttactgcagcagaggagcctcagtggcacagataaagggagagcagagaggacaaaagttatttccttggttgagtccatgatggtttaggacagcggcaacagcaagtttggtcttcccagtgatttgtggacccaggtaataaagagaccattgtattaggagccaccagacatgttgtgtagctcagactctgtcactattgtcttgtaagctgtgaagcaaatcataaccctctggccttagtttcctcatgttaaaagaaaatacttatcctccctgtggcacagggttttgtttaaaagattagacaagatgatacaaccattttggaaataatttggcagcttcttataaacatatactttacaggtaagccagcaattgcactcctagctgcacccacgagaaatgaaaatatgtccatacaaagatttatacacaaatgtttatagcagctttattcataataatcaaaaactgaaaacaactcaaacatccatcaacaggcagatggataaacaaattatggtatgtccatgcaacggaatacaactcactgatgaaaaggaataaaccacaaatgcctgcaacgccatgatgaatctcaaaacatgctgagtgtagagaagccagacacaagagtagatactcctatacaattccacttacatggaaatctagaaaagacaattcgaatatatagtggcaaaaagcagaagagtggttgcctggaaccagggtgggaatgaagattaactgcccagaggcataaaaaatggggtggtgggggcggtgatggaaaagtgctatgccttcactgtacctttgtcaaaacttgttgaactgtatacttcaaatgggtgtgtgttttattgaaggtaaatttgaccccaataacatttatttttaaaaattaagagcaaacagaaaaagcttagactaggaatctttaatttgaactataattctgtctactgtttccactgaggtggtctttcagcaaatgactcagtagttttaagcctcagtttcttcagctgtaaagtgggaataacaacaggcaccccatggtgttgcctatgaaatgcagtgatgatgacctaatccttagtgagcgccctatgtgccaggcactgtgctgaatgctttgcagaaacgaattcatcttatcagatagttctgaacactgcaaagcactatacaaatgtaagttacaggaattcttgcactttgcaggtgcttgttaaattgtgaagaagaaagcaaaacataagtgtaaaggattaccaaactgcactagtatgaagagagccatgttcctcagctgtacagggctgatgaatggggaggaggcctgcgagcctaccaggagaaccggggagactctctgtctaccgagagcctggatatcctcccgagtggcccctcatgagactatctaccaacgtgtaacagactgtctgtgacaggccatgggcataatatgtattagtatctctaagaaagaggtggcttttcctatacaaaatttgttggtgacagttggtcaacacttatgtacctgataagccatgtgggtacagtcgatcctcagtacaaatggcagtggtatgctgggtagctaatgatgacagttattaccgttactactattattatcaatatcctgttttgcagaggaggaaaccaaaaccaagaaggattgttcctttccccaaatcccaagctagcaagatttcccgatcctccctccatgccctttcctaacgtctctgtgatttgggagcttctgagctggagttctgtaaattcccaaggaatgggcagttcagaaaaataccaaaaattctaacattattagactttaaagagatttattgattccttttgaatggcagcagatggaacattctggactggggaaggacagtctgtgatgtgaaacccttccccaaggtagacaacaaaagcgttttttaaatgaacacttagtagaacaatctagaagaggaaaaacctcataagtaggaagcctagctgggcggttgggagaaggagtataagtgatttattacagcttatgaagagactgtgtgtgggctgccagggtcccagctctttctcagccccaactgagaaagggtggggtggtttgcctctgcctttgctgtgggtcacaaaccttcagtggcccaaaaggtggcaagcctgacagatgacctggagaaatcaaggatatcaatgttttaaatgcttttattcataagcagggtattggtggtgggtctgctgaaaaaaaaaaacaaaaaaaaacaaaaaaaactgccctgaggtcaggctttctccaggctgcttagaagtccccccacctggagtgcttgacgggatggcgctccttacccagtgtgaaggggcttcttctcattgaaccccatgaagaaagtaaggcaggttctggacttggttctgcttatagctgagctggtctgtgagcctgacttgtccagggattggtgatgggccactgcaaagctgcatagtgagcgggtccctccctcagtagacagccttgggcaagtcatttcacctcttctcacctctttttcctatatttaaaatgaagagttggctgaggtgatccctaagctccctcccaggtcactctccctggtcctcactgtcgtggcgccctgttctgtctgttcccctgcagattagactgccctcccatgcgatctgctgagcctgtggtgcacacccctgccccacctccctaagctcagctctgtttctcctcccctagtgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgaggtaagcatgtgagggctggcgggccttggtgcagggtatgtgggggtgcccaagcttcccagactcaggatgacaggcctaggagatgccaggcctctcagcgccctgggcaccacctcagggaggtcttgcagggctaaccctagtgactgagaggacttcctgtggatgtcttggaacagtgggatactgggttgggatttttttttctgcgctttccctggcatctgtcatttatgccatgcatctgacccaggtggggaggcagatagcacacaatagtcaatattttctgaatggggaaaaaggaaagagaatcgcttatgcttttgggaaaaaaaaaagatgtcatgccttcactctatagtacctggaaagaaagctagaggaagtcatttctagttgtttctacagacagagaaaaacaaaagcatcaggcctcatatataccaccccactcaagtgcaataatatttaataaaacaggatccgaaacagacatacattcagaggatacctctgttgtcactacctccatggctcacacacttctattgtatggttctttataagacgccaatgcctggagtcctacccattttttgtcggagagcttagctatgagggtttccatgcatctaggggagcagaatttttctagaaaatgtggaaagtctgaatggctctttcccccccattagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcggtgggtgcttcttagctaagccaggcccctggaaccccgttggggctgggaagagttcttactataacaggcctccctggctgcagctttttcttaaccagagctaccccagccccccaagtcttgttaatcacctgttagaggccaggccctgctgagcacaaaagaacaccacacgctcctgccctgataagaccatcccatatccgacctcaccaagtgctgtacgaggaggggttaagagaggacacccccctgagggtcgattctccaccatgggtggtgagagtctgagatgagagggaggggagaggtgagggatctgctccgaggccacttggacactgtcaaagagaaggggcagattcctaccagggtctggaaggacagatggcttgttcaggcagagggccaagttggagtaatgttgggaaggatcattccaaaaacacagagaacatattgaggcctgggattaagccctcaaacccacgacttcattaaagtgtctgcctgtccctggggatgtaagtcactggggaccccggcagggttttcagccctcggctgctccaatcctggaaacacccttgaagccccatgctccccagttcgcaacccgctgccaccctctcctggccttgctgtggctgccggaagagtggtgctcaccctggactgtgtcagccccttttagatgggttctacagcggccacgtgaggattgcagctaaagagaatctgaaacgcagcgggcccttggccagtaggtctcgcggcttgttttgtggcagtactgaggcaaatagctcaatagcccaattctcctctccctctcataccttccttgtctacccttccggatctgttcctcagggaagagtggctcctaatatatttagtctctgaaaattaaatgtcccaggagactgttccgtttaaagggagtctctacgttgactcatagccagagtcaaagacccatgtgttccagctgagccccagggtgttgggggggcctagccccaggcatgccttccagaccctcttagggccttctctgcggtttttgggcctcctctgccttggggtgagcccgatggttgtgggtgttcacctcccaggcccttgtctccacagggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacggtgagcagccctcttatggcgaggacacagagagggctccgtatgtatgactgctgccagatggctgaagggacatttgggacaggtactgtccttctcaggttatcacagagccccctagagtggccgtgacacttacctaccaggtatcagagctgttttcttccttttagtgttcatcccccaactccattgaaataagctccttgaagggctttgagcccccagctcagtccccatacagggcagtaacatcccgtatgtggcacagagctgcacagtttgcacagccctgctggccacagcctgtatcctgtttggtcctcaagacaggacaacctgtgaagcgacagtagcctcattttatgatgaggagactggaatttagagaggttgatgaattgacctaattcatacagcttgttaattagcagcccctctacaaatagttgtgtggtggaatggaattgaacctttgggtccaggaaggtatttcttcttccatgctggacttctggggagaccagtgccatatctttgactctgtccccctccttcctggcccctagcccaatagccctgaagactattacacatctttggataacgacctgaagattgaagtgattgagaagctcttcgccatggacacagaggccaaggaccaatgcagtacccaggtagatggctgtggagatcaggctagggtgtgtgcctgctgtctggtggacagcaaaggctcacatccattcttgtagcctcatccctttgttgtaaagagcagtggagacgtttggccaaggcccaggtcccctaaagaggtaggggtacagggtaatggagcctgtggtcaccccctcctcccactgtcaaatccagctcttccagcatatgtgtctcctacttagatagctttcttagcacacatgaaaaccgaaatgataccactgcacctttctttaaacaggccctacatttaacaagcatagccagatgtataaaacatgtataaacataggggacaattaatccctttataaacacattcatcttgtgattttaaaaaaataatcatttttatatgaaatgcactttaaaataaataacatctgtttgacaatttttcatttacataaaacttttcaggaacacatttattacataaggccaatgttcttgcaaaaactatgtaaacaaggataaggtagagggaggggtacgtgttttacaaaaccccagggaaaaccattaatcccccatttgtcttagtcttgagttcaaccagatttctgccttgccacttagtttgtttcttgatcctacttggcacaaatcccagctactctgcaaaacatgcccaattttagcttttctatcaccctccctcctcagcactcctgtagtatatatcatgtggcacttaatcacagctatctgcttctgctccttaaagattgcttagtattgcagtcattagtcagctgacacccactgagggtgtcagtctctgaagttagaaactgttttccgcatctgcttgtattcccctgcttgtatcatgcgtccgtcatgatactgccaccctaagggatgatctgagtatctgctgattggaaccaaagtctctgtccctggggtctggctgttaggctgttactctgcgagagtccacagatggacctgggcacttactgcttgcttaggcccgtgccagcttacaggagggagaagaggacaaaaaaaagccacagtgtgcaccacaggcctaagcattgtaggacaaggataaccaccacaggctggagtaggcagggctgactctgtggaagaggggctgcctcggcttcaagagagaaggcgggctccggacaggtgggatggggagaggagaacatttctcaatgtgcagggtgaagaggggataaacatgggggaaggctggtacatgatacaaggtcgtgtacatgacacagccaagtctgaggttttcctgataggccctcgggagccagtggaggcgtttgagcagcactgtgaaacagtgcttgagatgaatggctctgcaggagctgagttggaatagtgtttgtgaggtcgtaccaacccccttgcctctttgccggtgctgtctcccctcagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtaagtggcagatactcagctgtaccagcagggccgaaccgagaggcacccactagtaagatagctggacccccagggaggcccctgcccctctccccagccatctgataccccatttagcccttctctgagctcagactttggggaatcacctcaagccatgtgaggcctagtgtaggatgggtttttatctgggctgccactgagggcaggcaaagaagtggcttgttgagagccctgtacctcagtgtctcccttcggaccaccaccagagtgcctttcgtatctcggttcatcatctgagccacacagaaaattgagtgatgattttccctggttgaaaacagcaaaaagatacccctgcctccccttgccttttggctgcccccgggtcctcgccactgcagcctctcccagctgtgcctaggctccagaaatgccttcccatctccccagcatgctcatttcaccagctgcgagctcactgggctaaggcacaggggttggtacatgacctgccactcccaggggccgctggtacttgccctttatagagcagccaaactagttttcagtgggagcaaaaggcagaggagagacatgggcagaagaaaccctcctaaggactaacattgcccagccaggcagccatcccccagaccaggaggcttgagcccttcagcatcttatagctgaggaaggagacagagctcgagctcggcctgcaggtgcacagcctgcctctgagactctgccttttgggtctttgagtcatcacaggcatcagcattgggactggaagggcccctaagatgagaaggcactgagtggcatgtggctccagactccctcatagcctgctctctcgggcttggcaggtctgcaaagggttttggggctcgaggcccagacgtgctgagtccggccatggtagccctctccaacaagctgaagctgaagcgacagctggagtatgaagagcaagccttccaggacctgagcggggtgagtcatccccactggccacaggggcctctccatagcccttagggaacccagggctgctgagaggggtggggatgtggcccttccaagccagcatagcccttagggaacccagggctgctgagaggggtggggatgtggcccttccaagccagcaagtgccagccctgttccaggcccacccaacccacccagtctggggacctggttctctggccatttcccctttccatctgcccttcttactcccagggggacccacctggtggcagcacctcacatttgatgtggaaacggatgaagaacctcaggggtgggagctgccctttgatgccggacaagccactgagcgcaaatgtacccaatggtgagcagcggccacaggcctgggcctcctgggggttctggtggaaggactggggctcgggagcccatcctggttcttccattcaccacaggccgtacctgcctctctgagccttgttagaatggggcgatgtcctctgtctctcccgcagtcccacacacccaacttttccatctccactctgacttagatgatgccatcagagggtcctgaaggttggctgtagttctggtgactctgagcaccttttataaaggaaagggatgctagggcttcctggcctctcccctccctcaggccaatgctaccgtcactctctgactttggtctttcagataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggtgggtgtgcccaggatctgtcacccccatcccaggattcgatgccaggggaagcccacgtctactttttttccagcgtctgcacagtgccaggcacagggaggtgcttgacttgaagtcacctatacagggctcaggtctccttggatttagggaacctcctcacaagttccttgtgacatcagtgatcaggccccccagtgggtgggtctgagacacagctaaaaaactcaaactcaggctagaatactgaaggaaagaatgcagaccactaccgactgcccaaagaggactgaacactgaacactgggttggcgacccccagaacactgtaccactgttgacaggagcactttcagaagaaagagcaggcggccacagtggtgagggcctgttgaagaagagaagagaaagttcagagagagagagttgggaagcggtctgggcagaggcaggggatctcccgtctatgcaaggatgagcttgctgcgtggagaagggagtgctccttccctggggctttagggagaaccctcccatgatcaggtgccatccagggctctttccaccctgagaatcccggagccttgccccttcctcagttcttcatgtggatgtgttttggggtgtcactctgagttcaggcaggtgctgagaacatgccaaaacttccttcaggtagaacagcctggaaagctctggtaggcccaccccactggacttggttcaactgcaggcaccaatgcctgccttcaaccctgggccaccttcatcttgacagtatcttgtgaaacatatatgtcttcatgaggtttgtttggcctgaaaataattcgtggtttatggaaaaacataccaggcccctgttctaaaaggcaatttcctcagcaatagagtttggggaaggttatagttctgtgcttcagagtccaggctgtagaaacaccagacagccctggcttaaattctggctctgctgttgagttcaggggctggtatatatttatgtgcagtaagaggtagccagcactattcttcctgttatgtgaagcccacgaattaccttgaatattgaaatcaagggaaaatcatattcttttcaaaagagttgaatcatatcaaactcttttctgaccatgaataagagaagttagcaagggatggtgagcaggtatccattgatactgtccacaggagcagtcaagctggggaggcaggcatggaccccagcaaggatctgagctaggaggtgcaggaggcaatggccactggaacgaggctctgcagataagggaaggtgggtgggcatctcccatcggaggggcagaatgcagggcttccaggctctctgctgccacctaagcctttcctccttgggatgggggcctgtgtgtgtgctgcgagtgtcccccctgccactccctggtctgcctcctcggcaagagaatagcacagaggcaagaagaaaggactgctgagggtggtgaccagaaactggattttcagactgttgaatcttgaggcagtctgtgtttgcatctgtatgtatgtgtgtgttctgcatgttctgtgtatgtgagcataggtgccaggtggttcagcctttcctccctgctgccaggaggcatgggggtcagcaaccccaggctcttcctgaagcttccacatacctgtgctgcagcccgcacctcacgctttcctctttcttgggtctcagcaccccacctgaggcagtggttctggaggcagacacgttccccgggcatgcagcaggccgtgggacagacaccactgaaggagcagagtgaaattagggctgctctattggtatcccccagtcacaaagaagtagacacttttccaaatgttcgatttaggcctttaagttatggtaccaacccttctttcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatcct

SEQ ID NO: 35699 - DNA, 89273 bp, Homo sapiens; identical to SEQ ID NO: 35698

SEQ ID NO: 35700 - DNA, 3175 bp, Homo sapiens
gctgttcgcctgcgtcgctccgggagctgccgacggacggagcgcccccgcccccgcccggccgcccggtgagtgggcccgggggccgggggcgtccgcgcccgggctaggggcgctgcgtgcaaagggggcgcgtcgcctggagcgcgcgccggaccggccgggggtccccggcgatgatggcgctccccgcgcgcgctgcggaccccgctgaccttggccgcgtcccggggggcgccggggggcccggcggcgggggcctgagtggtacgcgggagcccgggaaccccggcgtgccggtcccctctgaccccgcgtctccccgcagcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggtacgcgacccctcggggccggggtcccggccccccctccccccgcgcagccgcagggtcctcagcagcgcgctcgggcccggcagtgacgtcactgtccccgtcccgcgccccctcccccaggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcccgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccaggtgccagggacggggcaggcccagaccccagggccccagcagggatgtgggtgccccagcatcagtccccccgggggatttccggcactggggagtctcagggcctgtaggggtttcaggcaggccttctccctcataccctcttctccgtctgcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccccaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctg

SEQ ID NO: 35701 - DNA, 7171 bp, Homo sapiens
gctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgaggtgcggaggggccgggtgtgggctgcgaagggccgggtgtccggcctcggaggccgcctggctggcgtctgcgccctctcggagagggccggcaccttgggcagcatctctcttaacagtttagtgtgtagttgagaagatgagtgcagagggtagagtctacttgttcaaggtcacgccgtggagcatgaggggctgtgccagggggaggacccagggcggtcgccccgcaaccctttgcgctccccacgacaccacttcgcagttttccctttctagtctgaacatttaatatgtcggggacaggccgggcgtggtggctcacgcctgtaatcccagcatgtggggaggccgaggcgggtggatcacttgcggtcaggatgttcgagaccagccttatcaacgtggtgaaaccccgtctctattgaaaatacaaaattagccggccgtggtggcgcacgcctgtaatcccagctactcgggaggctgaagcaggagaatcgcttgaacccgggaggcggaggttgcaatgagccgagatcgcgccattgcactccagcctgggcaacaagagcgaaactctgtccagaaaaaaaaaataataataataagtcgtggacagtttgccctaatggaaccatctatggcggccaggtctttttcaggttcccttagcgccagaagcggttggtacagtctggtgctcctggaggacgccctgtgccttaaagcagctgtaaccaaggcctctcaagaggcggctacggatcctagcggatcgacacgccacacagcctcgtccccagcagtaggtggaggccctgggggtgcctaacaagcctcagaacaccaagaaatccgcgtggttgtgcaggtctttgctgttcagtagcattccacaaatagtgtgtccaaaacgcatctgtagatgtaacttgagtgaatgaatgaatgattcgagttgctccttctacccaataaagtagataagattttatctttctcatctttccaaggcccctttatagttgggaaaagtgagtatttggaaagatgacttgtccaaggtcatatctgattcctagtccagtgtcctcgccctagtcctgggtgaagtaacaggtaggtgtgaggaactggtaggcttttggctaaggacgctgggcaaaggtggaagtggctgtgagataatgcttgcctatccaggcttgctcccgccccagtctgctctttgtggtgttggaatgctaataaggaagcattccctgctgccggcacggccaagaatccctggactgaagaggtgcttccgctgatgataggggcagatcctcctttgctcccttctaacctctggacaaagaagcagccattcacaagggtcattgatgaggcacaggtatttggcctcagattgctctcctagcttcttgccttcactgtaccatccttctcaaatgaagcaaaacgcaggacagtctggtaaatgtaaacctctgcggggtggggtgggcaggggagtgattgtttgagatggcctggtgtgacctcatcttttaggagaggctgggaaatggaaagtgctggtaaaggaggccattttctttagctctgtggcaggaagaactgtatcagtccgtggtagtttcccaatgactagtccacgttaaaccatgttgtctctgtttgagactaatcaaatagttaaacttgtaatctctgtaaaataacagatcctatttcagttttaaaataaatgttagcattaaattaaaaatttaacagtatagaaaattaaaagatttaacggtttaaaaggtcgaatacatatatataaataattcctcagtgctttaagtgatagggtttgtacagccttgaatctgatttctggagaaagctagtgagaactgagtttccccatgcatccttactgctaagagagggatggcctgggggaggatggagtccacaccacactgtccactcctacccctgtgagtgcccctggctatgttttagtttgatgggcaagttaaaggaagaggctttattctctgattcttcaggttctctgttaagaatcctaagcggaacttcttttctccttgaggacctatttatgtgtccaaagtgagccgcctcattgcaagtggaaataattgcagtgaaacagcctgaagctccccagctgaggcttgcactgtgggtattcacttccgggtgtctcagccttttgttggggagccattcctttccttacagttaggaaggcgacagtgagtgagtctactaggacttgtctggcggctcagtgatgagacctgttttttctcttgtgggtggtgtgagttttcctggtgattagttctccccagccctcactcagtaagaatgagttcttcttggcctcattctcatttgaatgactggcagaaaaattcacttcatgttttattaattactgttgctaaccccaatatgaagcaatatccaggcaagtttgtgctgaatttctaagagggccttctagcctaatggagaaaaacaggaatgttttcttggtcatcaaggaaagggctatctccccattatggtgggagggtgaataatctttaatgaaacaaaatcaataagactgattcctttttttttttttttttttttttttgcgtgcgacagagtctcgctctatcgcccagactggagtgcagtggcgcgatctcagctcactgcaagctccgcctcccggattcacgccattctcctgcctcagcctcctgagtagctgggactacaggcgcccgccaccatgcccggctaatttttttgtatttttagtagagacggggtttcaccatgttagccacgatggtctcaatctcctgaccttgtgatctgcccacctcggcctcccaaagtgctgggattacagacgtgagccaccgtgccgggccaagactgatttcttggaacctattcattgggccaacataactcttgccacaataactactgtgtatggaagacagattcattgatgaatcagatagtgcacagcactgggtctttctttagtgagtggcttctcctaaacttggtttaacatttaagtaggtatactctgagggtacttggtattaggctggaactttgtgactacagtagagagaaaccatggattagagtttgtgatgtgatttccatactccacagtgaatacaatttcatacaatggacaaatacaattgcaaacaaatacaaaaacaaaataaaatttcatacaacaaactgaagttttatcagtacaggaagagctcttcctgtgtcctgattgggatttaaatcctaattttcttacttcagagttctagtaaaatatcttttataagtgacaattcccagtctgggcaacatggtgaaaccttgtctctactaaaaatacaaaaattagctggatatggtggcgtgcgcctgtatcctcagcttacttgggaggctgaggagaagaattgcttgaacccgggaggcggaggttgcagtgagccgagaccacgccactgcactccagcctgggtgacagtgagactccgtctcaaaaaaaaaaaaaaaaaaagaaaagaaaaagtgacagttctaactgaaatgcaaacatcaggatccttgggaattaggaaaatggggatagctagagatggtggtgaaaagttggattctggagtcccacagcatgggttttaatctaggttttaacccacataatagctgtgaccttggatagagtgcaaggataaacaaaacagttggccaaatattttcttttttggccaaatattgtcatttggactacttgtacaggagattgatactgaagaacattttggctcagagtagacctggttagcttatcactttgaacttctgatttccagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggtatggacaaacagaggtttggtcactccgcccaggatcaggggcttttagtagtgtctgcctaatctcactgaacttacaattcatgataaaatagttaattgtaatccttccttctccagtgaatgaccttcacttactagaagatatggttgatagtttactatctccttttttgtgtttccatagtcagattttataaaaccctgtgaatgtgaatgggccaaaatcgatacatcatgaagtcttttaacagatgtaactcttaataagtggtgaacttggattctttattgcttaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtatgtatgttttttcagaggcgccctcaaggaaggataaagcagaactgccacaaatcagggacttggtaaaaaggagtctagggaagggctggacatgttaacagctttagagatggtctagattgacttctagtgaaaaaacaccctcaacccttgtttctcaaaatgtgatctgcagaatagtgacagctggaccccctgggagcttgttatacatgcagaacctcaggtctcactccagacctgtttcagaatcggcatctattccccaggtgatttggatacacattaaagattgagaagctcacctctagattggtattgtcaaatgaaactgctagtgaaaatcctccttagcttgccaagcacagtggctcatgcctgtaattgcaacattttgggaggccaaggcaggaggaccacttgaggccaggagtttgagacagcctgggcaacatagtaagactgcatctctacaaaattttaaaaggccaagcacagtggttcatgcctgtactatcagcaccttgggaggccaggagttcaaaaccagcctgagcaacaaagcaagaccttgtctgtacaaaagaaaaatgaaaaattagcttgatgtggtgatgctcatctgtagtcccagctactcaggaggctgaggcgggagatcgcttgagcccagcagtttgaggttatagtgaggtatgattgtgccactacattctagcctgggtgagagagtaagaccttgtctcttaaaaaaaaaaaaaaggaaaacaaatatatataaaagaaaaaattctccttagtcacaaccaggcacaactttacacatgaatctcaatttgcatcttcatccccgagggcctagaggcccacgtgtgctgatttttggttggatgggctgtacagggtatttgagatgtgtagtcttgcttcactgtgggcttctagatcccactttggtagagatatctggccatataccttgctgtagtttgttggtggtctatcttgtataccttttcttgcttttcagtttaatggctgagaaataagtatggtgggggccattccctgggttcagaactactataaagatcagaaagggtgtcttattttaatttctgtcaaagtcctttatcacctggaggacaaagtaaacctggaggggtgatgtggatttatgtcttgtgtggctgatgatggtggatgttttcaggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaat

SEQ ID NO: 35702 - DNA, 25632 bp, Homo sapiens
cccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggtgaggctgggggagtgtgcggaggggatggccaggaaggagatgccagtgatggcaagtttgaagttggaggcggtggccgctccgggtcctggggtccgcgtccaccccgctggcctctctccgccctctccccaagcctaggctcgtagcagcaggggtccccgcgggcgctggagaccccgctgcggcctgccccttgcacgcggagcgcggggccgtgcccgggcgaccttgcttcgtggccggccgagggctgggcttgctcctcttgccctggaccctcgcctgcaggagcggccagaactggagggtcctcggctgcaggaggaggcgctggacacggctgcgctccgagcgcgccgcagccgggctgtttcttttggccacctccggctccgctccacccccagcccctcgcgctcagggctgacgtgtctttagcttccacgccgggagtccgtcttcattcatttgccaaaacccttgttttctacacatctaagccatcagagtgtcttgttcaatggtcatctgccttgttcacgccctgcttgacccgtatgtgttactaggaggcttgatttcagaaaaactaccccatcgtcacccccgttatccgcccctgctgccaagcagactgaagaatccctgtgggatgtctcccttctgccttcttcctcttcttgtctttccatggaacaattttttgtttgtggaaacatcgtattgtgctgaaaaaatgtggcctacttcgagtgtttttaatacatagatttattctttcaacaattaacccagcaattaagtgtgaaaataacttagcagaatataaaaatatggcaacttgacttcctgcacaggttttgtcgtgaacttcgactttctaatttgtaaagtgaaataattagtctgactaagcatccctttcattctgtaagtttaagcaagctgtgtgtcttaacggtagtgacaggtattcacgagttgttttgcgatgaaaagtgaagtgactggcttctgtttaatggctagaaaaccaagtgggagaattaaacaactgttaatgagttaatctgcaggtttaacaagattttttactttaggagtcgtttgctggtactctttaagctttttaaaagaaaacttgacaaatgtagttttagttttagaactatttataactattttcaagttataaaaactttcaagaagcatgaattcattatctaaactgaattaatatcttgtaaacattttttgtgagaaacggtttttgtgtttggtttttccagttgaatgaagactgttagacttcatggggacaaaattgttattggttaacattaaaataataaaattgtttaatatttatgaaaggcctttatattccaaagtgctcaaatttaaccacgactttaaattactatatcagacatggtatttttcttactggtttttgaaaaggacttgtaagttatgaatgcactattttaggctttgttcagcaggcagtgaaatctctttagttcataatgcatggttcagtgttctttaatattttgcaataaatcttagcagccagtgagaacttaaagacatggaaaagactgcaaatgcatggtccttaactgtttctcctgggtgaaaacacgcttcccttcccatgttttttatccacagaattgccacatcatcattttttctgagagatgttggaagacactagaactttgaaattctttttatggtcttgcctgaaatagatataatgtgacttacttagagtactattgtctataaaactgtgattcaccttttttttgcattatacctgtactttgtaacactaagtttgagaaaaaatatcttaaaacatgtttgaagccacatgcaaaaataattggattctttctttgctatcaaacctgaagctaccaatacagtttttactaaacaatgtttttcatgcaagccagtttttaccatggatatgattacagatatttgttccttggcttacaaactatccagttctaagagtttcagctgtagtcacctctgataacagtgtttcctacatagaacattagaacttaagaatgctttatttttttatttttatttttttgagacggtgtcttgctgtgtcgcccaggctggagtgcagtggtacaatcttggctcactgcaacttctgcctcctgggttcaagcgattctcctgcctcagcctctggagtagctggaaccacaggtgtgtgccaccacacccagctaatttttgcattttcagtagaggcggggtttctctgtattggccaggctggtcttgaactcctggcctcaagtaattcaccctcctcagccttctaaagtgctgggattacaggcgtgagccaccgcgccggccaagaatgctgttttcttttaaacgtgggggttgtttagtttgctttgtatggttaatgacagggattacatttagaagtttcttatctttgcaaaaaattattttccttaatttgcttaacaaagttgcttgaagttctttgtgcttcaaggcatctttagtttgtgccattcatttttccatctgttgggcactttttgaagttaaaccacatttcccattaaaaataacatggaaggcagggaacagtggttcacgcctctagtcctagctacccaggaagctgaggtggaaggatcacttgggcccaggagtttgaggctgcagtgagctatgactgcacaactgtactcccaacctaggcatcagagcaagaccctgactcttaaaaaaaaaaaaaaaaaattgatatgcagttgttaagactactagtaaactaaaatataaatattcttcggtgcattgtaattggcatcattcaggtgaactgggagattctgttagtccaagggaagttttttttgcctatacctgatgttaaaaaaagaaattagtatttcagagtaaagggtaactgctttttctgtattttatcattaggcttgttagcagtggcacaagatcttacagaggatgaagaaacagtagaagattccataattgaggatgaagatgatgaagccgaggtagaagaagatgaacccacagatttggttagtgttacatactatttaatatatgtaaaatgtatgtaattgtattcatctgttctcatgctgctaataaagacatacccaagactgggtaatttataaaggaaaaaggtttcattgacccacagttcagcatgactggggaggcctcaggaaacttaccatcatggcagaaattgaagcaaacatgtccttcttcacaaggtgacagcaaggagaagtgcagagcaaagggtggggaaagccccttataaaaaccatcagatcttgtgagaactcactttcacgagaacagcatggaggtaaccgtccccgtgattcatttacctcccaccaggttcctcccacgatgtgcagattatgggaactacacttcaagatgagatttggttggggacacagcaaaaccgttatcaatagtacatctagaatttatccttacttatttatttttagagacagagacttgctctgttccccaggctggagtgcagtggcacgagcatagctcactgcagcctcgaactcctgggctcaagtgatcctcttgcctcagcctcctgagtagctaggactaccgtcatgccccaacaagcccggctaatttttgtaatttttttttgtagagacagggtcttgctatgttgcccaggctagtctaaaacttctgggctcaagtgatgatcctcatgcctcggactctgaaggcactgggattatgggcatgagccaccacacctggcctagagcttatccttatacaaaaatttaaaatcccaacttttagaggtttgttaatgtgatcaaagtgaattgaagttgggagaataggcaccagtcattgagaacagagcataagtattttctggaacagggaaggagacatgaaatagttaacaattcaggatcgtggtgacatgagtctagaagggtaacaacatagtagaaatagcactggacctcatggtttcatagatttggaatacctgctgcttccttttctgacttatctctgtgggtctcagtttctttttcgcttgcttgcttttactctgtttttattctttttgcttgcttgttgtatttctgaatccttatgtgccaggcactgttcttggtgctgggtgggcaaaccagatattttctctgctctttcagacttttttttggggcagttatatgtgttttaatggcagggggtgagaagcagacaacaaacagtatgtaaaatatatctggtgaagaataagggggttagagaagatctcttaaaagttgttcagctctgaaatgtttactatgtaatacaacagtaagaatattgggctggaattgggatcattgcagcatgcatctagttaattttatttcctctctggaacgactataatccatcctacacagctttttttctttctattttcgtgtcatacttgaacctggaacctctcatgattccagattttgtcatttccttcaaaattaaaccactagttccctattttcttatttcagtatcaaaatatttattcttatatatagatttctgcttcttttttgacttactttcatttttatggaatatgtcttccaactaagcaaatctgttgctattttattggtgtttttgagttatcatttttatgcttctgcacctactgttttatctggataggatgtccctagtaatttgtgaactctcctaatttccccctctttaggaactccttactgattatctgtgagtcaagcctttcatatgtatgtatacacatacctttagggtttatgttaagactccacgtcttcaacccagcctgcattaagtgaatagctttaactagattaatacatttctgctgcattgttgttaataaatatttgactagttgtggtaagataacttagagtgatggttggaagggaatccatctaggaatttaggattaaagatggtatttggggcactgaaatttgggcatgtactgaaatttattgatgaattatatcgttgttaccaattatatgaaattacttgtgctctctggcactagaatgtacttattgtggaggaagagggtagaagagagatgctgaacgccatgaggcacgcctgtaatcccagcactttgggaggccaggacaggaggatcacttgagtccaggagtttgagaccgcctggccaaaatagtgtgacaccatctctactaaaaaaattagctgagtctggtggcttgcgcctgtaatcctaactgttgaggcaggaggatcacttgagcccagaagttcagtgttacagtgagctatgagtgtgtcactgcactccagcctgggtgatagagtcagaccctgtctctaaaaaaaattaaataaataagtagagggtagggagtagagaagggaactgttagatccttgatagccttgtgtcgttgaccagaacttttccatatcttaatttctcctgtcttgagaaccattagaggaaaaagaacaactctgattatccactttctaccctggccaattagtacagaagtgttagtaccctctgctttgttacttatctcaaatcagaaaataattaaggtagattgaaatagaaaggcaggaaaagtattaccttccattgtactagaccacaccagcaggggtaggcttgtgtgtagactgtctaagaaagatgggccctcaaaggcaaggctgctacagaagtcacctccagaactgaatgagctagaaagttcacctactgctgctgttcccaagatttatcaccctatactcagctgccaaggcatcaagggattgggagatatggaaggatcctttgccactgggccagtgtcctggagtcaagtgaaggaaaagggggtttttcataagatctaagatatcaacagctggtttagacacaggttattggtttagaatttttgaggacaaaccttttttttttttttaagtcaccttgggctttcccccacccccccaccacccagacagagtctcgctctgtcgcccaggctggagtgcagtggcgtggatctccgctcactgcaagctccacctcccgggttcacgccagtctcctgcctcagtctcccgagtagctgggattataggcgcccgccaccacacccggctaattttttgtatttttagtagagacggggtttcaccatgttagccaggatggtctcgatctcctgacctcgtgatccgcccgcctcggcctcccgaagtgctgggattacaggcatgagccactgcacctggcctagtcaccttgggcttttctaacccattgattattcttttactctataaaactgggtcgcaatggaacttgccatcattcctgaaaggtttttttgtcctccccatagaaatgagagaggtttttgttttaatttttattaaaacaagagctgtagtagtaataacactaactaacttaaaaaaaattatttagccaggtgcagtggctcacgcctgtactcccagcactttgggaggctgaggcgggtggatcacgaggtcaggagatcaagaccatcctggctaacatggtgaaaccctgtctctactaaaaatacaaaaaaatctgccgggtgtggtggtgggcacctgtagtcccagctgcttgggaggctgaggcaggagaatggcgtgaacctgggaggcagagcttacagtgagctgagatcgtgcctgggcactatactccactacactccagcctgggcaacagagcgagactccgtctcaaaaaaaaaatagttatttaaaatagatgatatattcaaatggctcagaacttacaaggtacagaatatatgatgaaaagtttcccttgtgtgccttccagccatgaagtcatctccctgtaggcaagcagtaccaccagtttctatactctcctctggagattgtttgcaatagctgaaatattctggagttttaccgggtagcagatactaagcgttatacatcttacatgctgaatagctgtaagataaatgagttacttagttttccacaatcagtgttccaaacatttgccatgtttaaatccctaaatgagttttcagtcttggcagcaacattgccttcagtgtcagaaagtgaagaaggccatcaagcatgaactctatcagattttgtattttctacttccaaatatattattcacccatcgttctgcattttcttcttaataatgagttgtccttgttctcttctaaggctaacccttccacctgtgttcatctcttcctgcggaattttgttacattattctttccttttgtaacgtcaggcattaatcctcctcagtgatttgattctgttaagccacacatctgcttatactgttcatccacatttgctgcacctacttatctttaccaagaccggtggcttcttgaaagagaaacagggacagcttttctcttctgctcacttcacatttattctctatcatggtctggtcccatatatctagtaaaactagtattgctaaggtcaccagcaacctaattgcctaattccttgttttccgttgttatcctgttgtagctcttttccagctcttcacaggatagtttcatctgaatgctccataagtacttcacattttatatgtccaaatcttttgccatgtgtcctactccataaactctttattgttttgatatggctccagtgattcaagctgttgtcttgttacttcttccgtttgtttttattccaaaacccattaatcagatatcagggatttctcttgctgaaatataccctgttcctgtctatccctgtcatttatggtttcagcctctctgtctctgttctcttttcctacttatgggtctcttttctcagaatagaaacttactcttactaaatgaatgaaatcattaaggatacttaaaatataacttacaacacagtttcacagtcattgaacaagtgtgtttgagtgcactctctcttaagtgcatgagctggatggtggaggattttaaaattatgagataatctttgctcttgacaagttttatctattggaggaaggagtattttatgtaagtgaaaagttaaatgccaataaacaatggcatcctgaagcatctcaatttattaagagtctggatacttcaaaggtgtgactgtctctaatccatattgatgcctggagaaatgatgctgcactgtgtttaaagttttaaataaaatttgttcacattttaaaaaaatttgttgagatacagtttatgtatcataaaattcatctgttttaaacatacacttagtaaatttaccaagttctgcaacataaattcagttttaggacgtttctatcaacccaggaagatctctggtcacactcttttttttttccttcaaaattatgtgactgatcctcacaggaaaattttgttaattagaatggaaatctctgtaggctgttaacaaggtacttgagagcagaggtgggcataatgtggttgcaagccacatctagcgatccccattcatttacgtattgtctgaggctgctttcacacagtagccccagagttgagttgaatagttgcaagagaggctttatggtctgcaaggccatatctgctatttggccatttacagaaaaagtttaccaagctctgttctagaaccttggagttcacaatatggtctgaataccagcagctttggcattttctgggtgcttgttagaaagagaatgataggctttgccctagacctgaattagatctgcaacatccccaaagaattggtaggcacattactgttcaagaggcactgctccaaaagttctgttttaattaatgaggtatgatgaaattcttattgctaatcccagcaaagctgtagagaagcaatatttcttcctaacataaagtgaagtctttatttcttttttttgagtcggagtcttgcattggggcattctcagctcatacaacctctacctcccggattcaagcgattctcctgccttagccttccgagtagctgggattacaggcatgtgccaccacacctggctaatttttgtatttttagtagagaacggggtttcgccatgttggccaggctggtctcgagctcctgacttcaggtgatctgcctgcctcggccaagtgctgagattataagtgtgagccaccgtgcccggccaaatctttatttttaaataatgatttttttttctcccatagtaatctcctcttaattgttctttttcttaggtagaagataaagaggaagaagatgtgtctggtgaacctgaagcttcaccgagtgcagatacaactatactgtttgtaaaaggagaaggtaatacagaagtattagttttaattcagatgtaggcattttaaaacgatgagcttgttcatatatatctgaatacccatatctgtaaagtaatattgttggcatttaaagggaatacgtaggtgatatagacacaataaaaaataaaccaaggggaaaaaataaaataaatactacctagtttaactagaaattgactgtccttttcaaagattttgtttttgagacagggtctggctctgtcacccaggctggagagcagtggccccctctcgactcactgcaaccttcacctcccaggtttaatcgattttcctgcctcagcctcctgagaaagatgatgttttaaaacttctttaaactgccacagcaaagtaactttgtcttttttttttttttttttttttttttaagatgtagtctcgctctgtcacccaggctggagtgcagtggtatgatctcggctcactgcaacctccgaggcctcccggtttcaagcgattctcctgcctcagcctccctagtggctgggattacaggcacgtgccaccacgcctggctaattttttgtatttttaatagacagggtttcaccatgttggtcgggctggtctcgaactcctgacctcgtgatctgtccgtctcggtcttccaaagtgctggaattacaggcatgagccaccgcgtctggccctttgtcacattttgagtgttaaccattaatgagatacttaatttttccaatatggtctaggttagagcctaggattttttgtttgtttgttttttgagatggagtcttgctctgttgccaggctgcagtgcagtggtgtgatctcggctcactgcaacctctgcctcccaggttcaagtgattctcctgactcagcctcctgagtagccaagactacaggcacgctccatcacgcccagctaatttttgtatttttagtagggatggggtttcaccatgttggccaggatggtctcaatctccacctcatgatccgcccgcctctgcctcctgaagtactgggattacaggtgtgagccaccacacccggccagtgcctaggttttattaaaagaaaataattatggctgataatttattgagggctatattctcaatacttggcatgtattatttagttctgacaaacccactgagcgtagtcattgtcgaactgaagtttggagaagaaactggtcagggctcccagttcataaatagattggagaacacaggatccagacctagatctgttggccccatagcctgtgctgtactcagtgaaactcagctttgtagactactgtataattattgaagacttaatattgaaagttatgaattttcttggtcttcttacattttctgttttattctcatgtgcttttgaactttatgcctgtaggaagtataattttattatgctttttttcttccatttttgtagctacatccttgggtcttaaccttcaaatttgcattttgattaattgcttaacgtggattgggattgcctgattaatttttacgttctaacagatgctagttttcagatgaaactcttggactttatcttttcttcattcttctatttacctgcacagataacactaagctggaggtgaaggtgacttcaccaacacacgtaaccctgctgcttgattatttcactgccaaaaatacgcaactcttttttaccacatgatttggatgtgatctggtctgaaattgagacgcttattgaatgcttatgtgggagtgctagcgtacagacaaaagggtttcagcctatacagcaacttgaaccaatttctcgttagtaggtgactggagtgctctattggaagggattctgacaccaaagtccacaggaaagggtgccagaatccattagtaatgcctttttaaatattttgtgctctttccatgtgttctaatttttttgtctctattttgtttctcagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacgtaagatcctctaaaccttctttttgtttaagttagagatggatgggggcggtgacgttgtttaatagaatatatctgttcattcagttgcctgttttgtggttgaacctgtgatagccaccagggaagcaaagataaattgcacgtttcttcttcaagtctaatccagtgggggaggcatatgaaaacaggcactagaacatgctgataagtgatgcatactagagataaggggaataaggtgctattgtgtgggagtggaagtgaaaatggagatgtaagtaaagctatgagccggatcttaatgggaaaaggagcagtaagacacacaatggagtctacagcttattcagatgttaagatctgttgctgggtacagtggctcacacctgtaatctcagcactttgggaagctgaggtgggtggatcacctgaggtcgggagttcgagaccagcctggccaacctggtgaaaccctgtctctactaaaaatacaaaaattagctgggcatggtggcagtcgcctgtaatcccagctactcgggaggctgaggcaggagaatcacttgaacctgggaggcggaggttgcagtgagctgagatcgcaccattgtactccagcctgggccacagagtgagactccatctcaaaaaaagaataaaagatctgtcaaataatttgttttgtacctccttttgttgcttgcattttgcccattttactacttctgtttgtaaatttaaagactgtctataattgttttcccatcattttatgtactcatagataaaatagaaccatatattttcaatgtagtttcagcagcaaggtttatcatttactttttgatttaggagaaccaaatgtcctaatataagctctgatgccttatgatttttaataatgtatactatatatcagtcatcaatgactgaatgagagaaccctagtagaaataggtcctctaaatgagagcacatctaaaccattcctctgtcaaaaagttttcagacgaggaaattttattttctcttggaagctaattcaaccttttcattaccctggtgttaacatgtttaccttgtgtctgagttaaatttctagtgctgcaatcaagttttcttttttctgattacttagtagagaaaaggaagtattttcatcctgtcctcaaaataataacttacagttattacttaactctatagttaagtagcttaaagaattactgattttagcttgtttttgagtagaataaaatttaatccaacaggtatatatgaagttttagttccttcttttaaattcacctgtaccactttttttttaatctgtgtattattcctgaaattatcaatagaggaatgcaaattgaaggatcttgaagtaaaacttacataattacagtttagcaataagtgacagttttgacaatgtactacctttgtgaagaatagctgtgtattgccccagtgagtctaatgcatttgaaaactgaaattgtgaactgataaaattatttcaagaccacaacataaaaatattttcatacctaaagtgaccatcccatttattatgaagaaattggtttccagcccactgtctttttttttttttttgaggtgggagtttcgctcttgttgctcaggctggagtgatctcggctcatcacaacctctgccttctgggcacaagtgattctcctgcctcagccacctgagtagctgtgattacaggcatgcgcaaccatacccggctaattttgtatttttagtagagagggggtttctccatgttggccaggctggtcttgaactcctgatctcaggtgatctgcctcggttggcctgccaaagtgctgagattacaggtgtgagccaccgcacccggcaccactgtcattttagaacatgaatttaacttttgttccgatctagttcttaaaatgacctgcttctgcagctgccgctgtactcttccttccttgttttgaaggattgcaaacaacagaaggtaaagcttgttggcgtaagaatgctgtgagctttgtttctttctgcacgttttatctcatttttattttactctctgggtcctcacaccaccacccctaccccagaagaaaattcaggggacaactttggcaaagtcggtgactttttttaaaggggtgtggatctcgctatgtttgctaggctggactcacaagtcctgggttcaagcagtcctcctgcctcagcccccgagtacctgggaccacaggcatacgccatctcacctggcccagagactttatttcatgtgagaaaataacaatgttgagtccctgccacagaatattgcagttacatatgaatttgttgagtcttctaagtgatgggaaggctatattcaatctgttagagtaactgttttaagtaatgttacatgttttacttcctttattgcatttagatttttctgattattttattttcttaaacagggcaatgtattccaagatgcagtcttcaatcaaacagttacagttattgaaagagaggatgggttagatggagaaacgtaagtgaaagttgtagtatgtagatcttgattttgctcgtaaagtaagactggaaagcttgctctgtttcagcattgttttagatgttgacgatggaatgaactgtatagatttggtgaaatccttacgatattcattcatacttcagatgattcttataactataaaagtcaaattaggaaagatagttgaaactgatggaagaatctctttaaaagttagtattggctttctgtccttcctctcatctaaattttctacctcatgcttataaactgttcaccagcctaaactaagtctcgtgcctctgaaattactattgaaaacataagttagaagattttatcttgaaaaatgtaagtgttctttctgaatgatgaatctttttttactctaaacttatatataattcacttaaggtaatttttaaattggattgtgcaaaataatgtaatattccagggagatgaaagctaatgcaattattttataaaccaagcttttgaatagagcataaattgtaattctattttcaatcatagagttttttttaattgactaattgctcttaaaggtaatttataaaacttaactacctggatttaagttgaatacaaagcattttattccttttcgccacaagttatttggaaagcttctattatgtgttataattatagttgtaattagacgtggtatttcctctgaattaaagacagttcatattttctccttttgtaccagaatctttatgtatatgttccttgctggtcttgggcttctggttattgttggccttcatcaactcctagaatctagaaaggtaattatggatgaacacctcttacagccgtgtttcaaaagttgttaagtactaagttaagcagtctagttcttcggcctcatactgtcactgtgggtttgtatacgtagaactttgttgtacctttttaaaataaaacctgaagccttagatatgtaaattgattcatttaaacttactttctttttttttctggagacagagtcttactttgtcacccaaggctggagtgtgcagtggtgtgatcttagctcattgtggcctcaacctcctgggctcaagtgatcctctcaactcagcctcccggttagctgggaccataggtgtatgccaccacaccccgctaattttaaaattttttgtagaggcagggttttgccatatgcccaggctggtctcaaactcctgaactcgagcaatctgcccaccttggcctcccaaagtgttgggattacaggtgtgagccactgcacctggcctcatttagactttcatacacacatacaattatttattgtcctttgtgccctccagagtgatatttacctttggattggtattgtagctctaaatgctagaatttttattccctaaactcagattttattgttctgtttactttactttttaatgggtatgctattttatctgcaagtaacctagcttttatattttctttaatattcttttttttttttttttttttgagacagtctggctctttcatccaggatggagtgcagtggcacaatcttgcttactgcaacctccgccttcggggctcaagtcatcctcccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcaccctcctcctttccttccctcactcaccctcctcctttccttccctcactcaccctcctcctttccttccctccagcctacaaaaacaaaacctatactatttctctcagtgggaaaatataaacaattttatcaaatatgttaatataattcattagaccctaaacagttgctaatcattttggcgattatttattaagcctttagtcaggcagtcaaatctatattaaaattaacaatgaatgttattaataagctctttctctttaaaagagaaatactttgtgtttaaatgttaatttctaaaactcgctttgcctcattgtcataatggttggaatttttgctgtaaatttgtatattaggtataactgcatctccatttttcttctatttaaatgaaactatttttaagttatctctccatgtacttaggttctaacttacggattatataattaatactgtttcttatgtagataaactgaggtttgttggtttcttgggtttttttttaaagcaaggctaaatgagtcatttttactttctagcagttttgctgtaaatactctagggagaaagtttgaagttcttaaattgaggtggttagcttaatgagattttatggtttcgttttgttttgtctgtgccaactgtttaattgtatttagcttacgatgcagaaactgcctgcatgtaacatatcagcagttatcctgaattttgttgaatatagaaataaatttattctttgattacaatttgattcctaaagggaaataaagtcattgtataaatagatactcttatgtggtccaccagtggtacataacatgaacctttatagcaaggggaaaggtctttaaagcctgaaaataaatgtgatgaagatttattctttatcatcagtactagacatgattttctccttccctttaataaagtatttgagtagaagtatgttctaggaagactagaagagaatataacttgtttaccaagatatttaaattaagtaatttgataggtgttttaaaaattagagtaaacagctggtcatgatagtatgtgcctatagtcccagctacttgggaggctcaggcaggaggattgcttgagcccaggagttccaggcagcctgggcaacatagcaagacctcaactcttttttaaaaaatattaagtaaatggtgtaacggaactcctttaaaatatgtctttatgttcttttagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgctagagaattgggggctctcaaatagcacgtaaatattttacgtcaagtttaatgagtaatggaacaatttttcttactacattttattagaaaaactacccagtataacttgaaagaataaacctaaaatattacccgacaatttattttacagatacatttcagttttattacatattcagttaaaatactaacctttataaaagaatatagaaatgtttcttcaattgtaggacattttaaaaatgtttattataaaaccaatgcagcctcattataaaaaattaaatagtacagaagtgaaaaaaataagtcaattcctgacttcattaatcctatttatttatttatttatttatttatttgagatggaatcttgctctgtcgcccaggctggagtgcagtggcatggtcttggctcactgctacctccgcctcctgggttcgagtgattctcctgcctcagcttcccaagtagctgggattacaggcacgtgccaccacgcccggctaattttttttgtatttttagtagagacagggtttcaccatgttggcctggctggcttcgacctcctgacctcaagtgatccgctagcctcggcctcccaaagtcctgggattacaggcgtgagccaccacgcccggccctatttttcataaatggtattatgtttatattttccattaatttctatatatctataagcatatacgcctattgtttttatgtgagtatttagttcagattgcatcatgctgtctacaacttcagttttcataccttggatgtctctttgtagtaactacataaatatttactaaactgtttttttacaactagacaatattattttatatatatatgtatgtcatgatagattaaacctgttctgtattggaaggatattggttacttttattttttcactcctacagatgatactgtaatgaatattcttatatataaatttataggataacttcttaaaggtagagtaactaggtctaagattaaatacactgaatttttatggaagggaccccatttccctcctaaaaggggaaaaaaaggtagtgccaatttatgttctcaaccatgcacaatattgcctatttaatctgtcggtatgatataaaatgagtgtcttactgtttcatttgcatttctttaagaatgaggttcagctcctttatacatattcatagttgacccttgaaagacacaggtttgaactgcttgggtttcactttatatacagattttttcaatataattgaccctcggtatattggtgggttccacatctgcaaccaaaagcagataaaaaatacaatatttggccaggcgtggtggttcacacctgtaatcccagcactttgggaggctgaggcaggaggatcgcctgagcccaggagtttgagactagccttggcaacatagtgagaccccatctctacaaagaatgaaaaaaaaatacatgtgttgacgtgcgcctaggctgaggtgggaggattgcttgagcctggtaggtccgtgattgctccatgatggtgccactgcactccagcctgggtgacagtgagactctgtctcaaaagaaaaggtgggggtggggaggaaaggaaatcattgaggagctaagctctgaggacgcagaggcataagaatgatataatggacttttgggactcggggaagggtaggaggggggtgagggataaaagactacacatgggttatcgtatacacagcttgggtgatggatgcgccagagtctcagaagtcaccactaaagaacttacccatgtagccaaacaccatctgtccctcaaaactagtgaaataatagtaaaataaaatctattaaaaaaaaaaaaaggaaatcacagtttttgcaggataccaaacctaagtacagggaaggctttttgtatccaccggttcctcagtgctgacagcggaacttcagtatgcctggatttgggtggggttgccgtgggggagtagtcctggaactaatttcctgcagataatagagatgactgtattggctagggtttcttttcctgtgaattggctgttcaggtccttttccatttttaaattgttttctctactgctttctgtgagctagctgtctctttctgtgagctagctgtcatattgcagtatagcagttgctttatgaaaggtgggttcaaagtaacaagagcacaggaggaggtcagcactagacccgagtcttgaaaggttgggtgagaaggagtctttaaggttttatgagctatgctaacaacttttgactcctaggtcaaagagccactttaaaggagaggaattacaattgtgttttaaaaattatggtaagctgggcatggtggtgtgcacatgtagtctcagctactggaaatgttaaggcaggaggatcgcttgagcccagaagttcgaatccagcctcggccacatagcaagtctcccatctctaagagaaaaaaaagaaaagaaaggaaaaattaggatcactttgtggaggactgcaaaggagctgctggaagcagggttaccagttccgcgatttcagtaaagcacagaagtcactggggcctaagcagaggcagtggtgataggagtaaaagggagtagaaggatgtttcacaggtggagtagatggggttttttatgactggatgtgttagtgagggaggaatgaaagagcattctgaacttaggcaactgggtgaaagctgatcccattaatgtcccataatctaggaaagagaagcatggaaggatgaggagagatgtgtttggattagctatgctgagtgtgaaaaacctttgggactcccagataaggatgtccaggaaacatttgaaagttctgtttcagagcacaagtgaatcaagatttggaaacattgggacatatagcatcagtggtagctcaagtcatgggagctacacatctgtttttttttcttttgagacaggatctcactctgtcacccaggctggagtgcagttacgtgatcatggctcactgcatcctcgacctcctgggctcaatccgcccacctcagcctcccaaataactgggactacagacgcacaccaccatgcccagctgaatttttatatttgttgtagggagggggtttcaccatgttgcccaggctggtcttgaacttacgggctcaagtgatctgtctacctcagccgcccaaagtgctgggattataggtgtgagccaccatgcccagctcacatctgcatataacagtgatgctcacacagatggctgttaaatcctagagtactttttgaatcctcaaaagactatgttcagcatactgcttatttgaaaaagttttatttagagattggttgtctgtaagggcagtagttcctagtctaacctttttgaaaatctgataaaagttgtagactttcttcatcagaaacatttgtctgtactcacagctcagttttaggtaagttgaagagcccctgaaaccatctattagtaacctacttaatgaagtagtgagagcagttttctgggtttttttcacacttgaaaagtgagggcagttttcctgtgatatgtaggctctgtcttaatattttagcccttaactttttttatttttctgagacacggagtcttgctctgttgcccaggctgcagtgcagtggtgtgatctcggctcactgcaacctccggcccctcggttcaagtgattctcctgcctcagccttccaagtagctgagatcacaggcgtgtactgccacacctggctaatttttatagtttagtagagatgggatttcatcatgttggccaggctgggctggtcttgaactcctgacctcaaatgatctgcctgcctcagcctcccaaagtgctgggattacaggcatgagccactgtgcctggccttagcccttaatcttaaggagatttctttgaaaaatgtgtagtctttaaatattcttggctgggccaggtgtgatagtgtgtgcctgtaatcccagctacttgggaggctgaggcacgaaaatcgcttaaacccaggaggtggagagcggagatcgtggcactgcactccagcctgggcgacagagtgagactctgtctcaaaaaaaataaatattcttgataaacatttactcattttctaggcatggtgatctcataatttggggggtgagagatcttttgaacagattttttttttccattttatgaaatgcttacagataagccccatgctttggtgaaaatcactttctagcccttcactttttttaactggaaaaaatgatttttatttctaacttattctacagtatacaaacataccaaaaaaaaacaatacgaaatcaatgaatgcaaaatcaatcaaaatcaatacaaaaacaattatacaagtaatttctaacttattctaaaatcttcctaatatgtaaagtaccccccagaaagtaagacaagacaataatagagggaaggtacatacatccagcctttcactggttgaggaaacttataaatgacacctcttaccaaatggaagtagaaaaacccaccacaaatgtattttctgttaaatagaccctactgagaatctaacaaacatatgggagatacagcttgtgtgcatagaattgttttagcattgaaatactgatttcctttattctgctgcttattccaggtaaatttatgaaattgaaaaattatgcaaactgcatgactgcatttgtaaatacaaaatcagcagtttttaagcgtttacttatgcatgtataaacttggttaagttatagaattgaagattttgcatggtgtcttcagcagtacaataaccaagtttaaatctcttacccaccctaattgcaaaacactttcattttaattggggttacctcttgaaggattatgttaaagattgtttttaaaacctagagctagataggaggcattcattattagatggtgttcacccatgtgtgtgtgtaacttagtggtaaagttgaaggtaaatactttttaacatgtcttttgaattcaatatacttataataggcaagcttaaaactttctcttttcttccagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcg

SEQ ID NO: 35703 - DNA, 8970 bp, Homo sapiens
gccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtgaggggcggcggggcctgcggaggcgtcggaacccggggccccgcgggccgcccttccgccgcgcccggagcccgcggccgggcacgggtcgaggcggccgcctttgcagcctcgcggccgtcccgccgggggccggtggcatcgccgtcccggaccgggctgcgtcgtttaaggcaccgaggccggccatgcgctcggcaggggggcggcctaggtgcgcgggccgaggccccaggctccccagccggcagcgcccgggcccgggcagggggtcgggattgcagtgcccaccccggcgcgcgcggggcggcggagaggggcggggcgaggcgaccgccgcgggcacccgagccgcagcccggggccaggccgggcctcccacgccacgccgcccccgacctcgcggccccagcggagctgccagccgcgggccgcctcgttggtggcggtgccagggctcgcccacccgggcggtggaacacgggccaggacggggagcgactccccacagtgctttcctggcccttcggcctttgtgcgacgcaggcgcgacagggttccggcgccctcccggggtcccctgccgacgccgggacccagcgaggtccccactcgccgcgcggcgccccctccctcggccccggggaggccgggcgcggggcatgccgggagctgtagtcccctcccccctccgccgcctcccggagccagggctgcggggtgtggggcggggaggaggcgctctgctgtggagcctgccgccgagtgaccgctcgactacaaatagcctggggagctgcggggagggcatcttgacctgggccaggacaacctgccttgggtcggagcaggttccagggagaatcagagatggtgaattcccagcctgcgtcttatgccttctccccatccgctgctgcgtcctcatcctggcttcccaccgctgagctccgcgtgtgcggcacccacctcagggggcctttacctggtccagaagtgcatctgtctttgcaccagattattggggacctcaagcgtctgctccagcggctctcctgtggcatgtgacttccccttctcgctccagcgtcctgccgttttctacgagattgttattccaggaaagctcatttcccctttgatccatcattccttcccttttacctttctactcctcaaagcccctgtctattcttcgtggaagctttcccttggagggtaaccacacacctaccaggtggcgctaaagaagcctttacgtttctgggaaatactccagccctggactaactaccagaggaatactcagctcccaagtcagagtttaaggtcccatggagagcctccgggttcacctataacctggtttcttccttacctgttttgaactgtttctattctcttcactcatactcctctcgctctcctgtctccaaaccagaccttagtctgacgaccactggcatgaaggaagaaggaggaagtgtggcataaatacttccccctttgccgattataataataatctattattcaaccttttactggtctaatcttccaacaactgtaggagatagggattatcatcactgctttacaaataaagtgtggagaattttaaaaacttaccatacagcggaaacttgaactcagatctctcagccttttgtctcctttttcaaaccaagtcttgctgcacctcaagaaagacaagaaggttagttgactcataagccaagctgctagtaactgaatctggagggacaagtaggcagaggaggatgaacacagagaagtccctttatgttccctctggaggcttgcaggcagtgctggtgcccctttctgccccaaaccctggggtactcactttctcccccttcctcccaggtcatcaagagagagggcacaggtacagagatgcccatgattggggaccgagtctttgtccactacactggctggctattagatggcacaaagtttgactccagtctggatcgcaaggacaaattctcctttgacctgggaaaaggtaggcgtggtcagtgggctggtaggataggttcgaggtggacacaagctgtcacaagcagaaaccattttctcaggaccaagctcagggaggaatggtttatcacagtctgttaactctttcggtcactcttttttttttttttctaccgttctgtaactatattgatctctgtctccccttctcctcatcacctcccaacaccttactcccccttcaaaggtggactgtcttgcatcttaaactcttttgttcagggtcacgtgatcttttacagttcttagacctggtagcacttaatacaaccaggtacctcaccttctggtcccatttctaaaggatgtccagcttccccatgagtgtggtgcagtaactcttcaggagcactgtttgagcccagaatcagaaccctgctaaggcggtcctgtttgcttctgtacctgcaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtgagtgtttggtcactgagatccaggctaagagccaggccttatctcagcccaatgcctggctgccctccagcccttcctgcttcttggagacaatgtagccaaggctgagggtctggccttatgggaggagaaatgcagagggctctgctgctgctagtaatggaagtaatagaagcttcgggtgggaagaggcaggcacaagcccctctccagactcaaagcatggtcagggttaaggcatctttatctccagagcggtacccagaagaatactgaaaggagtcgggatgtcagaaactatgtcccgttataaatggcagtacagaatattggtgctctagagaccagaagagggagcagtagctcccctgtgggtcaagggctgagaaaaggcttcactgaggagatagaacttgacattgttcaatctgaaaatggttgagccaatccgtgggcccttgaatactgagaaactgctgagagatgttgggtaatcatttctaatacctaccaggttgggcttatcaggtagtgtgaattaggattatctgggacgcgtcctgatatgtccgtgttagtagagcaggtagcaaatagattgctctcctcagcttaactgaaatctatgtagtctgcccacctctaccaaagttgagattagggcagctcccaagaactgaaaaaaagtgccactctacccaactccttgtgactgcccttgtggtcagatccggcctggcagttagtagggactctctcggatgagaaagattgtgtttcactgcccatgagttagcatgggaaggaattgtgtcacatcttgtcccacaggtggagttgtttgagtttaagggagaagatctgacggaagaggaagatggcggaatcattcgcagaatacagactcgcggtgaaggctatgctaagcccaatgagggtgctatcgtggagggtgagacagtacagtctgggctttcaattctcattctgatatttaggccttgtgtggctttgggcaagacacttccgttctccgagcctatcttcttgtccataaaatgaggggttggaccatattctcttcatatcactccagatttgagaacacaggagaatcttgggatgatgggggtgatgcagggaggctgatggcatccttcctcagtcacctgccctcttacaactctggtacactgcctctctttcatgccagttgcactggaagggtactacaaggacaagctctttgaccagcgggagctccgctttgagattggcgagggggagaacctggatctgccttatggtctggagagggccattcagcgcatggagaaaggagaacattccatcgtgtacctcaagcccaggtgaggggtgggcacttcgtagggtaggcaggcaggcaaaccaagatcaaagatataaaatgaattgtagaaccagctgtttgtatcctttttaactctggccacaccaaacatacaccattatgatatcctcagtgtacttagaagtatggcccaattgtctacatctccttggatctaagcccagtcttttcagtcatagttgctacagattctctcctctgccatcaagattttcctctcccattaattcatttcagtcattactgaaacagctactacatgccaggcactgctgaaaattcctatagggcttcagagactaatagaacattgtttctgccttctaattctagctcattgtttagtgaggtgctatttaaattagtaatcacactgctgcctggctgtaagttattagaagggtatgaaggatgctgagggaccatctgacagtgtgaagaggccagggaagatttgccaaacatttgaaccaagtctcaagggatgggaaggtactttccaggaaatggacaggaagccttttcagcctggagcaggttaagtgttgccaagatgatacatagtgtttttcacccctccagctatgcttttggcagtgttgggaaggaaaagttccaaatcccaccaaatgctgagctgaaatatgaattacacctcaagagttttgaaaaggtaagtttgctcagggtcttcccatctaaagtcaagttccaccctgtacgtgactctggggtagctgacaactttgtttctctcctggggtgtggcaggccaaggagtcttgggagatgaattcagaagagaagctggaacagagcaccatagtgaaagagcggggcactgtgtacttcaaggtgagccaacagtcattgtcctaaggacactcccaggaagagttgctctgagcctccccttcccttggtgactgagatcattttctgccaagaagtggacaggttggcacctgccatcttcacttcatatatgtgagcttgctggccttgccagtgggaagggtgggagcaggaacctcttgtggccatgtgtcactgatgtctgcagggtataagagcctagtaccactgaaactgtgccaggtgcctgagcctctctcccattccaggaaggtaaatacaagcaagctttactacagtataagaagatcgtgtcttggctggaatatgagtctagtttttccaatgaggaagcacagaaagcacaggcccttcgactggcctctcacctcaacctggccatgtgtcatctgaaactacaggccttctctgctgccattgaaagctgtaacaaggtgaggccccctcagaggtcatggaagcagcattcacaggcagagttgggtgagctgccagcatgtctgaaacttccccttggtgactagggcagggatagcagggtggatcagtgggagctctgaggttacagaccaaaggcacggatgcaagtattcatagcaagaaccttagctttggtgggaagcagttggcaagaaggaggaggacacggaatgggaagaatcacataaagagttttcttccaccttggttcttagcctctccgcttacctacttgctttattctaaagtgaatgttaatgtctgaagtctttatttcatccaaagacctgctgtcttccctctctgcctgttggattaaatgaggtccctggattgttccatttaatgcctcaggccttgttcttcctggggtgcagccagccacttgcattcctcctcatcctcctgaggggtacctttggaacccagtctaggccagatgagctacaagccctgagctcccacaatgtggcttcctctctgcattctttaggccctagaactggacagcaacaacgagaagggcctcttccgccggggagaggcccacctggccgtgaatgactttgaactggcacgggctgatttccagaaggtcctgcagctctaccccaacaacaaagccgccaagacccagctggctgtgtgccagcagcggatccgaaggcagcttgcccgggagaagaagctctatgccaatatgtttgagaggctggctgaggaggagaacaaggtgaggattggggtggggaacagttggaatagcatccctccacttaacctggctactgtgggctctttgtgcctttggttgtctgtgccaatcccggaaaccagaagttgccttttccctggagcattaaggagcacgtgttcctgctgttggggccagtgttctgtgatcagtgcgggaaacctacccacaagccccagaagttgggttggttgccctgagtgtaattcccgatttatgttttcttgtgggccaggcgccgtggctcacacctgcaatcccagcactttgcagagccaaagtgggaggatcacttgaacccagtaggtagagacctcagtgacttaggatggcaccactgcaccccagcctgagtgacaaaatgaaaccccatctcaaaaaaagaaaagcgagatgctttttgtgtgtgattaaataaataatacacttagttaaattcaaactgtaccaaagtatacagtcaagtctgcctcccccaccagaagcagctgccccttcagggtcttggatggtccagtgtattgcgtcaaggcacaggcagacgttcctgttgcttcctccctttcccctaacacaggcaacgtgctccacctatgatttggcgcatactatgcttttttcacgtaatagtagctggaggcttattttacatccgtatttaaagaacttttacattctttcttaggcttacattgtattccattgtatggatatggcttgtcttagtcaatcagtccctttttagtcttccagtggttttattttttttctttttctgagacagagtttcgttcttgttgcccaggctggagtgcaatggcatgatcttggctcactgcaaactccacctcctgggttcaagcgattctcctgcctcggcctcccgagtagctgggattacaggcgcccgccaccacacccggctaatttttgtatttttagtacagacgaagtttcatcatgttgaccaggctctcgaactcctgactttagtgatctgcccacccctgcctcccaaagtggtgggattacaggtgtgagccaccacacccagccagtcttaaacagtgttctaaaccagcactgtccagtagaaatacagtatcaaccacatgtaattcaaaattttctggtaaccatgttaaaaaggtgaaaaacaaatggaattaaattttagttgcatttgtgtatttttcaaaccatcttcaaaatccaatgtatattttgcactaaaaacacgagtttgaactagccacttacagtagtggctaccatacgggacagtgctgcttagaacagcattgcagtgaataacctcatgagttcataatttgtacatatacaagtgttctgttttgttttgtttgagacagtgtctcttgccctgccgcccaggctggagtgcagtggcacagtctcagttcactgtaacctctgcctccagggctcaagtgatcctcttgtctcagcctcccgagtagctgggactacaggtgcatgccaccacgcccaggtaatttttgtaatttttgttgagatgaggtttcaccatgttgcccaggctgatctcaaacttctgggctcaagcaatctgaccacctcagcctcccaaagtgctgggattacaggcataagccaccaggcttggcctatacaggtatagctttaggacagatgtaggagaatgggtgtatctgtgtaattctgctggaaattaagtgtgtgttttttcacttgggaagtcagcccgtttgctgttcatcttccttgcaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagac

SEQ ID NO: 35704 - DNA, 8970 bp, Homo sapiens; identical to SEQ ID NO: 35703

SEQ ID NO: 35705 - DNA, 431350 bp, Homo sapiens
gtgaccacggaccaggcagtctctaatgaataggcaaggccacaacctccattctcccagaaaagaagaaatgctcatctgaaattcatcacctctctggagtcttcaaactgaccaagcattgaaaaggtctgtaaggtgtatcttaatatactaactagtagggcaacattttaaggacttaaaaaaaaaaaaactaaaaatacaaaagtttttctgaagatatgatactatttacaagataccttaattattcttttgcttggagaggaaacgtaatgagaatgttacggttttgccaaaaacagataatacgtaagatttgcctgcccacttcatctctgcctttgctgtcagagaattacactttctgttataagcttaagcatgctaagatggtgctatcaattccaaaaggattaaatgtatttatggagccagcttttgtcaagatcgtgtatgtgttatgtttcacagaaaaggaaaacgcagctttctagaccctcacccatatttaagctagataagtgatgatggcttaaagtgatagaccttagatttcagtaacattataaattgttaattacactttcaaaagattctaaaagtaactcactggacataattaaatgagttgggatagtaacagcaggtattttaaattatattcatgcataaaatttacatacatatttttaataagataacgcttactaagggaaaccacagtgcaatctcgagtccagtcaagtttaaacatcacagaataatttttatcatgttgttttaagttgcacatgaaattgtcttgaatccaatataggaggttgacataaaatgatttcaggctcatattacttattaacatttgctaaaaatactaattgccttctagtatgaataatgtggtgacatataaagccatttcttggcaatataaaactattacaaatctattcaatcacatatatgcagaaattaaatcctcatttcatgataaatgtgccttccaatgttttttctcacagaaagaacttgaatactcacctcaattattcagatttttttttcagatttttaaaatcaaagtctctttgacaagttattgctaacagcagaaaaggccgatgaggtttatctggccactaactgccctgtaaatacatgattacacattcctagaatataaattagtcctctggcatcctagaatctggtatggattagggtctgtatcccaggggttctgtgtcagctcttcctctgggtttctctgttattgctagagctgaatattaaaactggccttatagcatatttcacaatagaatgaggatctggattgcactggacaagtacaatcactttgacctccttacctcattttttaaaaatgtagagggcaatcattattcaggtttaaaaataaatatgacaagttctttaagagataccaagtggaatctgcaaggcccagacaagagctccacttcttaaacaatatgtgtgtggaggctgtcaaagggtattgcaattactgagctccagttagaaattcaggccatctagagttaatgactgtgtcccggtgaaattacagcaaagaaaacaaagattgaacaaagtatcttcgactaaaatttctaactgttaaatcatattagagaatatagaagcaaatttggtaaataggttttgaatttaagtgagaagaataaagccctgaattggataatggtaatggaaatggataattcagaagtaaaatctaaatatttgcaatggactcagtatggtgaataaagttgataagatgaacaggacatgggataacttcaaaaactctgtaaagtatcttatttggctgtttctgcattaaatgagctattagattatgtccttgaaattgagattaaataagctgtttaaagagatatttaaaactgtaggataaatatatctgcctgcattgacaatttaataattagaaaggaaaataatccatgtgtatttattaagaaataaattataaaattgtagtgcattttctgcatcaaacataaaatttcataaaattttcgtgtttgacttttgccctaaaggaccctttgtagcaaaaaaaaaaaaaaaaaaaaaaaaaaggaaggaagaaagaaagggagacggggaagaaggaagggagaagggagggaggaagggagggaggatgggagggaggatgggagggaggatgggagggaggaagggagggagacatggaagaagggggaagggaggcagaagggagggaggggggagggaggaagggagggactttattgatttagtctaggggggttgcctgtgattctgaagcatgaaaattaagtgttaaagcttttctaactttggttttcatagtttaggttttattaaaagatatttcaatatctaatatttgtatcaatggtttgcattacttttttagtaattgcttaaatatgaaaataaaactgctaaacctaaaattaaaaatcacttataactttttttcaaaaattacaaaataagcaacaaaagatccccctgcatgtcccacctttcaactcctacccctgcctaaatccccccacagaggtcagtgttgattgtttggtgtatgttattccaaccattttcatatatttattcctatctatgtatacatttttaaatgactatgggaatttagctattccacctggactctctaaagaatctgctgaatgtggtacatggtattaagtgatccttactgcctgtcaatgtttttctaacatcaaactttttctttcaaaattgtagcagttcttcatcgactcaaagtatttcacaaacagacttcaaaagttttccccttatctaaatttttaaagtaatttcctataatatctccaatgagagaagaaaactttgcagttaaatgcaggcttccaccctgagtctgccactttctgatggctcaggttgggccaaataattgaaactttttctgctgcagttgtgggtaatacaaacaataaaatagaaaaataacatctactacatggattgttctgaggatcaaactgttcacttttgaaagcaggtaacttccaagctgttatgtaggaacaacttgcattgtcactgaattctttctacttactagactctgctctttctcatgtatattccttgtcttccccaagttcctccacgtcaaagaaatctgttgtaatttcaacagtcaatagtgccttgattcatggggatcatgccagggggtggtcccataagtcttgtttgtttgttttttgagtcagggtctcactcttttgcccaagctggaatgcagtgacctgatcatcgctcactgcagcctagaactcttggactcagacaatcctcccacctcagcctctggagtagctggggctacaggcacacaccatcacactcagctaagtttttgggtttttttttgtatttttgtagagatgaaatctaactatgttgcccaggctggtattgaactcctgggctcaagcgatcttcctgcctcagcctccaacagtgctgggagtacagatgtgagccaccatgcccagccccctataaatatttcttaactgacaacatagaggattctcccaaatatcatagagctggctttcaggtaatctatccccaaaagtcagcaactttaaaggcaaatggtagtcataatttttaaatttgtctattttttctatcatttgtatattcatatatgaatgtgaaccatatacatttatgcctatagtacatattcaggatctaaaaaataaatgttttgccaaatattaggatagtcatgccaagataagattcacaaaattacttatgtcaaatgtgtaatatacataccaatgaaaacttatttatatgttctatattttatagtataccatgaatctaacagaattcagatgacactaacttagggagaagttgcgaaccataaaattacaattaaaattaatctataaattaagtgacataaaattccttaagaaagaatgaaatagccaggcctggtggcttgtgcctgtaatcccagcaactcaggagcctgaggcaggaggattgcagaggccaagagttcaagacaatactgggcaatgaaaggagaccctatctctacagaaaataaaaaagaattagcaggacttggtgacatgcacctgtagtcccagctacttgggaagctaaagtaaaaggatcctttgagcccactagatcaaggttgcagtgagctatgatcacaccatcgcactactacagcaggggcaaaattgaaaagaaaggaaaagagaagaagaagaatgagatatgcccagggagttaacaaaataggtcaccgtggacatttacctttgaaagcaatatttgcttaggataagccaagatgcttataaggatataagctgcctgttgacaattcaaggttgataggattctgtaatgactcacaatatttgccaaccctcccaaacctttgcttcaccaaatgtttgcttaagatgaagagtttggcattaggcacatgttgaaattcacctgggagaatttcccttcagagcgccatgaggtgacatggcagctgcccccatggtacactctgaaggaacctaaaggaccattgacctgagcatgttctcctcttgtgactttcaccaccctccccgccaagggtgtgccccccaaaacaacagtggtctgtagatgtgaacattaacatgcgaatgtgcacttcattttatcttatatgtctgcaccctaacaactttcaaagctagtttgaggctgtatgcaataaaagcatagtacaattgcccaaaatcaattaagaaaatgcagatcaaaccaagtataaaaagctttgaacttgaaatgttttctcaatttactacctttgtcctttctcttcttagaatcttaactccctaggacagagaatctatcttctttccagctatgtccctggcctatgaaagaggtgcctagcacatagtaggcactcaataaataaatgctgactgaataaaacaatgagaaaagtaagcaaaataaattttttttttagctaaaaacatctgaatttctatgactggaaatttaaccctgagcttgctagtatccgtgtgaaagagtcatcaaagtttacagaattctttgtctaacagaattgccagaaaatagaataaatgcttttctagttccaaattttttcatgagaaactttctttgagggtaatgagaaagactgacatccacgtctttatagatacttttttttaacacaatgtctgacctatgactgattttgctttagcgaaatgagcaggtaaagtgtattttatatgtagacacaaacagttatgtgttatatgtatacactaacatttagcactgattactctatcaagtttttaccagaaaacagagcccgggacacaagcaacagttgataaaacagaagaaaaacctagtttaagagcagaataatgtttagctgcactcagtggctcacatctgtaatcccagaactttgggaggccaaggcaggaggagcccttgagtccaggagtttgagactggcataggcgaaaaagggagacctcgtttctacaaaaatatattttaaaatttagccaggcctgacgatgcacacgcgtagttctagctactcaggaggatgaggcaggaggatcccttgagcccaggaattcaaggctacagtgagctatgatcatgccattgcagtccaggccgggagacagaatgagaccctcactcaaaagagcagaataacacttagctgaagagagcatgtcccagagaaatgtcgcagcaggttctgggaggctgaaagcaaatcagtcatcagaacatttcctgcctcgtgcctttgttcacatgtgtgtcaaatcctatccagggctcaaaccacatttcaaacacccggtatttcttagcttttctccatcagctgctgtaacccagtgtgctaagcatttgccatacaaagacgccagtcacagctcctgcttccattgggctcacagttgaatgaggaaagcattctctaaacaaatacttgtaatttaatatgatgactgctgtgagaaacgcaatgcaaagtaacatgcttggaagaagaagcaaattatattgattggggaactgttagaaagcaccaaaaagtggtaaaatttaagaaagttttcaaggatgaaccggagtttgaaaaacagaaagagggctggatgcagtggctcatgcctgtaatcccagcactttgggaggccaaggcgggtggatgacaaggtcaagagatcgagaccatcctgctaacaaggggaaaccctgtctctactaaaaatacaaaaattagccgggcatggtggtgggcgcctgtagtcccagctactcaggaggctgaggcaagagaatggtgtgaacctgggaggcggaggttgcagtgagccaagatggagccactgcactccagcctgggcaacagagcgagactccatctcaaaaaaaaaaaaaaagaaaaagaaaaagagaaaggaagcacattttaagcaaaaggagcagcaagtgcaaaggtgtgaaaaccagaaagaatctgaattgtttgaggaatggtgagtgggccagggaggcctgagtgcatgtgtgttggtgatgacagagggtgaggctggagcatttccatcagctcaggctgtccacgggtatgtttaacctgcacatcgtgctttggaacttttctcatcagccggggagcatcataggaaaaaaataaaaaccaaaagagtgacgtgacacaatttgtacctatgatctctcttaccatttttatcccttactgcaatttgttgaaactattttaatagaaattatcacgctcctccttgtaactgagttattttttactcttgtctaatccctcctactggattgtaagatcatttaaggagaataactacgcctgcctcatctttgtcctccttgaagcttctcttgcacaactaagcagttgttccgttgatttcatgttcaacttactattccaggaaagggaagtagaagaaaggaagcatgactgtaagatgggcgaggccaaggaagagtcatttcctccatggtgaagaacataatgctacgcaacttcaagcaaattaaaaaacagttgtggttggccaggcatggtggctcacacctgtaatcccagcattttgggaggctaaggtgggcagatcacaaggtcaggagttcaagaccagcctggccaatatggtgaaaccctgtctctactaaaaatacaaaaatcagctgggagtggtggcaggcacctgtagccccagctactcgggagactgaggaaggagaatctcttgaacccggcaggtggatcttgcagtgaactgagatcatgccactgcactccagcctgggcgacaaagcaagactccaactcaaaaaaaaaaaaaaaatggctgtggctaatgagcgttttagggaaaatgacaattaagctaaactgctaaagctggagatgatggataagacaaggatgagaaaaagaagaagacagaagaatttctaggaaattcagattccttctgagaaaagtgaggaggcaggggacaggacaatttaaagatgccaaagaatcctttattcttcaaaatttcaaaatctttcaatgctacttactaaagtagaaccactttaatggcgttggtgtttacctcatttcctcttcactcattaacagcagtattagtgggtctttttagtctatttcatcttctgtgtctatcacaccggcatagaattaccaagagcactgtttgacagaaaacatgaaatctcaggcaaatgatggagatgtttgtgattgtgtttcattccttttgattttgaccttttcattttggagtgctgactgacatggaaatctctgaagcacaattttccagtgaacttggcccgcttggaaaccgcccttgttcatcctcattgaatgagcattttccctagaccacgtgcatgttcccgcggcaataactggcttgcaaattaagcctgaaccagatatgccatagaactattattttctttttcaatgtgcaagcagttttaaagctacacctaatcctgactactggatcctgtcagatggcgcctctttaaaaccaaaatatgagttaataagcaggtgagataatctgcctccagcaaacactccctacattaagaattgaaaatgttttcatcattcagaagtttgctttaagctttgttatataatgctccttgtgaagttttaaaatgtatcatattatgttcatttggaactaaaaagcaattgaattaatagcagaactctgatttctgatccacagttttgttagtttgatacattgcttaggattctcaattatgaaaactacaatggtaagatggtaaagtgcatagaacatgagctctggagttattccctgggcttaaaccttggttctcccactcagattttctgcctccatttcctcctttctaaaccagaggctgctgtgagggttttaaatgaaataatctacatgatgactctgggcacaatgcccaccgcagggtaagcagtccattattagccattatcattatcaatcatcgtgatcattaattgcctttatatgtgttatatgaagtcattaggtagctaatgttctatagaaggggttggcaattttttcctgtaaaagtgcaggtaaatattttagacttcatgtgccatatagtctctgttgcaactactcaactctgacattggttcaaaaaaacaaagacaatctctacattcaaactcctacccatgaattccaacccagcatatatgtcaaaggccacctattccttgaccatattttcaatggccttgcccacttccctcccattttacctgcatgtcaaactgggatcatctatctctgtaccttcacctggatggctgagctctggtggagagaattgcacaatcacacagattaatgacactataaatacatcacatctaacttcaaccaggccctcacctctacccataaatccttcttacaaaacttccttccccctttttctacaacagctatttcaaatcatcttctgtcctcataaacctccaatgcacagaagtctcagtttgggaactctcctttctttctattacaaattttgcagagaatctcatgtttctctctctctccctttctctcttaccgccccccatgccccaacacacatacaccctttgttacttctctcctttaacaatgaaagaactgcccccttcctactggaagctgaacacctcatactccgtttgtcctataataactcatttcttcttacatcttttgagagctgacctataaatcatccccgcttttttacatttattttcagcttctcccttcttactgcctaatttggtttgtataaaacatgttacagcgctctatcctaaaaatgaacaaacctcaccagagtctatacttttgttcaactactaccttctgtctctccttctttctatgatcttttcaaaacaaaccaccacacctgtaatattttctttctttccttctttcctttccttccatgtagcaatctggcttatatttctgttgcatacaccgaaagtgctgttgcaatggtgctaaatattcccaagttgctaaaatcaaaaatcaaaaggacatgtactgcttcctgagatattttctttcccagcttccacgatatctagcttttcttgcttccctgtgattattcgaaggattctatcttctccttcttttttcctcgatgaccttatgcattcccatgtcttaaagtgccacccataggctaataatccccaatccagctctgttctcccttctcctgggctctagatcagcatctcaaatctcctagacatcaacaccagagttaccaaaggtccctcaactgcaaaaggctcaaatcaaaatcaagcttaaaaaataaaataaaataaaataaaaaaacttgttcctccacttgtagcatgtaagttaatggtaccagtcatctggttgttgaggtgagaaacctgtaaccctgcctctgcatcacctctgcctttaatcaattaccaagttctttcctttctatcatctatcttatggaccctggacccactgcttccctgaatcaccagctctcacttcagagtccaagaaggacacatctaatcgctgtctaggccaagtgccaagacttgtgcccagtctccaagcggctgggaaagaaaatacttggagatttcacatcccattacaagtgagttcagtttctcactgagcctcagaatatgaggaattctccaaaatgaagacgtccagatgacagcaacaccaaacgtgaaaccatgataaatgtgtgcaccccctggattactgcacaagccttctcacggaccgccctactgtcagtcttgtcttcctctttccctacctctgtcccggatccagactgcaatcagttatctctcaaaaatgtaagtctggtgatgtttctcaaggacttaacactcttccttgcctactgactacccataacataaaatgcaagttctctgcatggctccaggccctctctgacctaactcctgctttctagccttatctctggttattttcccatctccagatagatttctgtttagctgaaatgcttagtagaattacctgagtctgccatgtgctctctgggatccaagtcttaaaatacatatttgccagtatcctcttcacctccccgctcttcctcatccctcacacatcattctttcagctttctctctttcacaaaggtttcctgatcctgaccttgctgttgcttctaggtgctatcacagcactttgtttttctataccactgcaggatgactatagctaacaataacatactctatagtttcaaatggctagaaggaagatgttgaatgttcccaacacaaagaaatcataaatgttagagatgaatatgctagttgccctgatctgatcactataaattgtacgtattgaaacatcactaggtaccccataattatgtataattattatttgtcaatttaaaaaataaaatacaatttaaaaaaagacatactcaattatataagcttattatttagttgtaatttgtattaagttccatgagggcaaaaaccttctctttttcaaggtcatatccccgtccctagcgcactaccaggcatgtggtagatagtccataaatacacttcgagtgggtaattctggtccatgtagtacatctatcccagcttaggcttcacaatttcgtcatgtcaagaatcaaaggttttgttgcaattatttccttggattttcagcttaatctaccacaggtttggttgacacaaaatgtttttcaatctcctttagcactgatttcaacacaaaaactgaatttctttcaggccataataaataaataaataacaaataaaaaacacagtagctttctttcaaagaaaaataaattttacaagaaatgcaataaatgaaaatatagtctgttgtgcctttggtacacaaacctactttcagcccccgagtctccccctctccaccttcatgtctcttctggatccatgttacctaatggctcatctccccacaccttgtaagagttgatcctgatcctggcttcccctaaagttatctaccatgtgtgctgactgaggggccaattgtacttcagagctcattactgagagaaaccaggctgccttggtaggacaaactataaaacgttttgcaatatacaaaatggtactgggtgtccttgcaatagacacccagtaccattgctggattggctctggtggacgttccagggtcatctaattccacaggggtctatgccttttattgtctttacaattttacaactctgtaagttggaaaaatctaaaaacaatgcaaattatactggtgcatagatatacaaatgattttttttctagtagaaatgctatagttttccactcttatgattccaaacattgtattttattgctctatagatattaaccagtttcaaatctattaccaacttcatatcagcatgcctgattgcctacatgtgtctcatcttcagcgtctcctttgaaataattgtaatatattactgattttttcaattgttaaataaaagctcaaatacatgttatttgatttttatatattactatacctttgccttttcaaaatcatactttaactgcctgtttctcatgaagaaaatacattcaagtattaaaaatacactgaatataattgttcctcatatacgagccatatctgaataactggagaccagtcaggatgtttctatcctgcagcacagactggacaaaggaattagagtgatatttgggttagtaaagtcagggagaatgatgacaccctctgaaggattaaggatttacttgaagaagagtgcgaaatatggttcagtagatagagtagggctagcatgtggtgaatctaataattcaggcacaaaaaaagtaactatctttctaagaagacatgtaagacaaaagtacagtattccacttaagaagatggggtatgttaacattgagtttcaggatctctgattaactaccctctgttaaacagcaggtctatgactcactgcatccagtgaagcagtaggctcttgagctggatttctacaaccccctcgactcttgcataatgtattttgaaattagagattttcttagatgggaagatacttctacgcaagcaactcaattcagtcctctgaagacacaccatttctggggaatgtcccaccaagtttactcctgactgacacaaggtagaaagttgaggttcaccacatccaggaagcttccattattcactcctagactcagtcttgtggcagacatcaccgctgatgttttctagatcgtccctctcagtactctatgaacaatatatagcaaaagaatggcacacttagagtaacaaggagtcattgcttcacaatataaagttcaaaatgtcagtggaatttaaagctgtaatagcttacagataatgaaataccttttatttaattctgctgatattcccatgtaagtgttctatgccaggcctctagttatctcatgccctttaagattagattagactctcatagcccccaggtttttctcactttccttaaaagccttatcaaaattttatattattaacatattatttgtttaatatcttctctatctcctccactttactacctcccatgacttttaactccttgaacatgataactgtgctgtaagtctggatgaagggtcagcaaatttcagcccctgagccaaatccatcccaaccctttttgtatgccctgcaaactaagaatgtttttctcattttaaaactattgtttaaaaattaaatatcaaaataataatagttttaacacattaaaatgatataaaattcaaatatgagtgtccataaagttttattggcacacagtcatgctcattcatttccatcatctttggctggtttcatgctcatgcagagttgagtaattataatagaggctgaacagctcacaaagtcaagagtatctaccatctggccctttccagaaaagtttgcccatccctggcatacagcacagctgtacttccagcacctgaaatttaataagtgattattaccatctgttggactgttgagtgaatgaatatgaatgcacataactggagacaataaagtttcaaagatttcactgaaaactataaataaatgaaaattggaatccttaaaatgcattttgtggtttagggttggataatcagagtcagatttactaaaaatatcaatattctattgatctcattacattaatcaattagagtttgagtaaggtgggcggggggctgactgtgagccctatcctactaatagtgcctactgcacacatcatctttttgaatgatttaatactgcctagtgagatatttgatagcactcacagggcatgtattaaaatcataaaatgatcaacacaagtatacttgatatttcttccaacttgtaaaataaagaaaacttatattcattcactttaatgtttctcccaatttgtgacttacaagttttatgattaaaatggggaaaaaatcattgctactaatgacattctatgctgtctttcagaacacagtttcagaaaacagtttccagtgcctctggccttcctactgaaagcagacacagagtgcatgaagaccgttcaaatatgtcagggacctcctcccatgagtccttctatgactccctctcagacatgcaggaagaaagcaagaatactgacttcttcccgggcctttctgctttcctcagccaggaagagataaacaagagtcttgacctggcccggagagccatagccgactccgaaacagaagattttgactcggaaaaggagatctcgcagattttcagtacttctcctgcaagcctctgtgaacatccttcccataaggagaccaaattgggtgaacacgcctcgaggagacctcaggataacaggtcaacacctgtccagcctctggcagagaaacaaactaagagtatctcttcacctgtttcaaagaggaaacctgccatgtcacccctgctcaccaggcccagctacatccggagcctccgaaaggctgaaaagcgtggtgcaaaaactcccagcacaaacgtaaagcccaaaacgccacatcaaagaaagggtggcccccagagccagctgtgtgacaaggcagctaatttaattgaggagctaacatccatatttaaagccgcaaagccaagaaacagaagcccaaatggggagtcctcgtcaccagacagtgggtacctgtctcctaaaaatcagccgtcagccctgctgagtgcctcagccagccagagccctatggaagaccaaggggagatggaaagagaggtcaagtcccctggggccaggcattgctaccaggacaaccaggacttggcagtgccacacaaccgcaagtctcacccacagccccacagcgccctccacttcccagctgcacctcgattcatccaaaagctgaggagccaagaagtagcagaagggagccgagtttatctggagtgtagagtcactggaaaccccactcctcgagtcaggtatgaatttttgtattatgcatagcaaatgatcttgttgactttggtgttactttaatatgggaggaagaaagatttcctgtgtcattagccctctggagactgaggtagagtacttgcaaggagagaagcagcccagaatcgccactatgagttgtcctagttgtccctggcctgatatatctgtggtcatgcaccctctgtgctaaggaaggaaggcaaaggacttgagaaggcaaagagcagtggaaacagtttgttctctaagatggtggaactagtaacaaataggcacacttaagatgtgaaacttatttactcgaagtactgtgaaaagtgtgtgtatatttgaatatgagttgctaaagacggttgaaagcatggctaaaactagctgctatctagaagtgaaaggcacgagtgtgtagaggccaaccttcagattagcccccaataacgcattaaagggaacaataaacaccgaggcctacttgaggggggagagtaggagaagcctgaggatcaaaaaactacctatcaggtactaatctcattacctgggtgacaaaataatctgtatgccaaagccctgcaacatgtaatttacccatgtaacaaacctgcacacgtatccccgaatgtaaaagttggaaagaaaaaaaaaaaagattctcatatacaagaaacaaaaaccaaacaaaaattatcccccaaatggataatctagtctcaggcatggactaaataggcacatattcagtaacataaacacacacacaccccttcaatgtgatgcaaagaaggaaggcagaactttcctaagaaagaaagataaatcaagtcaggagctccgcaggtctgcccgttattcctacacaggctctggccactagagcatggagacagcaagaaataacagtgaagggagtatgcacttagagttaataggcactcataccaccatgttcattagaatttctatacattcttctgacttcattgtagagtttataccttcccctgagcaaaaatgttaaggggaaagagatcctggagtccccctgcagggtttccagtcatgattccattgcccaagttactctacccctctgtgactcagtttcttcatctgtgaaatgggaagtataatgatacctacatcattctgttttatgattaaataatacatggggaaaattaaagcagtaccttgcagctagtaactgctgcagtagtgttacctattatctttattatttctcatttcttaattttatatggcaaaatgaaaataacaagtcaggattatactacacaaataatgaatattcatttatctgggaagttttgcttttattcatgcagaatgctttacctaaattacataaatatttaaaaagttaactcaagggccaggcacagtggctcatgcctgtaattccagcactttgggagattgaggtgggtagatcacctaaggccaggagttcgagacaagcctggccaacatggtgaaaccccctctctactaaaaatacaaaaaattagccaggcatggaggcgagtgcctgtaattccagctactcaagaggctgaggcacaagaatcacttgaacctgggaggcagaggttgcagtgagccaagatcatatcactgtactccactccagcctgggtgacagagcgagactctgtctcaaaaaaagaaaaaaaaaaagttaactgaaaattatttgatttggaaaaaaatggtaaagtagacatcactggctaaagattgaattgaaacactggtactttcttactaatagcatttcacagatcacaaacttccctgtatctctgatcctttgctcactaacacaagctttgctagtgttggtttcttaatctgacctcattgtgcacacacatgaagtaaaaattagcattactggctgaaaagtggtgtgattacaggtgggcgatttttttcccccgaccaatttgttcaactaattcactttgagtcagctttacagtaattttactataattctttaagaaactgacagcagggggcagtaaaaaactttttcatgtgttcatttaattaaatatgtcgttctaaattctgcatttatatgttatttatgtagattatttatacagatttatatacatgaagaatttgtttcttacattttacctttgacagaaatgaatgtttcagattctatttagattttttaacctatcaatcttgcaaataaataattttcattagacattcattctcatgtcactcaaaacagttccacaggttttcaaactacatatggttccacctacatttacttccaaaataacccttgaagtatactacaacctttaaaaaatgacagaaagcagtccatttagcattgaaggattaattcaggtgaacagaccataattactgtattaaaattcacttaaccatttggtgattctaggggtcatcaaattcacacttctgcctctttgggggtagcagaactaaaatttaatttagttagtatctgcagtattattaactagttttctcttattctgcagtctatgaaagtccaaacttgacaaattatgcccttctagaataattaagtctcataaaatgttccattgttgaaagttagctggtcatgtttgtatcctatagagttttttgggtttggaggctgtttttgtttgagagggagagcatagatgctcattggattttttaaatttctgttccaaagatcttgatcctccttgtcatgtatttgtaagtgcaccagacgcctaagaacattgagctcttttgaccacatgagacatatgacagtcataagagaaaatctttgaaggaaattttctatcaggaagaaaacctttattaaagatttcctgcaatggggcattttagaacctgactcagactgtgtcagtccagaggacctaggacctggagcttaggcagacctattgattggcaggccatttcctgaggtcacagaagcagttgacagacgtgtggagaggcaaggagatgtcaggagaatctaaagcaagccataagcagaagcccaagagacactggttggtgagagcagagacgctcctcagtgttgggtagttggcagctgtactgggaggtaagtgaggtatggtgccaagaagcttggcggttggccaatggaaaggtccaggctgacttatagggaatgcgtcacaggaaaacatggcagcagacagtaggatcaagatacaggagctggaacacgggggagaaacctttaccttgcaagagtttaagcaagtgaaagttaggaccatagctccagaaagacaaaagaacagagcagaatcttagtgactcaactgggtccagattagggaaaccaattgctaggttaacatgcctgggctactaagcagctggctggagcttagattaaacaacagagattgtttgcttttgaaagctggcatgatgaaccttacaaatgtggataaagaagcccccactcagggaagaagtaacagaaacaacagggtaaaaccaggccagtcacttcaaggcaaggcatttgtacttcacatgcagtcacttcaccctctcacactgtgtgaacaccacttatgactacaaacaggactgaaaatatgttttcctcctttattattgcatatccaacaaaatctcaacaagagaaagaagagctgatagaagaaaaccctatgcataaaaaaggacgttatatacaattgaggtagtattcacatgatatgcaaattatattaacaatttgaattactacattaaatgaaatcaagtcagaattcattttttctctgcttatgctcaaatgtcccatattctcatatactccttccaaacagcataaagacctgttccctgacatcactcaccttccctgttctctccactcttgactttgtgagttagtaaaaaatttgtgaagaattttagttcaaaattacctccggtattataaaaaggaggccttatatttttaaaggtatttatttatttttaaaggtattatttatttattttaaaggtatttatacctttaaaaatattttatcaactgtatgttttaaaccatttaaatgtaaggagactgggatcaaaaactgtgaaatgatgtgcctagtaatacaaaaatcattcattagtcatggagactggagtataactcagctcttatgattcttgatcccatgctgcagttgttaatgagaagacttagccactgtcactgtggagttagaagttatgcatagcttactgaaagcctccagaaatggagatagtggaattgccacctttaaaaatctacgcttggaattcatattccaaatatcttcaaagaaaatggtagcctggcaatttccagtatctttctctatggaaaaagaaaacaaatcccttcatgggtatccttccctttttttgtattaagttaatcatggtcaatcaacagaaaatattttttaaggtgggtatagttagtgtagaaacattcagtgttgggtagttggcagctgtagtgggaggtgagtgaagtgtggtgccaaggagcttggcaattggccattggaaaagtccaggctgacgcacagggaatgcgccacaggaaaacatggcagcaggaagcaggatcaagacacagggactgggacatgggaagaaactatgttattctcaatcaaattactacaaataaagttattattcagaaaataactacaaataaaacaaagcattcctgttttatctacaagtagtccaaacacatctttatattattaatataaggtaaatgtgtacatatgtcaaaaaaaacttttaaacacccacttattgtagtaaaagtggaatccagtaatgtgctttaatagtctaaatacaattactcatatctaatcataagatacctactaggtcatcattgttagccctgtaaagttttatttactatatataattaaaagtaatacaattatttctttttataatcgaaatacagcatgtccaatgcctccaattagtttacatcagcaagactttgatcatcatcaaaagccaaaacaagaggattagccatatcaaatctatgcaactctgtcagtaaaaatttccatctcctcaaaaacgacaggaagaaaaacaagccatgaatttacttttcttactaagggtaagaaaatatggtatctcccatcttttggctgatttggtttcggaaaatgtagcaacagcaccactagccaatagtttatgaatattcagtgcttgtaaagtgaagatccagatggcttagcccaggagtatcgttgttgttaaagaatatagtcagcaatgagataccagataataccatcagatcatcaaaatgaaaaaatcctgacaatacacgtgttgtgactgcaacatgaaatgtaaataggtacaaccagtttggagaactgttttacgatacacaattaagatgtgcatacactaagcctttatagatacacaactgcctacttgacaccactatatcgatgtctgatactcttatcaaatttgtcgaaaactaaactgattctcctctcctccaaaaaccttctctttccaaatcttctccatgtcaacaaaagacaaccctccttccagctgttcaggaaaaaaaccttgaagccattctcgatccctctttttctcacaccccaagtccaattcatccagcaaatccagctggcaccacctttaatgtctccagatctgaccacttcaccccacctccataaatgaggctgcacgtcaagccaccatcatctgtctctttgttatttgcattaccttccaacccatctccttgctttcgttattgttcatcacagtctacacagcactcagagtaattctttttcatgaaatcactatcacagcactgcccgaacaccgtccaggggcttctcacttagtccgagtaaaatccatagttcttatacatcctaatcaggcttcatctctctgatttcacctcttgccactcccccagtcacagtggggttcttggctgcacctccatcacaccaccaggcttgttcttgtctggggcctgtgtactttctgctccctctgtttgtaaatctctctccccagatatctgcaggattaaatccttgatcccctccatatctctatcacctttacaatatggcctcctataactactctatgtaaaagaaaggtcctgcctaccttactctctattccactctcttgcttttctccatagatctcatgtgatacactgcacattttatctgtttgatttttgtagttgtctttcttccttcactagaatataaaatccttgggtgtaaggactttatctgttttactcacttttgtgtcctcagagcctagaacagtgtctggcatgtaacaggtgctcaataaatatgtgctcaagaaactggaaagaacctaaacattcatcaaagagaaaatggataaattgtgatatagtcacacaacaaatgaactagagctgcatgtatcaggatatatgaaactcataagcataaaatcaaccaaagaaaagcaagttgtaaaaacttacacataaattacatggacagatgtttgcatatgaagttacatttgcaaaatagtactatttcaggcttacggatgtagtagtacagagaaatgtgtgggaatgaggaacagtcaattccagacagcagtaacctttgagatgaagcacgtgatttgtgaggagtcaactgtgttggcagtattttatatcttaaggtgggtagtagagacacagatataaactacatcattttaatatttaatagtgaaaaatactgactttcatgttaatctactatcctcatgatgtatcaataagttcagcagcaatgtctctaatgaatactttgatttaccccataaaaaccatccagaaaatatcttggtgttaagcactgtgaatcggataggttggcttttagccatttgtccatataattttcagggttgttttagttatattttagagctttttaaaatgtttttttttgttttgaatttatggtgtttcagtagaatattatatgtattcagtcttgtgccatggatcttttatggtatagtctactttatttgctgcagtcaattaaaaaatctgtatatgagcttcttgtttttaaggaaaaagtctgcattaggcacaaacacacacacacacactatggacctggttaggactagtgagagggaatttgaaaatgaacaagtgcttcctgtcactatctcaccaacccaattgcctctcctcccatctacatacctagacaataggaacaagcacactagggcagaatccataagaaagcaaaacctaattttatagttgcctattttcttattcttttatttcttaattcattttaaatctttttttttttctgtgtatttgcactgaattgaacaaacaaaagcctttatattttgcggaggacaataaatattccctagaacacccaattactgttgaactagaaagcaaaagaaattcataagagaatggcacctttcgccgggcacggtggctcatgcctgtaatcccagcattttgggaggccgaggcgggcggatcacgaggacaggagatggagaccatcctgactaacttggagaaacccagtctctactgaaaatacaaaaaattagccgggcgtggtggcgggtgcctgtagtcccagctactcggaaggctgagacgggagaatggcttgaatccgggaggcggagcttacagtgagccaagatggcgccactgcactccaggctgggtgacagagcgaagattccgtcaccaaaaaaaaaaaaaaaaaaaaagagagagagagaatggcacctttattttcacttaagtgaaaagatagccttatctctgactcctaccacacaatttctgggagttaactcatgaaaggcatgcgacgcattgagaggttttatcctctttctatcttttccattctttcttaaccgctgttttcatccagtacctacccacttgtaattttcactctgaaaactagctatgcctctgcagtagcttacctgcaaggccatcattaatgagaatattgagtctatttctgcagaccttagcgaaatggaataattcagaatccagcaagcccaggaaatattgcccctgttgcatggaattcttgtttaatgacttgaatattacagagtggcagcagctgccttattacctcttctggtcaacccataacaccatgatgttatgaaaagcccattccagctgtataaatgcataaagctgtgaaaatgttgctctcactgataccttagtgaaccaagaagtaaggctgatattcaaggcaaaagtggaatatcactatacagttagaagtttgaattggttatgacagtcattggtatctagtcatgagtagcagtagctaaattagacagtagcatcagtttatatcttaatggacaagtttctggatttaacaagaaaacaataaacaccaaaataaatgtagctgaagaataaaggtagagattttttaatgtcttttgctttgaatttgtggtgtttcagtagaatattacatgtagtcagtcttgtgccatagatcttttatggtatcatctacccagtttacctgctgcagatggcaaaaaaaacaaaaacaaaaaaaaacaaaacacctgtatataagaagcttcttcagataatccctttagaattaaaagggattcgtgaaacaagcatcagaagcgcttagtggtggacagtagaggttctagaatcagaatgtgactcttggctccatcacgcatcagttaggtcactgtggcaagttatttcaactttctgtgcctcagtttctttgttggtaaaatggaaataatagaagtacccacctctagggtaattatgaatgttaagtcaattaacacagagaaagagtttaaaactgttagcacattgtagtgtcttaataaatattaatgtattattttaaaagttacttattattttaaagtgtttacttttatagtttattgttattgacttagaataaactccccgcactctaccttttcaaaaacctttgactctgtttcctctctttaaaatcttcatactgccattttcttttatactactaagtattcacaatggtatagagcctatggagatggaacacttcaacagcataaaataaacaaatgatttatcagaaatacaatacatcttgaaagttgcttttgactatttgttgagtcctagatttgtatctcagagtcggaatcatcacaaaggctgccaggaagtagtgggatactttcccttggtctctgtataacatactattttttttatacatttttacctcacttggccttctgttccttcactgctgcagggtatgggatcaaagccaaagaaaagtgatttgtttctgtctctactcctccttcatacaactaattatctccccatcctctctttctaaatgtagaagctgtgaaggtcagccgtactgtggattactgtcaatttagaacaccttccaaaaataaaatctctttgactattgttttcttgctgctttaaaaattgtttagcaatttccctcagtttgctttgtgagcatgtgttaactatttgctagagttaattgaaagtggttccccaatactttagccactctttgtttttgtatttcaataatttcagcaggaagaaaaatctaaaataatttaagtaacaaatgcaggcttttcctcagctagataaattgaccttttattttgcattttcttactactaagtattataccatgctgcaaagctctcaaaaggaaaaggatgtgcttttcggaagtttaatttattagtatgcaaactagtatcaaatagttgttttgaaagaatttgaccctgaagtttcagataccttcacagtcaaaactactcaatgtctcaaatcttttctgcagagtctattttaagtacttttcaacatgtttcttcatttgccttggggccatacctcctcatggatcactgaatctgcttaagcataattacagcaattcaaggactccatttagacattgcattcttttgacgttttggagttactttataaatgtaactgtagcaaatacaattttaagtatgaaactttatatagcttactgtgctgaccaagatgcaaaatagttctaccagttggtgtttgaatgatatataacaatagaaatggttctttcctatttaattttaattgatttgagccaagaaatagcatcctattggatatctgctgaaataggactaaactgctggtctcctgaactgtgatagagaaatccaatcaaaagcttttcctggccaaaaataatactaattgcaagtgaaaactagctttgttctctcggttatgagttccaatggtgaagtctagttccatataacagtgcatggtaaattaggccacagaaacaagcttccagtcactgtttatatgatccacatgttgtggtccaaaaaatgtaaataaaaataccctagggaataagaactttttcctaagatgacagcttttagccttggttgttgaaaatggtgagtatttctaatgaaattgaaaacaagtctagggaaatgaatttccaagtaatggaggagaatctttgagaacgagaagaaagaggagaggagaggaggggaggggaggggagggtaaggaaggaggaagggaggaaggaggggggagggaggaaggagggaggcagacaaagaaaactctcatctgaagattaatggttcttttaaagtcagaaagatcttcaaaataattttcaccattatatagacattacagaccaattgctttgacagagaatattctaattgtgttagtgcaaagagaatgcaatagatatacagttgtggacatctagggagatgagaaagaaaatgtttcagttttggactttgaaccactacaaagaccaagaattctccatatcaatatatgaatttgattatgttaatggaccagcatgggcccagcatgctttctagaaggatagtaatgagaaggtattgataaataagaggatttgttcaaggtcagggcttagctaagcctggtcactccagtccaggggccttgttatcccctaatgaggaggtcttgaaagttaacaccagaagcacggtaacattcaaccaccatcatatatgtctgtgcagtcactgtgtagaattacacatagtactaaattgtaggaagtttatgctaaaattgccattttcatgcttgtcaaccctatggtcatcattctaaagtcaccaattaaaatgattcctctttattttcttacagagctattaacactgaaccctcacgaaagttattgtcattctcctagtaatactaatagatataataatattaatagccaacatttcttgagtacttagtgtatgccactcttctaagggcactacctgtataaattcacttattccaataagctagatactgccagatttctgggattctaagacatctattttacaacactttaacatctttgtaatcagaactctttacagaaaaggacatacttaaacaacagctgtcagatgactcattttgtggttgtattgcttgtacacatacaaatttggtcagaattgtttggcagcttaattatttacttggccagtactatatgctgtttctttattagtggttcataaaacaatggtatctagtggtgatttcatgttagattcagtgaactagaaatttgttttctccattttaaaaataacatactaagatatgaatagtttagcaaaacttcccaattgtccagttactggtagggatggaattcacactgagacaaactggctcctgggtctatacttttttgtttctaatttttatgggtacatagtaggcatatgtatatatggggcacatgagatttttttgatacaagtatgcagtgtgtaataatcacgtcatcatagaaaatgaagtatccctcccctagagcattaacgaatctgtacattttaactgctatactctactgccataacccttctcaagatctgtctcaatggagtttgggtgagtcctcctgaccatcagaaacaccaccacagatagtgagcagttctctaaaagcaaacctcatgaatcgcttccttccattgcccccagacaatgttaagaaaccttaaaaaagaaaagagccatgattgattctttagtggtcctcatgagaaaactgtgctgtatacattcccagcccactttgtggtgtcacatgaggaagagccagcgtctttactcttagcaacaaccttccttgttgcaacttgtgagggcctgagctacagtgcctcctctatcaaagccattttgctgggtttctctttcttttataaacagaacactgatcccaagcagaatataacagatatgacttgtaatccgttatagtaccatttaatccttatgtttagctgccagcattctaattaagaatgtgttggcatatgttggccagaatcctgcaacatggaattattccatgggccaagcctgaggacacacactgctgcctaaaatcgaggaagaaagggccccaaccacactttagttcaagtgacttctgatataccttttctacaaaaggccattgcaaaatacaattctgcaagatcattttttacgaaataaataattttaactttgaacagggagctaagagggaagcatgaagattgaagaaatcaaattaactttggaacgagagattgtcgtcatagcctaaaaagtcaatgagcacatcaaaaggagagagattcctctgcccacagtaaaattcatcagggggccacatggtatagtgtatctaggtgttaggtgtgcagacaaggaatggcgtgcctcagtttggggtcagtttcactgactgaacatttgtgctgccccattgtacacactcagctctacaaatatcttgaccaattcatttccaacctagatgctagatatttgggagaaatttttaattggaggggattggcacatatgttgtaagtgccccatttgttttactatttgttaatggaaaatgccaatggtatacctcaaattaaagataccatcacccttagtaatagtttaaacaagatattccacagaagaagaatgagaagaatcactctagtatgagagctattgtgtttggattgtattttcttttctaaatcctaataggccaatgcaggtaaaatgatgaatccattaacaaggtgtttctatcctattacaaatcaaagtaactttactaccactgtgtaacctataataattatataccgtataatatataatgtatactgtaacacttatgttgccaattttaaaattttatactgatctagtccctttcacctgcaaatcttaaaatcttaacatttgttcatccagtgcactatgtaaaatggctttagctctttggaattggaagttgtatcttctaacatggcctaggagcagcccctgccttccagcatagagttcagcttccaacacacgcctcaagaaccatgggtttttttggaacatgaggccagctcttagctacctgcaattcggaacgtactatttggtttcagcagtttcttgacccttcatggggtcatcttcaagttctgtattgttgcatatgtgttttttctctttgcctttggatagttttctggctttcagattttgatctttcagattttgacaaatcagaaaaagaccaaacccagccaaaacgtgtctttcattacagtttgttctggttgaaatgttaaaccttctcacatccgtggtattgaagcaaattatgatccaaaaagaaagaggagttgggttcatcttctctctctcacatccacattgcaaatcagtcctttttcactccccatatttagtgctatctgttgtcctcttgcctcactttcttccaggaggtcttcgtatcctcaggtaggtctacagaaacacaatttagttttcctttcatcatgcaaacacaatgctacacctgcactaatcatctgtgctcaaagccaatggatgatagggggcaagtgttagaaattacccaaggctcttagcacctggagtgttttctcacagcctcacctgtatggataattttatcagccaaatagagtaagtggatcttagttgatcagagcaggaaacaagcttgaagccaggggtaaaaaaaaaaattaagagaagcaaatgaagcctccagaaagggaatctgaaagagacaaggtgaaggattagaagcagatggcatgagaaacagttccaagaagcaatgagaaaaggcagagctggtgatagttcactgctagagaccattaaacatccatatcccaaatggttccagatcagacctcccagggaatgaaattaatatgcaacagtctcctcctttgccagctgcttgtggcatttgtctcagctctctgtgaaaaattgtgtgtactcacaataacaaacatatacgcgacagcaatccttccgaggtgacacgagtcattgttgaagagtcgtgctcccagcacgttgggaggctgaggatggcagatcacctgaggtcgggagttcaagaccagcctgaccaacacggagaaaccctgtctctactaaaaatacaaaattagccaggtgtggtggcacatgcctgtaatcccagctactcgggaggctgaggcaggagaatcgctttaacccgggaggcagagattgtggtgagctgagatcgcgccattgcactccagcctgggcaacaggagtgaaactccatctcaaaaaaaaaaaaaaaaaaaaaagtcatgctcatggcattacttccttaaaacttcgagtaggatacagaaggaaataaagacagtaacctctttggggttctgtacatcttcacaaagcttttcttcatagatcagaaaagaaacttaaatattccttgggtttaagctgccacagaattgtgttaagattattaaaatacaagcatttaaatatgaggatcataagtctgccttactacttttgctccattatcctctgactcatcatctttcatagaccctgacagatcctcctcttcccactcttctccaccccactgtcttgccctgagtggctgatctgtgtagactagaacagactccttcaggtttccggttgggctaagtcctggagggccctggcagatcagaaggaagaaagagaggaactcaaggtacttagtgtcccatcttcctcctatgggcttgccttggccctctaagtcaaatgaaggtctccatcaacacaatgcttccctgtgttcaggaaagtgcatccaccttctgttcctttagggttaagagtggtagcaattctgctttgtagtccccaggtgatcccttatccctgggtttcctcatactctgacgataccttcagatataatcttttcatgaaaccctccttgcattgtttgagttttagtgtgccctctctttctagctaggaccacaactgctacatcctcctcctgattgcccaaacctaaaatgatgatgacccataattattatccagatacggtgacacaagcaattcctgaaatgctttcctctgaaattgctaaggattactcacaggcaagttacacagcttcaaaattacttttccagctctatattccctattatttctcgctgtttgcttttagacttaagtaaacttcaactccaattctataacttagtaaaagaatcacattgatgtgaaagtccaaaaagacatttgatgttgtaagtggaattttctcattcgttcactctctgtcaatgagaaattaaatgactaacactaaatggagtgctacatatgtctggcattttttacaaaggaatttatatactgtctctcatccagttatctcgcaagctctgtagggtaggttctgttattacgtgttttagatgtgagaaaactgagactcagagaggtaggcaaactatccaaagacataacgtgacagtaatgtgtctgggattattaacaccaaaagttggctttttggtggaatttgtaatgatgagtgattcatacatttgaagtggtgcttgacttatttaatggtacataacaaaccactccaaaacttaatggctcaaaacaatttattattttctctcacttactagtctatttgaagactagctaccacaggggaactcttaggcatttttttcacgtctgttatcctggaatgagtaaactctaatgagaacaaagaataccgaatatcatggagtttggatgaggagtgtgatacaacagggttacagtttgaattaggagtcacgccaaaaggaaggtagaaaggaatccagatcagtggaaaggaggaagcacctaacataagaactaggtgtgccattaagaattatgctttgggccgggcacggtggctcacacctgtaattccagcactttgggaggctggggctggtggatcaccggaggccaggagatggccaacctagtgaaacttcatctctactaaaaatacaaaaaatttcgttgggcatggtggcacatccctgtaatcccagctactctggagactaaggcaagagaattgcttgaaaccaggaggtggaggttgcagtgagctgagattgtgccactgcactccagcctgagcaacagagccaaactctgtctcgagaaaaaaaaaaaaaatgtgtttttctcttcaaaatctgactccctccctcagtcatgtaacctgcagcatagtattagcgcaagtgcagggagccaggcgaagggggagagtggtacacaattaagaagggcacagcctccccaggctcttactgaactgcattaccacatgacgatggaaagtcttcagctagttttccccccaaagaaatgaatctggtaaatcactatgtttaacttacatctgttttattaaaacctaagaacaatcgtttaatataaaaaagttttttgagacattttattaccgaaaacaaagatccaattacatggcttctgtagtgggagttctcagcagacagaagacaattacaaaatcaaataaagctgttataattttaaatcaaataattacagacaaaatgactaagtattgatatttttgtttttaaaaataaaaccaggctaaataaatgaaaataaatacttaaagaagtaattgttgcagctaaagcaaagcatataccttcttcacctaaaatattagcttacatgtttattttcattttaatgaaacccagcccccgtacaatatgtgtaaacgtcaaactaattttatgtttctctattaggtttcccaccattctaaatggtgcacatttaacaatattttatatttcattattactatggccctcgggttctgtgttagaacaattacatactgtaaagaattagaagtttttgaggatttactctccagaatagtgactgaatgtactttgatagaaatggagtaacaatagctaactctaatttatccactgcaattggtaataaaggaagatagttaagatctcaaatctggaagtctgatattttagccaacaatctcaaccttctcattaaacaaaatatttctttgcagataaggcctctgcccttattctctcatcttgctattgatgtccattacgtgcatttggactatgttatgcatgtgttggacatttatagaacactccttgagtgtaaagctctgttgggtattgaagggtacaaagactctatccatcccttcaataaacctagaactgcagagagagatagacacctgcaactgaagttcctgcctctcacaatattgatataattggctcctcccctcgccaattttatggtttgtgaaagttcaaagcatgtcttccatatcttttctcacctattggactcctgttgctgcacatgctgcttctgtgatgcattcagtggactcagatgtaaaactgcactgtctctttgagttcacatttagcaattttttattcacacttatgagctgaataaacttcacagaagatggtctgaaaggagacagatgaggaacttacatcacaggcatgcccacaatctgtaagggagccaagaaggcaggtcatctggaaagctaaatatcattttaagacattcatattctcctataaccatcaatgaccactactcacctctctctccaaactgccctttcttctcagctttctcttttatcctggattgcagaagctccagattcttttccctctaataaacagggaatgtccccctcctctgaagtcttggcaccatctgatacctagatattcccaacagagaatccagtctctggaagaagtgtttgtgcaaattacagagcatatttttaaaatattctcccttttgtcaaatacccttaattcaaggcatgaataaaaaggactagaaaataataatgttatgatattgcttatagtagtaagatttcttgattatgtatgtgtgaatatatataattgtgggaccatgtggtgattttttcccctttttctactatttgtcagaatgtttggtaataagactgctttggagtaacaaagaattgcttaagtagactagctataaattttaagctgatgatgatcaatctgaaatggatggttagacccagaaccttatgattattttgcctgaacaaattacagagatgaaaggctgccttcaaatttttggacaggatatcccaggtaaagatggaattcatcctaaaccagaggagtgatgtaataccaattccattaccactcagtgtccggcactccagaccagaacaaagctgaaaaatcggcaggtgtgaatgactcacactggacactgagtgataccattcacgtatcttctgtccccatgacggaagaaaattggcctaagaaactcaggaagtgaagcttatatggtgaaccaaaaaagttaggccatgcatgcttaaggaatactcagtgaaaaatcatgaatgctgatagaaaaatcctccctcacattgatgctactacagtgaagatataatgtaggtaaaaacactgtcttcataaggtattggccaccaggtcaacaaaaacagctgccctacagagggcatgttaaacagagaaccactctatccctgaagtaaatcctttcctgctttggcaattgaggggctggagttttacaggggaaggggaatcttccaaaagccctccttttttttctttttttaaagatttttacttctctcattttatttcttttttaacttttaagttcatgggtacaagggcagatttgttgcacaggtaaacttgtgtcttggggctttgttgtacagattatttcagcacccaggtattaagcctagtacccattagttatttttcctgatcctctgcttcctcccatccttcaccctctggcaggccccagtatctgttgttccctgctatgtgtccatgtgtttttatcatttagcttccacttataagtgagaaggtgcggtatttggttttctgctcctgtgcaagtttgctaacagcctccagctccatgcacatccctgcaagggatatgatctcgttctccaaaagccctactcttattctctacagggaaatcagatcttcactacttcagaggaaacatagcacattacttataccagtcatcctaagtcttcattcataaacataatctaactatcagaatagccaggtattataggaaaacaagaacttggcctctctatctctaccaaaatgaatgaataggaccaatccaagaagaagctgagttatctcaagaaaaaactttaggagagaagatttttaaatcccaattaacaaaatacaccatcaataaaaataatattatattgctttgggaaaaagtaggatataataaaattagaatagaattacgtaagtaaaaatttcagaggattgtctgaaaaatcagaggataaagctaactatcttgtagaagaaaaaatgacatttcttaaaatgtagatcacacaggaaaagacatcataaataggggaaaaggatagagacttgagggagattcatggaggccaaggtgcattcagtagaattccataagaagaaatcacagataatgaaagaaagggaaaccattgaaagaaacattagaagaaaattagcttttgctgaagaaatacaggaaccttctgattgattgaaagacacatcaatcaagcattgggcaggatagatgtttaaaaaataataaagctcttgatgcaatctcaagatgaagagacaattctaaaagcttctaaagaattaaaataggttacccaaaatgaagaatcagactaacacctgatatttcaccagaagcactaaaaccctcgaggacaataatggaaagcatatttgtgtgtatatgttttagaaagacatctggaaaaatatacatcaaacctttgggagttgagggagaagactggctttttactttctaccttgctgttgttttaatttttaagatcatcttttattacttttataactaaattattttaaaaatatctttcccttctaattaattctatccatggacagaattaattagtaggcaaagagactagacgctgttacctaattagaatgttattataacagtcactgacgagaaactgagaggggaagaacctacagtaatagaaattaggggcctgaatcaaggaatgttttgaagatatttttcatgatttggtgagttattgaaattaagaataaaggagaaagaaacaataaaggtgattcctacaagtctgaatgactagatgactagataattatgccattcagatgagaaagaccaaaggaggaatagatttctgttggatgttacggagaagtccatacgatgtttacgttacggacttgagtctgaggtataggaagagcattcatataaagggtctggcctgtggtctgaaatgggggctggagcttgggagagatgttgactggagagatagctgggccatggggtgagcagacaagaaagaaaaggactcatgacagatccatgtggagagcctgcaccaggggaaactgagggaagagaagccagtgctgcgggagaaggagtgttcatacggaaaggaggatctagagagatcaatgtcacagctaaaggaggacattttctccaaaaaggagaaggatttgccacattgacgaagacaagaaggaagagttgaaatgcaagtttttgataactgacaatgtcatttcttcttcaggaatttcaggttaataaatattagaatggccaaataatcttgtataatatattatggttcatcaggttgttctcatacaggcatctcttcattaccaaggggcttttaacatcttaagcaaggcaaaggtagaagaccccttacaaggttgcactttatctagatttctggagaaaacatggagtcaaggagtccaccccttagggatgagtttccagaattccaagctgaggtcaattcctgaaccaggaataccaagttcaaggaaaagatgggctgaagtcaggacacagaggtgagaccaaagccaccaggagcaagaccagagccagagaccagacagggaagacaaaaacaccatcagcgaacgtgttcatctgagagtcagtcagaggacatatcagcagtggcactatgaaactaataccttcttgcctttcaatcatttgtctgtcttattagggaaatgaattgttatctgataatatttcccacagaagaaagtgttaatcatttatattctcaagatctatgacctataaaatatgcatatggagaagattgatacttttctaatatgcattatgatgaaaaagaactattcatttcaaatggtataataggggaagtggttccttcatcatttttggctttttgtatcttccactgaacacattttctcttctgaacttctccagtacatattgtaatagcacatgtctgcttctaatcatttattaccttcatactgacatcttttcaaccacatacattgtatctttgtcatgacagccacaggggcaccaattctgtcttattttcctttgaatcctctatagctactagaacagtttacataataggttatctcatactaattggctgtcttttatcgcattacccaaagataatgactactgaggattattcctaatacaacctaatacaacctccatatctgcatctgtggattcaaccaatctcagattgaaaatatttgaaaaaaaatggtgtctgtactgaacatttacagaccttttttcttgtcattattccttaataatacagtataacaactatttacatagcagtcatcatattaggtattatgagtaatctagaagtgatttaaggtatactggaggatgtgcataggttttatgcaaatactacatcattttatattaggaacttgagcatctctgaattttggtatccaagggaggtcctggaaccactcccccatagatactgaggaatgactatattatttccttatgtaggtttttatattttttaaagtattttaaggtacataagatctcttgattttcacaagaattaagtggcttaaatgggagagagggtggattaccacttaatagatgagtaaactgaggttcaaataattcaatgattttccaaaagattcagtattcaaactacagtctatactttttaattcttaactgggttaccttctactaccagaagtgctgttgattttctgtaattgagattcagataaccgaacccacatatcctaggccagtggttcttatatggtggtggctggggctaggggaagacttcaggggtgtatgcgtataccactttccaagaagagattggaaatgtgcagagttatcacatggtgggtatcacaatggatggaaagtgattgtggcatttagtaggatggggtgtttaacaccttgcaatactgaagccaccacggtgagaattgttccatttgaacacccattgcatccctcttaagaaactcagcaagtttaggcaaataaagggaactatagccacctctacaaatatctgaccaagagtcctcctttatgctgtctataaggggtaagtgagcaaaagcaggaatttagcacacaatccaggctcgtattctttgtacataaaaatacaactattacatcatcgcattaataatcacataagcaacgtggtgtgtaatttacaagaacacttaaagaactctcagtaccttggtgccggttagagacttcactgaatacattttaacttatactcctttatttgttttgataaaaaagagagtcaaacagaattgtctggaatcttttcttaaggttaacagctttctgttcccctttgttcaagtgttcattttaataatctaattattccagatctatgactcctgctactcaggactctcccaaaagacccctgacttctgatgttccacttctgcctgtcctttaacccaaatagattcctgttgcccttccagcaaaacaaaacgaaaggaaatgacatgctacagaaggctttcttctcagtttgcaacaaaccctgtaacaaggttttccctctgtttaggataaaggtctctgggcacctaaggcattaagccacagagcattgccctcctgcattattaccatcctgggattaccttttgaaacattctagcatttgtatttgaccgtgttcacactgctataaagaactgcctgagattaggtaatttataaaggaaagaggtttaactgactcacagttcatggctggagaggtctcaggaaacttacaattatggcggaaggcaaagggaaagcaagacaccttccacacaacgcagcacaaggcaggaagaaatgtcaagcaaagcgaggaagagccccttataaaaccatcagatctcgcgagaactcactcactatcacgagaccagcatgggggaaacgacctccatgattcaattacctccacctggtctctcccttgacacttggggattatgggattacaattcaaggtgagatttaggtggagacacaaagcctaactacatcagcattgaaaaggttctctcttttttttttttttgagacggagtctcactctgtctcccaggctggagtgcagtggcgcgatctcggctcactgcaagctccacctccggggttcaagctattctcctgcctcagcctcccgagtagctgggactataggcgcctgccaccacgcccggctaatttttttgtatttttagtagagacagtttcatcgtgttagccaggatggtctgatctcctgaccttgtgatccgctgcctcggcctcccaaaatgctgggattacaggcgtgagccaccgcgcccagcggaaaagattttctagagtttagtgctttcaaattatctttactacagatacatttctaaaaggatatgcctttccaatttcattaagttgcttagggtgagaacacaggactgaggaaataattgggcacaaaaaacagctcttacctgtaaccctttcaagtgcaaactgtgatgacaaatgctttactcactcaataactaataacatacttttggttacacaaacatactgctaaaaaattgtattttcaatgattgaagcaattattctacataattttcacttagcagttctaagaatgtattgatttgttttctgctcatctggtatactggagcaaattgtttagctgtgatgctttacaaagtgccatgtatcactttgtatctccaattaaatttcaattaagaaatcttataattatcttatatcaaccagccaagagcagaaattcctcatattgaatcatacttacactactaatgagactgtcaaggtttggctttatgtttacctcagataggcgtccaaaaactgtgatgattgtccaaactctccgaacatcttgagtctgcaaaatttcgctggcagtcttgtgggaagaagtttcttttctgcatgagccatagtgtctgcttcaagtcctggctcaaagtcagactacaaaggcagacaaaaatgagagggaaatttttatctaagtagttcaaagcttcaaaatggatgaaaggttcaggaaaagggaaagtttattttctttaaaaccagttcaacatatttggtgcctatggccacattcatgtttaacctgttacagcagtaataaattgaattctatcccccttcaggtgagaataaccagtaaggaaactttctgtgacatattttatattcttggatcttttccctgttttaacacacaagagtggcaataccaaaacaagctgtgtttttatttgaattgtgcttatacataggcatcataagtatatactgaagtatttgcttaagcaagtagggtattaagtaggattttaaaaataagtagaagcaaaacgggaatgataattgaaaatgtatagaattataaaatgtgcctcatgatttgaagtatagatccagggaattattctgagtaagtaaacaatccacttccttttttctatctggaatctaataaaatgttttaaaggctttgcccttaaaatgaaaaggtaagtatacaaagaaaattgaaagatttaaccgaatgagaaattgcttaatataattcctacagtcatgacattccaagttcagaacaatttgttttaaatttaaataaaataaaataaaataaaattttattttaaataaattttaaataaaataataaaattcagtccattttagccatagaccttgtttttcaaatgaccttatgattcagttattatacctgcgctcattctgtgacaggtcattccagaagagacacaattgtacaaagctgaacataaaataaatcttggtttcttattgaattttaaattacattgggaatgcttttggaataattccagaccttaggagaaaaaacgtctcccaactctaaagtcccaggttccatctcaacgtttcacattcaccggcaaaggctccaaaaataaattacaggcaagcttaaaagatcagaaaggctttcccattgtgcaagtgggtgattacccgcgattggtgtctgttacagtcattgtgtctttctctaggattctctctctgtttccgaaacacatatgttccaagttttggatgctacgacttcgtgttcatgtggttcagaatttagccctcccccagcccctaaaaaggctgatcttatgggcgtgaaaaacaggcatttcacagatttagataaatgtatagtgtgtcataaaactagctcatagaattataatttgaaattgttaagaacattgtgagtacctactacctgagggatgaatttcaatggcacaccttattttgtttcatccttactacagctgtgctatcccattttacaaataaggaaaactgaggcttagagaaattaagtaacttttccataatttgtcagctaggaaatgatacaagttgagttcagatctaagttttcagaccccacgtcaaggggtttcagctttaaaaattacgagtcctgcccgggcgcggtggctcacgcctgtaatcccagcactttgggacgccgaggcaggggaataacaaggtcaagagttcgagaccagcctggctaacatggagaaaccccatttctactaaaaatacaaaaattagccacccgtggtggcgcacccctgtaatcccagctactcaggaggctgaggcaggagaatcgcttgaacccgggaggcggaggttgcagtgagccgagatggcgccactgactgtctcaaaaaataaaaataaataaataaataaataaataaataaataaataaataaataaagatgctttggaaaacctaaaggttgtgcaaaggcctctcacaatttcttttcatagttaatttatgaaaatgcaacacacagtctcatcaaagctcaaaattatctttttcatccccgttggtaccctgttgattcttccaaactaaaacacagctgcatataattcagatttattatactttattttatttttttaaataatttcaacttttagattcagggggtacacgtgcaggtttgttacatgggtatattgcgtggtgctgaggcttggggtacgattgatctggtcacccaggtattgagcatagtacccaagagttagtttctcacccccttcccttctccctccctcccccttctagtaatccccaatgtctactgttgccatctttatgtccatgtcatacttttttatgatgtaaaccaactatagtgtagtccaagaccttaaaggcacctgaagctgaaaaagaatgttaattatggcaccgtattatgaccaagtcatcccagtctgtgctgcgacatgagccctaacgattttctcattagcagatgctctagctggtttccatgaaggctttccacagtgacttccatagtcgtcataggcgactactatcagattccatctcaacgtttcacattcacaggcagaggctccaaaaataaattacaggcaagcttaaaagatcagaaaggctttcccagcatgcgagtgggtgattcatttgatttgtgcctgttacagtcattgtgtctttctctaggcttctttctgtttccgaaacacaaaactacagaaaccacctcaccctctttctgtccttagggttcatgctaattatgtttttactctgaaacgggttttaggattgaagggccatgtcgaatggtgataattctatttcagttagacaagagcctggaaaaaaaattattttaaatgagtttcagtttgcgcatttttttaaaaaaagagcaaaaagtatgcatgtatgtttgtttttacattcttctttatttttatcttcttactttgctttttaatgagtcattagcattggaaaatgaaaacaatttttctctagccaagaaatattgcaggtattacacattctcctacatcaaagcaaaggcactccaagccccctttttaatgaaaagagtttttagcaggtgggaagaaaaaaaaaaaaaagcacttgctcctgagatgataaaaagccatttttcactgcaaaattattaaattagctgtaaggagttggagtttgtatttggcattccttctcacctcaccccagccttcatctctcattgcatttttgtggaagggttatagatatactctaaattgttgacctatcatggagacggtagttagtctccaaattccctgtgggcaaagatgattgcagcctccctgctaataagtacacttcagttctatgaaatttatacttaaaagaaaacaatggaaaatgtggcacaaacacattgtcatatttacgcagatatgttgactcactgttacttaagcgtcaatgaattattcagggctcaagatggggataaatattcagggaggtaactgcactcattctttatctgtttgtgttattcgggtttttacttggtttctttatttttgcttttttctcatatgagaagtgttcagatgacagcacatccaacaacaaaattcagcccccatcctataaaaacgtcctctcttagactgtcttgttagttgtgacatattttattgtaaactaaaactaactgggaattgggttgtatttattttacactctcactcattttatttatttatttatttatttatttatttatttatttatttatctgttgagacagtcttactctgtcgcccaggctggagtgcagtggcatgaggcccaggttcaagcgattctcctgcctcagcctcctgagtagctgggattacaggcgctcgccaccacacctggctaatttttttgtatttttagtagagacagggtttcaccatgttggccaggctagtcgcaaactcctgacctccagtgatccgcccaccttagcctcccaaagtgctggaattacaagcatgagtcaccatgcccagcctctcttactcattttataatagatccagtctttaaagaaatataagccatttgattgcccaattatatgttgcaaaaaaataaaaatgttgaaaagtgtcccttccagtcaacagatatttattgagcacctactcagtgaagacactgttcaggatgcccagaatacaggagtgaacaaaagagacaaaaatgcctgccttttgaagctgacatttgagttgcagaggtgaggggaaagtggtggtggatctaccctaacatttgcgttatcactatgtgctcaaattcgtatgtgtatgtttcccaaactggtctcatcatcacaaacacacacatacacacacctttaaggttatactgctgttatccacgttttgcaagtgagaaaactgaggcacagcaaggataagtaatgtgtcagtcacccaggtagtgaatgacatgtccaagactctagcctgagcagtttgtctctgggatctgtggttttatggtaactaaaaccgccactcatggctagacatggtgggttgtgcctgtggtcccagctactcgggaggctgagatgggagggtgacttgaccctaggagttcgaggctgcagtgagctatgatcataccactgcactctagcctgggcaacagagagaaaaaagaaaattttttaaaataaattaaaaaaaaaactgctgcaccctattaacaattattgtggcaggtttttagtggcaaagaattctgaagtactttgttgagtgctcccacctaggaaactagtcttttacctaacttggcactttatatcaaccacaaccacaatccagcagtttccataaacagaaaaattataccatgactacttatgtaaagctatatgtaaggctccctatatatttatgtaaagctctctctctctatatatatatatatatggtttacatgtttctcccagctaacctttccatatatatatatatatatatatatatatatatatatatatatatatggagagaaagagagagagagagcttaggcagataccaaccttgggtgggaatctttcacatccttaaaaaggtttgggcctatctgatggccttgttgcgtcattgccctctacgtggctggacccagagcaagggccatttccagacagtctccaccagcccactggattcacctggctcctcagacctctgcctcttccatttccgtatgacctaatcacctgctgtcttttgatatattaagattttgtgccactctcctactgagatggaccttaaatcctcatgagctgatactgtctcgtctactttatgagaaagtatagcacagtaattaagagcacagcctctgagcatgtcagctaggaccacttcctagctccatcatttgcaagctgtgtgacactgagaacgtcacttgccttgtctgaccctcatcttcttcatttgtaaaatggagacgatactactgttgagaggaatatatgagttaacagatagaaagtaattaggataacacatgacacctagttgatagtatataaattatatttatcttttttttttttggcatcttccctctccacataatctcgtctcaactgcagggactacagttaagtttaactgggcttactaggcaagatgtggtactaaatgggcatctagtttaatgtataaaacacaatctctgtaagttttcctctattctgcctccgccacagttgtaagagagagacatttctacctccataatggtgtagatgattgaatgcaaatggcaggagggcaaaaaaaaaaattaaatgaagtaaatgaaaatgagctaaatgtttgaaaatgagctacatatttaattatattaaatactgtatattataccctgtcccaagagtctgagtcatcatttgaagggtaccttcccacaaccagccaagctgggaaaagataccccaccttatagacactattggctccctccagcctttcgaaaagtcttaacaaatactaaatctgcagactgcatttcattgctaaagtcttacaaaattttagttctcagcagagacattagtatctttggggaaaaaaaacccaaaggaagagatccttctagttttgctcactcattaaaaatgtgttgaataatgaatgaatttggtgtatttgtgtatacatgaagatgtactcacgtatatgcatatatagagaatatttgccaataattgttttatatatattctttctccatttttactgcctgaatactgaaaacaaatttcttgacttaattctacaaggcaaatatcacataatctgctatgccaaatgtcattgataaatcatgtatttatctgtgtgaatgtgttccaacttttaaaattagaaactacatgttctgtttatactttctctcactgatatatactgattattagatgatttgaaatttagttctaagtgcacatttctgcatatcctgcagtgttagcaagataagaacttgacttatttgtccatttcaacaaatattttcagtacctattatatgcctggcataggccctgtggatatcaaaataagtaaatgctgtcttgccttgagtagtataatattgcagcatagctcatggtcctggtaattcttgaggttaatgtgtgtgttaattacctatttataggtgtatccattaatggaaaacttcccaggatctactaggcatttaaagatgggagagtgagcttgttattataaataaattaagccaaccatttacttagaattttttatcctaatttaaaatacagataagattatatgacttttaaaaatcatcttgaattactaaaatacttaagtgaattgcaaaatcaaaaaggataatttcgttttacacttatttctattatcagcatttgtagaaaattttacacttcttatttcctagtttattcagaaaattccaaggctgttcactaaaaaagttaactgattttgcaagtaatctcatgagctagcccaccctaacagaaagggaccatttttacaccaggacaatgtttctcccagctaaccttgtttctggagggttgtccaagtcatccccagggaaacaacgtaaaagctacttcagattttgtgggtctcttgggacacaaacaccatacacgtgcctatatatgaccgtcactcacttgggtagaggctagcattgtcaggacagatgcaggtctgatttctcagatccagcaacttcaatccttggaatattagattaactctctcagcctgtgagaggaaatcaaagtggtggcagaaataatcccggagctcagactgaaatcatttcctcatgagctttttattttcatcctctctggtttccaaaactcaaattccttacttagtatctctctaaagcctgagtccttagtgtaaatgactatttcctttactctcttttaatagaactcaagattggccgggtgtggtggctcacacctgtaatcccagcactttgggagggtgaggcaggcggattacctgaggtcaggagttcaagaccagcctggccaacatggtgaaacctcgtctctactaaaagtataaaaaaattagccgggcgaggtggcaggtgcctgtaatcccagctacttgggaggctgaggcaggagaatcacttgaacccaggaggcggaggttgcagtgagccgagattgcaccactgcactccagcctgggcaacaagagagaaactctgtctcaaaaaaaaaaagaactcagtttctttttctctattgcttcctacagctaatctatagcaaattacataccttgtttgattttttacctattcactcttttaatctgagccttctgtctatcctccttttcccacatctgtcctagatccattccagttgtgtgactattgcactgctctttcctatttcaaacacaatatcattaggaataccagtatttatttacaatgacaaaacaactgagttttgtaattacataatgtcagtttatcaatatataatatccacttcctacagtcagaaagaggaacagttctatcatgtacaattatgatgggaaaggtggaatgatcccttatgcagcaattttaagtgagttcatgattttaaattacttaaaataagtgctaggaagctcccattttcaaaccctttattttcctggcttaacagaggaataaaatgctatttaaatgcacaattccattctaaaagaatggattctgttaggaaagaaatttaggggtagctctttcatttaaccaagcagcttgatagcttctgtatatgcacaggttggcctggagctgagtttgagagtaaggaacagagaaagacgaattactgtgtgtattcatctgagaaacatatggagttcctgcaggaaatatgagaggaagagaataaagaacaataatgagagtgagagcagtcagcaagatcagagtgctcagaacatatcggaagccagtaaaaaattccaacgccccccaccccccacccaccaaaagaaagtttaagaacagagatgcctgcttttcaaattaaaatgtttatcattccagctccttaagctttccttgcctcccccaaattaccagtaaaatctcttagcacagaaaatctttgtgtgagtgaaattctgtgaaaatcagaacaagaagctgagctattggggtccacaaagcaaagaacaggtatagcccaggcaagatgctgggatttgaacttgaagatggatcttagagccaggagttaccatgagaatttaagcccctgaaaattcatagacatcctgcaggtctttaaactttccataggtgccgaaatgaaaaaagttggtccagtataacccagtttttgaggatacccgctgatacgtgtactataatcaaacatcggtttgtcactgtcccacttaaaatgtgagggctaaaactaagcgcaaattccaaatgatttatttccagcacagagaagaagttgggacctctcttatttcctgaacctgattatacttctatggatactataaagcagcctaggtttacattatgtatttcaatccatcacatgctgatctcatagccacagatttttttattcacatgaacaactgtcttctctccctgttccccaaagctgtatttcataatttttttaaagtaatctgaacttaacaccttatatttttccctattaaattttaccttttgggtttttgtggccagcattccaacctgttcatacattttagagttctgattctgttaccccttgtctcagctgcagatttgatccatctgcctttacctgacaaggggttataaggagccgtggacaaagagaaagaatacaaatctcaagccctggaccgtcgccccacacgcctactaactgggtgtgtggcaagcacccggccagtgatttaacctttcagaaactaagtttccctgtttgtaaagtagaaaagccaatttctggcaaacttgcctcaggttattaggaaaaccaagtggggagtgtgtgggagtgtgtgtgttgtgtgtgtgtgtggccagcataacaccgccaataacaccacaatgaacgtggagccctctggggtaactgtgaagatctccttccaggccaggcatggtggctcatgtctgtaatcctagcactttgggaggccaaggcaggcagattgcctgagctcaggagttttgagaccaccctggccaacctggtgaaacattatctctaataaaatacaaaaaaaaaaaaaaaaaaaaagccaggtgtggtggcaggtgcctgtagactgagctactcaggaggttgaggcgcaagaattgcttaaacctgggaggcgtggccaggcacagtggctcatgcctgcaatcccaggactttgggaggccgaggcgggcagatcacgaggtcgagatagagaccatcctggccaacatggtgaaaccccatctctattaaaaatacaaaaattagctgggcgtggtggcgtgcgcctgtagtcccagctacccaggaggctgaggcaggaaaattactggaacccgggaggcggagcttgcagtgagccgtgatcgtgccactgcactccagcctgggcgacagagcaagactccgtctcaaaaaaaaaaaaaaaaaaaaacctgggaggcggaggtggcagtgagccgagaatgtgccactgcattccagcctgggcaacaaagagcaaacaaacaaacaaacaaacaaacaaaaaagtctccttcaggctcagcacaattaattatccagcatgtgcttcttgaacaccaactacacgtcagacccaaagtgttcaacataaaaaaattaatgagacaaaaggatcttatctaaagccattaataagaaattctaaaagattgaaggggagagttcagtcaccaatgaggtaatatttactgttaaattttattgctctgacttaaaaatggaagaggctcttccttactttttttcagatgaaaaaaggaaaagagatcatttccttctaactcaggaaaaaaaaaaaaacagggaaacactaatactctcagcagatcatattactcctaaattatctttacacttctttgttttctggtgtacacaaagaaaagaagcaatgatttgagatgattttgaagacaaagttcttcccaatgactagttaaatctaaagagattccccaaggctgaatctcagaagaggctaataaaatactgatatgagagatgagagagtctggcgaaatggtctggtgtggggcctgggcattatcagggaaatctaatgcaagtcctaggtgagaaccattgtaggagagacaaagtaaggagagttgaagttcaaagctctggggaagagcatcctatgatataataaaggataataaggatatacaagtcttatttttaaaactatcttacatgtttcctttgaaaggttgctttaaaattattaccgtaaatgattttattcttgaaattaacgatttaaatacaaatttgaggagcgtggtaaataatatgaaagttgcagactgggtacagtggctcatacttgtaatcacaatattttgggaggccaaggcaggaggtttgcttgggcccaggaggttgttgtagtgagattatagtgagccatgactgtgccactgcaatccagcctgggtgacagagcaagaccctatctctaaaaaagaaagaaagaaaaaaaaattaaaaaagaaagttgctattaaatcttgaggaaaatataattatctcagaaaaacaccatctgatgatttaagccaccatctgacaatttaaatcacttactctctataaatatttaaatttccatgtggtctgctttttgagtgatgaattttctttttttacaaagatatcattgaaataattaaaattgtcaattgattgcaatgtcacacttctcaaaaaaaaaaaaaattagtattgcagcgtctaaaccaaaagcataagggcagtgaatgcaaaacagatgttcatctcggtgggtgttcaaaacaattttttaaagtcagatgtctctgtatatgtgtttgtacagcctcaagacacggtcttaacagtttatatatttaaatgctcactcatttgatataatgtcaagtaaacaagatagcattaaaatcaactactcaattaatttattttttccatcctttatttctacggatttttcaaacatctagtactgaaggatcttgacatttttaacccagtacattccctccctcttattaatacttcacccaattatcttttttaaagtatcctatttagagggaagctagagcctataatttattttaatattctggtgagagatgagaaacaaagatatccatcaaagggctatttaattttagaaaagttaaccagccattagacattcatgggcaatagttcaaggaacaagaaccacaaaaaaaaaatgagagttagaattgaagaaacaaatctttaaccctcagaaaaccaagaggttttttaataccttattttctatagtagcatttagcaaaaggcaatgaaattctatccccaaaatgaagaagtttatgatggttctgacaataattcatttatgtagaattatattatttacactttcatccatgttgtctcatttattcctcccaacatctttgagtaatcattttacaaatagaaaataaatctgagtaatttctccattagccatagtgaatacaacacattaggaaattaatgccaggttcatctctctcaatgctcagtgccatttcccctgtatcagcaaatacttaggataactgtgggcctgggattgtggagggattggaactaaagcacacttaataaaaaggagagaagagttcctcagggctaatcctaagttaaaagggatgactttactttgtctgagtcagtgcaaaactacatttttttttatcaaaacagaaaacgaaaacaaagaaaaatggtaagtgcttcaatcataccatccaaagcagagaattaccatattcaagtcatggagctcccccaggcctacaagtatttgagttattctagttctctgttcctctgggataaaatagaataaaaccctgcaagactcacagggaaagccaaatgtggaaccgaagcaaaaggggcatttttggcaaaatgacaaaacacagtaagcctctataactaatctggacttcaagctagagatatttatgagcttctaaagagccactgggagagtctccccgtgcccagtgcccacctaaacttctgtagttacattcctcactcactatgggggcgccctctttgggaactttgctaatcaagctgggcactcaagatcaaatttttgctatacaagcaaattagtctcacttatagggggtcagtatttcgttttgtctctttagagacatatgttatgaatccctcaattactaatttagttttgcttttcagtttgatactctgcccccaatccatgttctttcattgaactgtaatgttttactacttgtcattatttttggaaaaacagtttctaactctcttgttactagtgctaatttgcataatttgaattaatggagaatttgccaacacttacgtagcttctacaaagtttgcagttgcttcaagaattttcacattttataaatccagtgacaaagtttagagttatctatgcactgtagtgtatacccttgttacattataatttttatacccctgaaagacttattacaaatcacagaaagccaaaatcattgtattcttgcctgaattgggtagtctgtttttttcaatttctcttaatttgatgaataaaaaataaatctatttttatgtgcatttttgaatatgaattatattttcaaatgtttttattttctctttcgtgaattgtttgctcaggtcttttgcctattatttcagcaatctgaggaaactctagggcaaaataaggaagctgctagccacattttataacttgcttaagaactggcaatgacagtttatcaggattttatacataaggattccaggagtatacttcataaccacaaacttgggagtcacaattcttttattgtgtaaatggtagaattcctgagtgcttggtgcattagttattaaaggaaataaaacaaaatttcaaaatatagtaaccatgaggactaatttgttacctactctttgtaaaggagatatcaatgtggataaaaacaaacctgggggtacatatattaagactttcaaaggcccttgacaatagtttagaataaaaatgatgtttcatttttttttaacattttataacttgtttttttaaattaaaaaaaaaacaaaacaggcaatgtgaatcatgtatttagagcagcttgtccatggctagtgaactggcttggaggtagcaaaccaaggacaactctccactaaatgaagtaaaattaaacactcgtgttggcttatgatcagtgctggaaacatctgactctgatattatagtgtgatttggaagagaaaattcacgatgacatttccaattttcagatgacaccaagtttttccaagtcatgacataccaagtcaaattgggaaggaagatagaggaagctcccgtgagtctttggttttgaggtactactccacaagggtaaacctttgagatgtatacattaaatacattaggtaaaatctttgagatttaccctataaggtaaatctctagtgtcattggcccaatttaaagatgtgaaaactgagtctcagagatgttagtttaagtcacccaagttgactcagccagtaagtgaggagtttgtatttgacatcaatctaaataagagcctatcctttactgcccccaatgtgagagaggaaggaatcacactcatgaagggacccaaagccaacgtggggtgaggggagggcaggaacctgggaagttggattcatttggttttttgagttggtgagaaacaagcaggtatatttaaatgtggggaagtatgaagtgatatttttaaggaagtccagtgctgcaggaaaatgaatccctggaatccatgagctttcttataccacttactggcaacacaggctctaaacactaacctgccagcaacatcaacccagttcattagctaacttttcctgtttggaaacacaatggcaaatattatcctacccagtacaaagccataaccccctatacaggaagaaagctgtggaaatctgaagtgaaattttaaaattgttatatattcctatgtatttaatatgtgggttttttggggggttttcttgtttgtttttgttttgttttgttttgtttttgagacagagtctcactctgtcggccaggctggagtgcagtggcatgatctcagctcactgcaacctctgcctcccgggctcatgcgattgtcctgcctcagcctcctgagtagctgagactacaggcgcgtgccaccatgaccggctaattttttaatttttaatagagacagggtttcaccatattggacaggctgatctcgaactcctgacctcaggtaatctgcttgccttggcctcccaaactgctgggagtacaggcgggtgccaccacgcccagacaatatgtgttaagcattgtgctaatacttcatatgctgggcaacatccaacaacctataaccctacaaacctataacccaacaaccctataagataaatctctagtgtcattggcccattttaaagatgtgaaaactgagtctcagagatattaggtaagtcacccaagcttacttagccagtaagtgaggagtttggatttgaaacccatctaattgaaaacctattctttactgtccccatatgtaagagaaggaaccacagccatgaagggactcaaaacgactgtgaggagggcaagtctggggaaaaaaagccttataatgttgtaatggctctggtaaaagtctgcaaaaggtagagatgggtgaagttaaagcaaacagagtctaagtccaagataaggtaattcatttataagagtcattaatgcaagtgctacaattgaaaattttttaacgtaaaatgtttaaactagtaagtgacatatttgcaatcagtggattcagaaaaattaagttactggagagaatattcctgtgcttgggttggcactaaagaaagataactctgtctgcctacaaaggaacctgtggtattgctgtcagaaaaagaaggctggggtgaattagactgaacgtttgtgtataatgattcttaatctgtacttcaaaaatgtatcattagacatgcagatatgtttacccatttttgttgttgttgttgttgttgttggccttgctttgtttttttggactgtttttccttatgtctaacttagattctgataagcaccaagctgcttccctacctgagtgccttggaatatgcatttttcctcttactggaatgttctttctcctctccctcctactaccattcaatggagagggcttctgggtagggtaggggcatcatgttatttttatttgctgaatcagggaattctacattctggaaggaaacttctgatatttgtgacaacggcgattttaaaaactgttcatttaccacatctttccctgagtccaaggtccgtggcagcagagaccatgtctgtccagcccccactgaggccagcgcagtgcctggcacacagggaactatcactaagccctggttcaatgccggacatccttcggcttgtacatgaagcccggtagctctgttttatgagggtaggaaacatctggtcaccattgtttatgaaatatttgccacctgaaaaaccattattattaggtcattccttgttccttgctttatttttctgagtttttttctctccattaagaacatatttcctggaactccttattggcaaggaaagctaactcactttttactttctccaatacccttattgagtttctctcttactcttcagaccgccaatgattagtggggaaatctaccaatgctggagcaaagacactatcccatctttaacggggagaaatttgtagaaccataaaactacagcaaaagtgttgaacacctctatgtcagccaatccgtggtcaccacagatgttcatagtctcacagcaatgcatgttacctgtatttttagaattgtttaaaacaaaagcgactattattatttaacaagttgtaatgctgacatggtaaacattaaaatatttgaggctaagtacgctcttaatttttttaaaagatttttgttatggagcaatttgaaagtctttaatgctccatatataaagaaacctttttatattttgctttatatatctttcgtttaataatcttgatttcagaatctaccagaatttaattctagagccctccaaaataaataatcagctttcaggttatctcaacaacttcactgatattttaaagaaaaacctatcatatttatactatttacttttatactatcatgtttatactatttatatttatactattcatatttataccaagatacaaattaaaaacactggaacaaaatacattaaaatggaaacaatgtttgccttcgtagggcataattttgagtgattttttgtttctatttttgtatttttatttgtatacgatgagatttatatgcaaggagaaaaaacaaacaaaatattcaattttattggagtccagtcttctaatgaagtatgaaagaaagaaacatgtagatctactattattaaagatttatacgaatattaaggatgttccctggggtgttttccccagtgaattgaacttgtgaataagtcctaagtgccagcaatgaaagcgaagcaggtatctgtcaaggctgattaggaacggagcatagagaatagaaccacagaaaccaaagaagactaaaactggttctaagggttgaggcctgagaaaaatccataccaggttccagcctttccctaactaaaaaggaggaagatggctgaatctgcctggtggggagaggggtaatttgctgcaggtggaaccactttattcagacctgagcaccgcagcgagccctctgtggacccgctttgctgagaaaacttgctgctccctgggttctatccagagcagcctggcgattgtgttctaattttccttttagatagctgaatatgagtattagaatgaaagatctgatattagcagatcaatcatctctttctccactttctgttacacaattaaaccagcaggtgaggcagagtgccgcaaaagtaagtagaccagctgttccatttcagaatagacttgccaagcataacacatttagaaacaaaatgcagttcattccaaagcagttgatttaatccctcattatccatttatgtattcagcatcatggcccatcttgacaccttattaataaattattcaaaagcttacctctggatagcatagttgttaagacctagggatccagtcaaaaagagggatcgattgcaggctcagatgcaaattaactctataacctaagacaccctatttaaccttcttaaatcttcatttcctcatttgtaaaatgtgtatagaaccaccccgaagttccgggatcatggattagagagagaaaaggtttaagacctcttagcacagcttctaacacatagtatagtcagtgttcgtaaatggagttcatattaataccctttttttttttgagacagagtctcactctgtcgcccaggctggagtgcagtggcgcaatctcggctcactgcaggctccgccccccgggttcacgccattctcctgcctcggcctccagagtagctgggactacaggtgcccaccaccacgcccggctaattttttgtatttttagtagaaacggggcttcaccgtgttagccaggatgctctcgatctcctgacctcgtgatccgcccgcctctgcctcccaaagtgctgggattacaggtgtaagccacggcgcccggccatattaataccttttaaaatagggaccagaagttgaagaagaagaagtgaagaaaaaggtaaagtgttttccctcttccattcacatatatttttcattttttaaaaatgggctttccggaagtgaaactcctgtaccagcgaagcaggatgctttcaatgtgtgcaaatcaacctcttggtagcctgccttttaaaagctcaaactatccatccccacacaagtctgggactcttaccctgtgttattttttaagtcatttaagtcatgcttgagaggaacatcattgttactatcagtcttaacatcttaattcaaaccagcctaacaaaaaagactgagaaaatatgaaagtacagaaatttgtgctagagaaaaagatgggaggaaaagtgtcacaccttggggctgccccgatgtctctttgcctcttaggtgcagggtactccatactctcgtgactaaggcatgaagcctagaagaagtggctacttctgcctgtggtttatagccctactttattctagacagctccctgcacagattagaaggcaggaagcagagcaagtgttcctgtaatcagcctcccccgggaactgtcagtattcaatgggctctcaactcacatttccacttgtttttgttttgttttgttttgttttgttttgagacagagtctcgctctgttgcccaggctggagtgcagtgacgggatcttggctcactgcaacctccacctcccggcttcaagcaattctccttcctcagcctcccgagtagctgggattacaggtgtgtgccacctcatctcagtaatttttgtatttttagtagagatggggtttcaccatgttggccagtctggtctcaaactcgtgacctcaggtgatctgcccatctcagcctcccaaagtgctgggattacaggcgtgagccaccactcccggcctccacttgttcgttcaatatacgtttgccctatagagttccatgcatctgagaatattccaacaaatcttagaccatttccaagcaacggatccctattgtactatttcttctatttctctctgtaagcattaactttgaaactacagccattaaatcatattcattagttcattccaggcataatcaatatgttggactaggacaactcaagaagtaaacaaatcataatcaattcctcttgtcccctacccctttaaacttattccattggactgcagtaatcttcctgtgtcccaatgtggaaacacatagacactatccactgttacgtaaggtgccctacatgtgcattaaatctcaagcacggtctccttcagtagtaagaaggcctaatcccatgtaattctcaaacctctgagcttgttgtggtatgagattttctcccctaccccagttaggacctacttcaggcttgagtcagctgtgagcagggggattccctcctgctgttaatctctccctgctcacccctgtctgtgcacttcctaccagcagggatgtgggaaagggagggaaggtggggagataggacaatccttacttggctgggtagctttgctctctctggtcctggtgatggctaaaaccagctctttttctcattgagtgctttgtaggctctacagagcctatgcagagcccttcgtctcctcattaccaatggccatttgggactccttcctcagctcctgcaaatcagttcctcatcttcagcctttttctgatgaggtcacctctcacccctacgggctactgtgttgtaccaacagcagctccatccttcatgtcccatgtttactcatcccccagctctggcccccaaactgcaagtgaaaaccagtgctggcagatcagcgcttccctggctcctccacacaaaggcactcagatctcctttcctgtgaaactttccaggacaggttagaccccagtccatggtacactttacctttctcaggcaggagtcaggcgccagccctctgggtatcccacatgcaaggaaggcatttcaaagcggtagaggtggcccttcctccatcaccaggcttatggtttggagataacacccctccctcagctctttcacaaacagaaacgtgcctggcagcagctctctccaagtgagtctcttcaccagcccttcttccctctccgaactctgaccactttttatatccttgatgcgctgaagggcccaagagtcttggaactggtttttaattcctttctttgaaaatccaaatatatggatctgtctcagatacacgtgggtacccattatccaccaccatgcttgtgcttccattgaagcagagaccagaggagccccattctaacatcctgttacataagtgaaaatggaatttctttggaatgccatttattgtcatggtgccaggagttcatcataatcaacattacaaaggaaataccaaaggaagcaataatgatttgccatttattgtaaaacatgacctaggtgtgtcttttttctctgtttataaaatgacaaggttcaaattataatgtaactttccacatagcaattgaaatcacagactgagaggttattacaggactaggttggaatgaatagattatccatatgatttgatttaccctaatatagtttcttttagttccaacatgaaatctcccccttttaactcaccctgaattacaaatgacttaacagaagcagaaatattttctctggaaaaacatagtaaagtgtaaatggaactctggatttttagccataacaagatttttacactgtatttcccccgatgtatctgccttaagattcttcagtcacttcatgttgactgtttagcctctgaaaactctaattagtttaacaagttagccagccaacgccacagcaagactatacacaaatagagaagatcaggtcagttttgctgaaaagaaggatcattaaaggtacagagcatgagatattgacccaacccttctgataaatgatacagaaactatttgctcatgaacgagtaaactatgcccccaccttgacactgaattttaatcactagaaatggaattatatcaaaattcaaacatagctgaaaaattttaagataacatgtttaaatatgcacatttcaagtaaaagaacattattatagtgataatatcagagccatttgcagagaacttttgagtcttatcaagaaagcaatacataggctgggtgtggtggctcacacctataatctcagcactttgagaggccgaggtgggtggattgcttgagcccaggaggtcgagacaggcctgggcaacatggcgaaaccccatctctacaaaaaatacaaaaattagccagatatggtagtgtgcctagctactacaggcacctgcctgtagtaccggctacccagggaagttgagcttgcagtgagctgtgatcacaccactgcactctagcctgggcaacagagtgaaaccgggtctcaaaaagaaagaaagagagagagaaaaaaaaagagaaagagagagagagagagcatgcaagcaagcagtatataaaccagtgaattttacctggcgcttttaaaaataatatttgagttcatatgaaattcaaatagcatcttacaaatttcaatgtatatttcctagaagtaattcaaggtaccctcaatatatgctgtcaggtagagtataaaggggtgtaatgatcaatgcagcaacttcatgacagacatgagctgaaatgggttgtagaatgttctttctgaagacccataattagatttctagcttgttgttcaataaaatagttcaggtaccctaagtgaagtacatgacctctcaaacaagaaaactgtctcattctgcaaggccagttgcttgcttttcacagtgacacccatcaccttactgaatcctttaagaatgaagttcttcttgtccagtaacactgcagctggaaacaaggcagacgctggaaagcactagaactgtgcacaatgttgacagtgtaatctgaaactactcagcagttcctagtatcaggttcacacataatttgaaccagacagatttcttttgaaactttctcttaaaagtttcatttaaattggaagacgaagagtatgagtatcaagaaattactcttagtaatccaaatgaattaaatgatcctaaaatgatttaagtgattcatagcactttcccaagcagtctctgtccccatagtaccggtttctgtatcaagctgtcaggagatcagagaagaagctcattaacccagtcagacatgtattcaaccaacatttgagttcctagtaagtgccaggtactgtcataagcaccaaacctattagttttgtggaaggcaggtctaaccctgtctttaggaagctttaacccttatatccatattcacagaaagctgacctaccagttgaatgcccactctggatatgggcaaatattttattctatttttaaagtgcatacatacacacaagtactctagcataactaagctgttggttatgatttatttgctttgaaaagcagagttgcctgcaataatagaggaagcactgtcagtggaaaagtaggaaaacacatctgcagtcaagagggaggcatttcagtgcctgttattatgccctggagccaagatgatgacagtgagacatgagcagccctatatcaacccagttctgttgggttctgtgctctgaggcctccctggatgcagtcaaggataagtcagtgaagcccaaatcaccaccaagaccccttcctttcccaaagttgctatagacagatacactacctaataagggctaataagcagacgaccaattttctttttttttctctctctctttttgaaacagggcctcactctatcgcccaggctagagtgcagtgccacaatcacagctcactgtagcctccacgttctagggttaaacgatcctcttacctcagcctcccaagtagctgggactacaggctactacagagaatggaccattgtgctcagctaatttttaaatttttttttggaaataggggtcttgctatattgacttggctgatcgtgaactcctggcctaaagtgatccacctgccttggcctcccaaagctctgggactacaggtctgcacctctgtgcccagccccagatgaccaactttcaaaaatccttttcaagttagaaaaaatatattcaaaacatattcatacgcttttttcttaacttatttttcttaatcttcattcatgcatataactcacagattattcaaacttctcttattatttttctaaccctttaaagaggatttccaaagcttagctttacttgaagtagagtggttcccatccattgatattcgggggaagtagttcatctgaaatgaggccagtattgagacttcaacatatataaacttaattatttcaggaggaatgtccgtgggaaaaaaaagagctaccgtgacttttccctccactaatcaacagatatttccatatgataataatatttaaattacatgtatttgctcagcactttacactttacaaggcacttttacagacattgcctaaatatttattctcataacagctggattattatctacaggtgatgaacttaaaactcagagaagtggaaagattggctcaaaggtcacaaggataaaaaaaaaaaaggaatgcagacaccgtacttctaattctaagcctcttttcactctatcaaattaccttccagtatgtgccatgagtcataggaagaacatcatttctacagtcaccgaatatctgttctgtgccttttatatttctggcactgtactaggtgatttacatatattatttctaaacctaccagtgtttaaagtagcaaacaaaggcacagaggaggtaagtacagcctgagattcattcattcatccatcattaaagaagttcaggagtaagtctgtgttctaagcactggagatatcgctatgaacaagacagattaggtttctgccttcaagtttatgtgctggcaagaggaaaaagatagcaaatacataaacaaataagtaagtaatgtaattttaaatggtgttaagttcttgaaaaagataaagatgcaggctggaaagtaaccaggactacaggattactttaggtggtgtggtcaggggagatctccctgagaaagaaatagttcagctgagaggaaagtgttgctggaaaagaaaaccagtagagaaaggcactgaaatgggaatgagacaggcatgtttgaagagagggaaggaggccagtgtggctgaacatggagggtccaggaggtgaccctgaaaagaatggagccgtgtggggactctaggccgtggaaaggaggttggccctcattctaattgcaatgggaagccattagatgattctaagagagaagagtgatctaagttttgttttcagaagatgcctgcagctccatcgtttgtgtagagaatggactatatagaagggtatgtgaaaggcaagagatgagtgaatccaaacggaaaatagaagtggagatggtgaaaagaagttggatttgcggtatatttttagagagagagctggaagaacttcctggaagattgtttgtggggagtggcggacagaagaataaataatgatttggggcctgagcaagtgagtggatagtggatctgttagctgaaatgggaacaactggtgggtgggcaggtttcacaggcaggtggttgagaagacagttggtgtcaagcttctgttttagacatgttaagttggagatacctattaggcatctgactagtgatctcagagcagttgtacgtaagaatctggagctcgggggaaagggatcagaagtggcttacataaggcagttaaaggcatgtcttttctgctaggaaatgagacttaggcagagccttgaggttctctatcatttaaagacacatagaccataaccagaaacatcatgctgtcagtcagatatctttctattacatcactccatctccatgattaaagtcaaatctcagtaaaactgagcacatcaagaaaccccaaaaatattacatataaaactatttgccaattttcctcttcagccttttcttttgttagtaattttaatttgtcttttaaatgaatgtagattttcaagtgtgacattttagcaaggtcaaactgttcattatcagttaaagtcatatgaaaaagtggtaatgttccctatttatatatataatgcattataaaaaacttttgcttgatgtgatgtgagttacaagctaagattttccaagaacaggtagttctccattatataaatctctttctcaaggcattgattgtctgtctgtgttctactaatgaccaagaattgtgaagcaactctagttctgtggaagaaaaacatttttaataaaaacttattcatatgaatttatggggtacaagtgtaattttgtgacatgcatagattttgtagtgtttaagtcagagcttttagggtatccatcactcagataatacacctcgtacccattaagtagtctgccttcatcacccttctcccagccttcacccttcccagtctccattgtctgtccacatggaagaaaatctctctgggcttcattaggatgagaagatgagagttttattctgagcctagctgtcctttactatgacattatcatagttcatagtatccaaatgtgactcacagggaattcactcaacagttactgagatacctgaattaacatttctaggtcttttgttcaaatgttaataaagccagtgcttcttagaggcgaggtgaggttagataaggtcacgtagactccaacataaccagtgtctcaagtgaggtgacctattctccttcaacctaccatgacgttagcatttcatctcttcacaattttttctataaacatataactgcatattacatttatttctttgtctacttagcaaggatctgttcagtgtctatgacataacactgttaggcacagatagaaatacaaatgaaatgcattgctcttcaaggtcttactagaaaagatgaaataatctaaaattgtggatagactaaacaagatgttttctatatatggtcgaggagggattatataatgcctattaaaattcttgactgagactaatgacagaaatccatggaggatttaaacatttgggggctaaacctatggtaataaaataacagcctatataaattacatgtactattatatatgcacaaaatgaatttctctgggatctcaaggacattaatgtaattattcatttcaagtttatatatttatgtttttagagaaaatcactatagattaagtcataggtctctacattgatcaaaagcagatccaccctcatatttgctcccataaggggaccacatactttcttaaatttaacattatattacccttaagaaaacttggctgggtgcagtggctcatgcccgtaatcccagcactttgggaggccaaggcaggcaggttgcttgagcctaggagaccagcctgagcaacatggtgaaaccccatctctaccaaaaaaaaaaaaaaaaaaaattcgctgggcatggtggcacatgcctgtagtcccagctactcaggaggctgaggcagcagatggattgaacccaggaggtcaaggcagcagtgatcctgggaggaaaatgagaccctatctcaaacaatagaaggaaaagaagctttagtctttcacttttttttttctgaccaatgccaccaacaaaagcaactattcctgttcaaacttacattcattaaacaaatattcattgaatgtttattataggctagatgtttcagtagcctctggggatacaaggggatatttagagaccattccatgctctcggcacaagtaattacacatgtgatgagtgcagcacagagctgggggagatgcaacacctctgcaggaggcttagagataagtcaggaaggaaggtgttccagaccaagaaaaccaaacctggaggtaagaaagaacacggtgcattcattcagctaaaacctatccagcttgacttaagccagaggagctccagagagaggcacatgaggagactggggaggtcaggtggccaggtctaatgtcatctggaggtcaagggaaagccaggaggtcctccagcaggaaaacacaggtgcagatttacactccgagaagaccactcctagaagctcaattctgcttcatggtattactagtttattagtgaataatatactttacattgtcaccatcaccccacttcatgaaaaagaagagctcataaaaaagaatctgtattgaattgaaaggtaaagctgtcataattgaaaagctgattccttgtcatatttttttaatgctccatgaaattttatagccttgagaaaattttgacttctaaatctagccaaataatgctagtggctgttgcagaattagtgtgttttgtgttatataatggtgtggatttttttttcttccttaaaatactcttagaacttttgacctgtcctgtgactgaattctggatactattggttataatagtgcaaaacaggtcagagataacataggataaataatatagtctcttagcacttagccaatctctttggccatcatcccacagaaaatattcttcaggagtgctaaggtatcagttattagaaagtaatctatttttagaaacaccaaactcagcttaccttcttttctagatttagaccttgttttaaagaatacaattctttcagtttttcacagggagacatttatctatactaatcaattccactaatttatttatttatttttaattttgagacagagtctcacagtatcacccaggctggaatgcaatggtcgatcacagctcactacaaccttgatctcccagggtcaatcaatcctcctacctcagcctcctaagtagctggagctacaggcatgagccaccaagcccggctaattttttatatttttgtcgagacggggtctccctatgctgcccaggctggtctcaaactcctagtcctatgagttcctcctaccccagcctctgaaaatgctgggattacagggataagccaccatgctcagctatctccacatatttatgtcatggaaattgtactgattcttgagtccatgaagagtccatgaagatacaaacatgttctgttcaataaacatattgttgttagcatgcttctttctacagtggcgtgaggattaccatctcattattttcctatactcttagttttaaccagctattaaaataaagtgctaagcagaagaaatctgcatattaatataaacattgggctcatttatttgtgtgtttttcatgaacacatgatgaggtgtttctggatagtgtggattggtcaggcccaacagagatcagcaaatgcagtgaagccagagatacaccagattgttctttcaaaacttcctcaggaaacatgttgtcttaattgaggaggcaacacagaaaaacaactggaaccacattctgcagcactttttctagctatgagcatttattaccttacttgaacagtgagttgtctctgtagctccattttgtaagtagccaaattttagtagcatcatgtggttctcacatgtttgagttaaaaaattatttttataaaaacaaaaatagacaaataagatttagtttaactaaaaagcttctgcacagcaaaagaagcagtcaacagagtaaacagacaacctacagaatgggagaaaatattagcagactaggcatctgacaaacgactaataattggaatctacaagaaactcaaacaactcaataagaaataaacaactctatgaagaagtagacaaaggaatcaacagacatttttcaacagaagacacacaaatggccaaaaaacatatgaaaaaatgctcaacattactaatcatcagagaaatataaattaaaaccacaaagcaaatggaaagcaaaattgtggaatcaacctaagtgtccaatgtccatcaatggttgattggataaagaaaatgtggtgtgtgtgtgtgtgtgtgtgtgtgtatgtagatatatatattatacattatatataatatatataatatacacacatgtacaccatggaatactactcagccataaaaaagaatgaaactggaggccattatcctaagtgaaatgactcagaaacacaaagtcaaatgctacatgttctcacttataagtgggagctaaacaatctgtacacatggacatagtgaatggaataatatacaatggagactccaaaaggtgggaggatgggaggggggatgaaaaattacctatcgggtacaatgtacgctatttgggtgatgggtatactaaaagccaagactgtaccactacataatatgtccatataataaaactacatttgtatcccctaaatctataaagttttttaaaaaagaagtgattttaaaaaatcaaacttttccattggattatctattgagattcttttcaattatctacaaatatttttcattttagtttttaaaaatactctaaataaaagctgaaatttcttactattctaggccagagtttaaagcaacatgggcccttttggttttatgaatatattagtttattagtttttatttctattagtaaccaataaatatatagcaaaaaaatcattaggctttatcgacctagtgataaagagaaaattagaggtacatagataatttccatcataattgatcatttttagaaattctatagcagaacactgaaaagcatcctacttgttaagcaatttattccatttttctcatggtattgggtacactaaaaattggtcattaaaggcatattgaatattcttgttttcatgtacctctgttcattatatgaagttcaattcaggatttgaagtctttccttcacacaatcccacaaaaatgcatatggtgagtataaattgaaaaaaatagggtatttctctaaatgcaaaaagaaaaacatctgtctttaaatttttttaaaccctgcctaaattgacatgtgctttacattagtcctgtattattcaaactttcatacttatgtgtgcattatgtatgctcacacacactttagtgatggggtttgtgtatgtataaggtacctgcaaatccaaactacttcatttgaaatttgggaaatttttcctaaaataacttccacaaatatatgtgtgtatgtaggtatatatgtatattttatatgtaaatatttatatatgcatattatatataatatatgtattctacaaatgtattatatatctataaaatagtaccatggaatgctttaaatatattgtaattggttttcagagttggggtgtgtgagttgttctatattttaaggatagtgtcctttttaggaaaacatttaagtgtgatcttttagatagatgtgccttcctgaagaaggaaagactaatttaaaaaaaagaaagaaaggaaagaaattatctcctggtctggtttactttttgcaacagctgttaaaattcggacagtgacagagaaatatctgtagcagctctacagatgtttacaaaagaaaaatatctcctttacctgccttggtgagcatcttatcagcaagcacattaactcaaacaatagctactcttatctgcagaggacaggttcaggctcattagtgaagtgaactggcagccactcccctctacatagcaactggagcaaatattgttccagcccgccaagtgaccaatgagaactgagatagtgccgtggaatcttttcaatacgagtagtgttagtgtgaacaacctctctttgactctcattcgccttctcatttaatcctaccatttcaagagaatgatctcatctacagactgtaaatacttggggacttttatgaagggaaaatattacaaagggctgaagtttgcttcaagaacaacttaggtaggcacttcagtttaattactagcaacttgcatatgttgtggtatttcaaaagggctgtagtgttagtacactcattatggaaatttctaaatgtcagtgtatgaatcagtaacggtgatgatttttattattctaaaaagatctctaagataactaaaattaagcaggctgcacgttctctaatcatgtaatgaatgaatcaggattcttgtctgagatgcaggccaaatgtgctctggaactggttagtgcggcatatggtgaatctacatcagacttgacccccgcaggtttgtaactgaaactttgtataaattgaccacacccttcattaactcttctgctgcctagaaaataataaaaattgtgaagtgggactgatggcttttgaaaaatacaatcaggggcttgtgtctctttgcaattctagaagaaacgtcacaggattttaattcctgccaagcaatattgaccacgtttcctgtctcttcccttcttgtgctttttgccttgctttatgatgctggcaagtatggaagcctttatctaccgtgtaaatgtatatcgttgtaattcaacagggaaccgggcttcaaattacagcctccgaatgcaataaccttggttatttaccgagtacaaagtaaacaacttactttactgtcaaaagttttactgcaatatgttgcggggcttactactagaacaaccattcaataattgtctgtctatttaacgggcggattttatttcaaaccaaatagatactgtctttgtaaatgctgaaatgtttggtttttgtttttagcccagaagaaaattcccataaatacaaacccattctggccacctaagaattttgtcctagaagtggcatgctttctttcccttacgggttttaaaacttggccacatggtatttttaagttggcaaagtaataccttttagacacgccttcaggattttgcttaattgagtacagcaggttaacaaaagtgccaatgttcctttaaaacaaaaaccaaaatgctctgtggacttaaagctaatgctaaatattagattaaattgccaattgcacttttccatgtttatcttctgagataggaataaaattaaaatgtgttaccatagaagcatctgtaacattttatgagacaaaagatccttttttccacacaaagatccaagccaaaagcattatccattaaggaaagcaataaggctagagggacatttttttatagtcatattatggaaatactaaagatccaatgtcctgaagtcaaattgggaaacacagctgttcacattcatttttgtcctggattgacactcttggttaattcctgaatattgatcagttcttatcctccaacatccctaaaactggaaaagttttctcctatccacatttattctcaaatcacattttagggaataacaaagaggtgaatataaatctatgccttgtgaagcatttatttaggctctatgcctgacttggttttgtaatcttgatttttattctctggagcttatttctttggctctcttctttgaaaataatggcagggttctcatctaaagaaaaaacatagagagcttttaaaaccttgcagtccatgaattttctttgcatttcatcctaaccaccgttgccttctttaccattcagttctcctttctcccagaagctttccagagtttcttccctcttttccttctgcttcatttattctgcaccacatgctctaaaacttaccagttcattcatctatttactctatgtgtgattctgtgaactgtaagtagaagattctagctggatccattttaaaactaagataacttttttcccctaaacgtaagcactatgtccaagttatcaatcaaatttatctgctttgatagttgactcattacatacctgaaactggaaaagttttcttccattcacaattcttaggttagcttaatatttacgtaacttatcaaccattcaattagaagtttttaagtatatctaaggaaaaaattttaattgcaatccctgacttcatttaaattccagttgactcccaaaatgtgttacttttcacagatcgagaatttgtaaaactatagaagtcaagccactcagttctctgtattctccttgtctgttgacaatttttagcattctttagaaatctggttttatcggcagaatgcaagattcttgaaggtaaatttcatgctatgaacatcagccttccacaactgcttattgagtagactactaagccaaagaatcttaaagctttctctgtagattttaaacctgaagagaagttaatgttctgaataattctattgcctcgagactactgtagatgactgagttacagcatttttgtttataagaattatcagtgccaggcctgactgagttacagcattttttatcagtgccaggccgggcatggtggttcacacctgtaatcccagcactttgggaggccgaggcggatgaatctattgtagtatggtggctggtcaataggcttggcccttgtaatacctgaagcactagaagcttaaagcctgagaagaaaggccttgcttagtaagaaatcgacttcctgtccctcctgatacagtactcagtgcagtggacacagctttttcttcttggcagtgaaacctccctctgcacttgtcaccttaagcactgcctcatcaccaccattatagccgtcagtttgtggtatcatttttcagcactcagtgtggtccaggtactctataaatataccacatccatgatctgatttaatcttcacaataatcccatgatatagatatatttgccagatacggaaactaaggctcaaacagaacagttatccaaaatggttatgtaggaaaactggggtacaaactcaggtcattctccctccaagggccaagattctaactgctttttcacagcggtagaaaaatattaaggggaacctccaccttttgatttgctctgggttagtaaaccctttcactaggtgtggacgtttaataggcctctcaaactcaacgtgtccaaaccgaacacttgatttgatatcccccttcccaatctgttcctcatatagtctcagaaaatggcaccaccatctagccacttgcttaaagccaaagcctgagagtcatactctgttccttcacagcttacttcatcagcaggtcccattggcaaaacctccaaatctgaacacgcttcttgccacccacactgctcagccctggtccaagccatccttccacggacatcagcagctacctcctaaatagtataccttcttttgtgctccatataatggtcagagtgttctttttaaattgtaaatctgatccagacatcagcctgccaacaacccaccagcacaggtggttgtcagcaggctgatgtctggagcagatttttttttttattaatttagaacaaaatcttctgttcttaatataatctacaagtaaggcccagccagcatgttctagagtctgtccacctctccaccctcatctaccactcttctccccaactcacgcctacagctgtgttctgagtaagctttctttccatttctcaagatttccaagcacaggaagtctcagggcctgtgcatttccagttccttctgcctggagtgctctttttcctagatcttctcatgatgacaggtctcagctcaaaagtcaccatctcaggaagccctgctctgaacactcccgccaaaggatccctcccctaccccatttctttctaccccattgcctttttttttgttaattgtgtagcatttaccactctctgcagtcatttgtttatttacctgcttatgtgttgaactatctctctcctttcactaggtctttagttccttatcagctgagtttgtctgtctttcccaattctatacccccagtgtccaaaacaccttgacatatggtttgaatgaatgagtgaatgaatggctaagaagattgatggtcatgtaaggaaacatatcccaaatacccttctggtttttattggtgggggacaataaatcagtaactacaatttagagagatgattgctatgactgaaaggtatgaagagttctaaaagaacgtgggaagttgggaaggaaccatctcaggctgagagggttagaaaaggatccctggagaaaatcatgcttctaggaggccctctttcctatggtctgttcataaagcataaaggtacccttcccaattatacgaagctgcataccattattggtgtggaaaaacagtaaccctggtattgtatttctaaatgcttgagactactaacataatcttgatcactatgttcatttatccttggaatacaaccttttacgtttgaatcttaattaaagagaaaacaacttctgggaagcagcttttttttttttgcaaggtttatcctcagcttgccaggatagctacatttttggatgatctgtgccacgtcttgctttcagactcttattggtattgtcgtggtgcttaattaagcataatactagcataaacagtatagtcatggaatgctggagataataaaaagggcatgttgagaagcatcagacacttattgcatagttaaaaacatgactttcagaaacctcccaaagtcagagaatgtttagaaacttattttggatatcctgagtcacttcttactttcagtgggtacaatgggatcaatcactgattataaattattgtgctttacaagatgcttaccacaaaaaacccccaaagaaacaaaaaattaagaaagaaagaaagaaaatgctcacacagatgtcccttctagcttttgccactatttagcctcttggttaaaatgttccagtagcttcttacttgtcttcttttcttgttattctcatcttcaaaccactgtcaggccagttataataaatgatcattttatgcctccattatgcaaggcagcatattgcagtgaaattatttatttgttatgtctgtctccctaatagactgtatgttccttgaggaaaataactgctattctatctttgaatttttagtatccaatatcgtctaacctgtggtagatgctcaataacaagtttggggaatgaatcattccccaaagccttcattttattgtctctcccatttataagagtggagaaaagaaatatcaagtaccaactcttttgccctgaatgagttggaagttggcagcacttcaaagtagaacttattagctactatagagaactcataatatgatggctttgtcacagaggctctaaagagtcagaaaaacaaaacaaaagctagagtaagagattaaagctagaagagattcctgaggcttagaatgtatttatcactctctgactcacttaaaaatgagagatcaacattcaccagcatattatgtcctgtcttttcccaattgttctatctgctattattttaatatccgggattaaaagcttagttagcctttgagatgctagttaatgcttcttaatcaccatgactgcaaatcaggtgtctgccaccagctgaatccctttgccttgcatgaatctgattcgctacagcaatagttctctcactttagtatgcatcagaatcacctggagggcttataaaaccgtagataacttgagctccaccccacttggattagtccgttttcacactgctataaagaaatacctgagacttggtaatttataaaggaaagaggtttaattgactcacagttctgcatggctgggaggactcaggaaacttacaatcatggtggaggggaagcaggcacatcttacatggcagcaggtgagagagtgtatgtaggaggatctgtcaaacacttataaaaccatcagatctcatgagaactcagtatcacgagaacagcatgggggaaaccgcccccatgatccaatcatctccctccctcaacatgtggggattataatttgagatgagatttgggtggggacacagagccaaaccatatcaccactctaaccccagattttttattggtgaggtctgacttggggatgaagaattggcatttctaacaagtctctcggagctgccgttgctggtcttgaaaccacaactttcagaactcctggtctacaatgcttctctcagtttcatgcacctatgaatcacctggaaatcttgtgaaaatgcaaattctactttagtacatctgagctggggcttgagattctgcattctaagaagtttccaagttatgccactgctattggcctggggaccactgttgaaaagttctctcctctggctgcatgttagaatcatccaaaatcttaaaatatcttgctgcccagaccctgccacaaaattccgtttcaattaaccttcagggaagtaggggcagaaatctatatttttaatgaggagctccaggtatttctattacaggtaatccatagtccacaattggaggaaaactggtctagaaaggataaaatcatctatggaattttcatataaatataattgtctaaaacatatgtgagttattaaagaatatattttttaaagtatcattgcatttaattgttcctaagatgcactttttaatatttcaatatctctaaaattggaacacttcataatctgtggtgcttacaattatttaatataattggcagcattttctttttttttctttttttattattatactttgagttttagggaacatgtgcacaacgtgcagtttagttacatatgtacatgtgccatgttggtgtgctgcacccagtaactcgtcatttaacattaggtatatctccaaatgctatccgtcccccctcccccaaccccacaacaggccctggtgtgtgatgttcccctccctgtgtccatgtgttctcattgttcaattcctacctatgagtgagaacatgcggtgttgtggttttttgtccttgcgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttgctattgtgaatagtgccgcaataaacatacgtgtgcatgtgtctttatagagcatgatttataatcctttgggtatatacccagtaatgggattgctgggtcaaatggtatttctagttctagatccctgaggaattgccacactgacttccacaatggttgaactagtttacagtcctaccaacagtgtaaaagcaaaaccacaatgagataccatctcacaccagttagaatggcgatcattaaaaagtcaggaaaaaacaggtgctggagaggatgtggagaaattggcagcattttctttctctgtgatacataaaatgattagtagtgataaatgaaaaacttcaaccgaattaaatttaaaagagtttaattgagcaatgaacaattcatgaatccggcaggctcgaagactccagcacagccataaggtggaagaagatttatgaacagaaaaaggaaaatgatgtacagaaaatggaagtgaggtacagaaacagctgaattggtaacacgttgatgtttgccttatttgaacacagtttgaatgctcagcagtgtatgagtggttgaagtatgactacaggaattggccaagactcagctattgttatagacacatacacctaagttaggcttttcagtcttttctaccgactaagttaggttatggtttgcccacaaggactcaaatatggaaatatagagtccttctcaggccatatttagtttgctttaacagtagataaactatgagtattcttatttctattaaatacagtatatcaatttttaaagatctgaaaaaaatgcatgacattcacaggattgtaacatttgttagcacccatttaattcaggtttttcttacataggaaggatttaaaatatatcaaaagtatttgcaatttttattctctaagagattgtttgttatgctggggcaggagtcaagagtagagaggcaatttggaaactgaaagaaaggctaaattgaccattactcaaaagaggccaccagttccagggactcttggaggacccaagagtagagaggcaatttggaaactgaaagaaaggctaaattgaccattacgcaaaagaggccaccagttccagggacttttggaggaccttggccaaagaaagaagaaggggaatgaaaggacaaacccagcatgcagcaatgggcagcagaagaggaaaagaaaacagctgaacagctgcctggaaagtggaacttcgataagagaggacacatgaatgggggcggggcggggggaacgttgtgaatctctcatcacttcctggagaaaatgttacaaagacccatactacttttcaatgttctttcaatttaatgtgtgcttcctttggatgcaggatatactgaggcaaagtagcctagaatattcacaaacaacttgttaatttgaaatctgataataaataacattggtttgttctacattatcttctagggtcagcaatttccctggacatacaccttccattaagttaggatttaaaaaacatctaattgtgaatcaaatagcccttacaaaagcatttccaaaatttgtgtttgatatggttcagctgggtccccacctaacgctcatcttgaattgtagtttccataatcttcacgtgtcataggagggacccagtgggaggtaatttaatcatgggggtggttaacctcatgctgtccttgtgatagtgagtgagttcttacaagatctgatggttttataaggggcttttccccccttttgcgcggtactgctccttgctgctgccatgtgaagaaggacatgtttgcttccccttctgccataattgtaagtttcctgaggcttccccagctgtgctgaatgtgagtcaactaaacctctttcctttataaattactcagtcttgggtatgtctttattagcagcatgagaacagactgatacagtgttctaaacaataagactgtggaaaatgttttacatgtgaagaaaaaaacacagaggagttagataatagattgatagaatagacagatgatagatgattgatagatatcataggtagataaatatgttggtaggtaatatgatagatcaatggatagatagatagtcccagtgcttaaaaaaaaacctatagtaaagaaagttatttgtgtttttaaacctattacttcccaaactcatttaaaaagagaacactgtttgaggctcacccattaacatttggtaaacactattctgtaaaattccagtttgtgtgctctgtatgtgtcaatttctagttttaaccaactcctagtagatttctattttcaagtagggaaagagttttcacaggaaaagaagagcatttggagatcaaagaaagggataaaggagactatctgaaaataagcttcagctctgtaattttgactaaggcagtccttgctttcaatccctagaaagtcctagtaaatctcccacagtggggaggtcaaggtagttcaccacaatggctaatagtgccatgtaaagtgcagctatttgaaagttggttaatctccctaaacgtcatttcgtaccttcatgtaattcgggtaagaatgatgtctcctccagagggacattggggatattaaatggaatgtcatattgaagcatgccataactaatcaatgactgtcagttgtcattattaacaaatgcatccaattgctaaattttaatctctaaatgtttgagaaattgatttggaaaaacataggaatactcaaacattgcagcaattttttttagctatgcaatacagcgcacaaatatgtataaatcaacatatatctagttaggtaaacaagcatataatatcgggtagttaaagacggaaaaggtctaggtcaatgttcttaaaataaatatttaaaggaaaattaacaaattaaaaaatatgagaatcatgtttatgcccctattgtgaagatgactcttcggtagcttaacggggcattgttttttattacataaaaattattttaaaataagttcttatctgacatgtaagacataatttttttctggaattttattttattttgacagataaaaattatatataaagtatacaatgtgatgttttgatatacatatatgttgtaaaatgattactgcaatcaagctaattaacatattctcagctcacatagttacagcttgtgtgtgtggtgagaatacttcaggtctactctcagtaaactttaaatatagaacacagtgttattaattataatcaccatattgtccattaaacctccaaaatttattcgtcctgaaactttgtaccgtttgaccaatagctcctcatttcctccaccatccaaaccctggcaaccaccattctaccttctgttttatgagtttgacttttttggattccacgtgtgtcagatcgtgccatgtttgtctttctgtgcctggcttatttcacttaagatgatgtcctccagcctcatcaatgttgtcacaaattgcaggatttccttctttttaaagactgaatattatttcactgtggtgtgtgtgtgtgtgtgtgtgtgtgtgtgtatcacattttctttatccatgcatccatcaacagatgggcaaaggacatgaacagacaactttcaaaagaagacatacatgtggccaccaagcatatgaaaaaaatgctcaatatcactaaccattagagtaatgcaaatcaaaaccacagtgagataccgtctcacaccagtcagaatggctactataacagacaaaaaataacaggtgctggtgaagttgtggagaaaaggaaatgcttatacactgctggtgagagtataaattacttcaaccattgtggaaagcagtatggaaattcctcaaagaactaactacagaactatcatttgacccaacaatcacattaccgggtatatagccaaaggaatataaatcattctactataaagacatatgtatgcatatgtttactgcagcactattcacaacagcaaaaacatggaatcaacctaaatgcccatcagtggtagactggataaagaaaatgtggcacatatacatcatggaatactatgcagccaaaaaaaacgagatcaagtcctttgcaggaacatggatggtgctagaggccattatccttagctaactaacacaggaacagaaagccaaatactgcatgttctcacttataattagcagccaaaaaatgagaacatgtggacaggaggaggaaaacaatggaaactggggcctactggagggaagaaggttggaggtgggagaggttcaggaaaaaaaaaaaactgtcagatactatgatttgtacccatgtgacaaaataatctgtataccaaaccactgagtcacaagtttacctatattacaaacctgaacatgtacccctgcacctaaaataaaagttacaatattaaaaaaaaatacccagatccttaggttgtttccaaatcttggctgttgtagataacactaccatgaacgtgggagtgcagatgtctcttcaggatactgatttcatttcctttgtgtatatacctggaagcaggattgtgctggattttatgctagttctatttttttttttgagcaaccttcatactgttttccataatggctgcaccagtttccattcccaccaacagtgtacaagggtttgcttttcttcacgcccttgccaacgcttaatcttttgtctttttgatagtagccattctaacaggtgtgaggtcatatttcattgctgttttgatttgcatttctctgattagtgatatcaagtgctttttcatgtatttgttggccatttgttttctttgaagaaatgtctgttcaagtcctttgcccatttctaagtagggttatttggggatattgttactgagttactcagtaaactcaactgaattaagtttcttatatatacggatattaactccttaccagatttatggtttgctaatattttatcccatttcttaggttgtctctttactctgttgactatttcctttgctttgcagaaggttttagtctgatgcaatcccatttaactatttttacttttgttgcctatgttttttaggtcatatcaaaaaatcattgcctaaccaatgtcaaggtttttttttatgttgtcttctagtagttttacagtttcatgtcttacatttaaatcttgaattcacttttagttgaccttgtatgtggagtgaggtaagggtctactttccttcttctgcatataaatatccagtttttctagtgccatttattgaagaaactgtcctttccccattatgtaatttgggcacccttgttgaagaccaactgtccatatatgtatgggtttatttctgggttctctactatgtttcattggtctatatgtctgtttttatgcaagtatcttactgctctcattactgttttatagttctcagtgtgtccagatttttcacctccttgattaaatgtcttcttaggtattttattgattttatgctattgtaaatgggattgttttcttaatttctttttcatatagttcattgttagtgtacagaaacacaactgacttttgtatgttgactttgtatcctgctactttactgaatttgtttatcagattttttgtggagtcgttagggctttctatataaaagatcagatcatctgtgaacagagactatttgacttctcccttttgtgatctgaatcccttttattcctttttcttgcctaattgctctggctaggacctcctgtactatgttgaatttctgatcttagaggaaaagctttcatttcttcgctgtttatgatgttagctatgggcttgtcatatatgcctttagtatattgaggaacatttctttgatacctatctcgttgagaattcttatgaaaggagttaattttgtcaaatgttctttctgcatctatggagatgatcagataatatttatccctcatcctgttaatgtggtatgtcacatttattgatttgcatatgttgaattattcttgcatcacagggagaaatctcacttgatcctgatgtatgatccttttaatatgctatgaatttggtttgctggtattttgttgtgggaaaatataatgttatatgcatagttgcctccaacctaagccagtgcctgataaatgaaaggctttgcactcttaattgaacaaattccttggttccagtactttactgttcattgaaagccaggaagtactgggacaaagaaattattagagttgataataaaagagtaaacagcatactcattattagcagcgtactttctcattttccctccctgataggactttaactctcttctatatatttcagccctaatgtacttatcatatagtctttaggaacaagagaaaagaccaagtagaatatgtacaaaactaaaataaatacagagacatttctttttgttttattaggaaaagttaggaggatgagaaacagtgaaatctaagatattgttcctacaatattttgctatgtgtatggtatggatgaataaagtgaaatatcctttataattatctaaaaagtatgtgaaagtgaatagatgatgctgaaactaaaaaattttattctagatcagtgcttctcaaacattaatgtgcatacgaatcacctgaggagttttccaagcacatttcgattcagcaggtctgggctggagactgagattccacaatcacaaagagctcccagggagtactgatactgctggtctgcatatcacacttggagtagaaaggttctagattacatagaccgtcatcttcatgcaccagacttatttcctagtctgggttcctctggaaatatttccagtgcaccaatcagtttgatggagttggataaagagggagactcaagatttacttcacttgaaaagaatatttattttccatttaaggctaatggactaatggactaaatattacacatctcagcccttgggatatctgtgataatatttttcttttcctaccaatgtgcttttactctatacttctgctctgctgggtggccaatgggaccttgtctgtttaccaagcctagttctcaggtctactttccttcgatatcttttctttcttccaaccttccaatccaaactgaggtggtggtattccccaccaccaagaaaggcatagtttccattttttctctaccagttctagtacatgcaattaaattttctgagcccaaaatttctcatctctgaaataaggagcatgaaactctgtgcgtgggtgcatatgaagctaatgaaatggcacataaagtgtctaacacaaagaaggaaccaaataaatatcagattctatccctatcccacttttattttgtcccattccaatgtggctttgcataattggaaatcattatgtatagacatcaggtaaaatctagcaccagcttatatagtactctaagaccatcaggttttttttttttttacctcgtcttcagttttaatttaaagcaattaaaattaatatattcagatttcaacaaagtgtaagcatccctctgctgaaccactgtatcattacagtgtgcgttaagaatgccaataggcatggaacagatgccagataaccaagatggtacttttactgggtctggcattaaacaaagaaatgtgttcataagtcatctttcttggatctcaaccaaaaattgttattttggattttgtcatctttccatttaaatttctacttaatccttcattagagtatgtgttaacaatcttaatttgtgtgattgccttcatgaaaagttggatatataaaataaatgtcacttttaaggcatctaaggaattgttttctatcttagtcaccaagtatgtcagacacattgcttacaatgtcttctatttcaatctgtggtttgtttctgccatccaaaaatgagtaaactttagtttcacccagccgtgtttctgaatatgaacattcaaatgtggaccatgtgtgatggaaaatcctgccatggctgagaatatggataaacttgagggggactgtttgatggaaagtcattatataatgtatattttctttcattcatttaacaaacatttattctaggccaatggtgagcaaaatattccctcaacaaagtacccatgcacacacacatgaagaaactacacatttatttggaatgtctagtagagttcccccctttcttggctattttacaccagttcccatataactggtttatataataatagttatttatgataaaaatttgactaattctaactgacaagaagatagatatgtttgttttggaaactatttctatttggtaatagattccaaatgtattgaatggtctctaaaagatgtaggaacacaggacatactgctcatgatgtacaacaaaaacaatagtttcaaaattttatgacatattgcagtttatcaagtggttttataaccattatcttgtttaattctcacaacatccttatgagtagtgtgtgtgtgtgaccatgagaatatatgagtgtgagtgtgtgtgtgtgtgtgtgtgtgtccgtgtaggagaggaaatgattaacccatttcatagatgaggtgtaacccatttcatagatgaggtgtaactaacaatgtagcttcaattatactggcaggtcacagaaaagagatttgcaaccagccttatgcctctcctcccacctctctctactgacccacatctttttatgaagtagggattgcagccatcccacagctcatcaatgctgtcatgtctatgcacgaaggcactcttagatagaagagaaaacagaggggggcctgggatccagtccccagcgcaggcactgagtgtgcccctggccccatcagtttaattctgagcgctcaggacagtatgaggagcagcctgtcgttttcggagacaccagctgagggagcctgtggacacaataccagttgaaaagctccccagcccagggtggaaccaagcagcccacgcctgctcttaggagccaagtttcccaaacaatgtcagagttagcttggggaatcttcttagtactcttaagaggccagagctgagatttccacacaatgacatattaaagtattggatccagggtcctttgcattggtagaatgtcaggaaaatagcattagctagataaacttctttccctcaaaccaaatacagtcgtattgtttactattataggtctattaaggttgctgtttaaatgttaccaatgtcctcatattttggtaattttgttcgagttggaaagaaatgtcttgagaaatttttatttagccagagtgtttgagcactttaagatatctttagtatactacatcgcttctccaggtcctcaagagacctaaaaaaaaaaaaaaaaaaaaaaaaaggctttctaagcagtgcctatcaagctactacttccggccccacaaaaaagaaaagctgagactcttcaccccttgattccagtattcccaaactcctggtaaaccattaggaattagatatgccccaaatttatgtagcaactcccttcttaagaatatagagaacgtttttttttacacaccttgttacacctcacaattgagcctcaacttgagattcccttgcccagcaaagtccagaattcaccactgtctacatgctggacccaattcgttttgctgtcgttgatcactaatttgggaattgtgggagggagaggaggagcgaatccctctctttactttagaactggtaaaactgagatagccagagatttctagaactgccaagctaaaacgtaagctgaatcattgtgcaagtatggattagaacccagtactgggtttgaactgtaaacccagtttctgatcatatggctgcccagtgctcctggtggcagagctgattgcttcctgggttcaaatgggtcatgctttccagggcactctggacatccatggaacaagcctaatttaaacattagaggtctttcaaacccttatataccaaatcatcatcagttcagtctctcaattctgcattaattcttttgtggaattaaaaaatattttctcctgaatttccttaaaaaaaaatcgaacgttccctcagggcaaggagacatagctaggggtaccatgcgataagagagtgagtaaaaaggaaaagtctagtatcctagacagtctctttgcagagctgcgcttctgctcagaagacatttgtcaatgcctagagacatttcggttgtcaccactgggagaggggtgtactagagagtagaagccagagaagctgctaaacatcccacagtgccctggacaccccccgacgacaaagaattctccagcccaaaatgcctgcagtgctgatgttgaagaatgcgggtgtgtagatataaacaacaatctgctaagctttcaaatgatagcagctagaaagatcttcaagagtctagggatttggaaaattctggcatcatgatagtcaatccccagtggagacattctttgaagaccacataggcaatcacttgaccaaatgccacctaaaaattgaaatatttttcacgttttgcttggtttgctagaacacaccaatatactttcacccttgaagaaagggaactgtttatgtcattcagtagcaggactccttggctaaagcagcagacagctcaccagatttcactggaaagactgcccaaaccagtctctgccagggactccaaagcgcagggaggcttcagtgctagggagagcggatgtgaaggcggttatgaaggacagctgtgccagcatctcccaacttttccgttttttctcaaacctcagcttgccttgtgcatggctaaggttatccctggccagctgcttttttccctattctacctctcccctgctgtagcaattccctaaccagtgctactaagactaaggatttcaccacctcctcccattttccaccatacagaaatccacaaaactgagttaagagaactctcctgccatccccaatagccaaaaaactgagtcaccacttggcctaacagcactcagatgattcattaaaatacagtggagcgctcttcaggggggtgcaggggagattcaagtgggaaggtaaggctgcaagcaggaggggaagtggacaggagatgagactgcgaggcgtgtcacaagaagggagtctcctggtgcctttctccagggctaaaccccttgaggcagaaactccgttgagtcattctgaagtcaaatctggtgctaactggcgctcttggatctgggtcagtctcgatggggcctgggaatgtctgcggagtgcccattcctctcagcagtttgtgagattgagagccactgctctgcttttcttctcccttgaccccattcccagtttcctaccaggatcactgtgagccctgggaggatggatttgtaaaaaattcctggagccaaacaccctgagctatgaaactggcccattattgtgagaattttcaaatgttgaagaaatgtggggttgggaaagagaggagcaccttaaagaagatttattcacctagtcaccctcagatggttgtctgcagattttgagagagaaatggaaatagtttcagatactttttattttttttttgagacagagtctcactctgtcacccaggctggagtgcagtggcgtgctcacctcacttcatcctccgcctcctgggttcaagcgattctcatgcctcagcctcctgagtacctgggattacaggtgcctgcagccacacccggctaacttttgtatttttatttttagtagagacgagattttgccatgttggccaggctggtctcaaactcctgacctcaagtgatctgcccgcctcagcctcccaaagtgctgggattacaggtgtgacctaccgtgcctggctgagtgtcagatactttttaagcatactctggttatcattcttctcagattacttcactaaattaaaatgttctaaatgtacaaagagcaaaatggtttgtttaaaaaaatagccgtgttcaatctctatcagaaacagcttcaagtaaaattattttcctccagccaatttcttctttcaagtattctcctctatgaaatactcaatttgcaactctagatgaaattactgagtcaatttgtggaaatttcatctgttccttgacagtgagtttttatgtttgggtcaaaatgaacttaaggccaggggtatctgtaaaacactaggtaataggacaacagtccctaaagtcaagcgggctattgtcaagcacaactgtactggttcgtcagagctggctcccttagcagggaaagtttgtgtcgtttctaaagtgctttaccatactgtaatttgtcattcttgattgtaatgtatggtaaattatgcttctagaaagttatcactctgatccacgtctgatctaatgagaacagctgcatccactgcaggccgggtgcttgtcagcttattccctcagggccagacaggtgtggtctaagctccaatttaggtaggagaccttcagggaaagtccaggtgcttcaagaagctccaagatgagatcagaaattggccccaatccctctgagtcagaattctgagtcatctttttttaaggccattttttgtccgtttcctcctgcgactatcagtgcctatactttaaagtgttctataaccgtgaaatctttcctgggataacccagtccactgtacccactcccaccaacccccaccaccaaaaactatagatctactgctgagtcaatttcttcacatttgaaagctcaagaagggggagaacaagttgaaatttctattcagagctgacactccatattaaagataggaaagaaaagtttggggagttgctaagcatgagaggcattgttgataaattatcttgagatccagatattagttgagcctcactcgcaactgaaagaatcaagcctaatggacttttctgcccagtgccagactggaaagatttaaactcttgaaggtctctaaggattcccaactgcttttcctctcatgatcctctctgctcctgttctgtatacctgcgtgctgcctcatttggccccatgtccacctaagtgtaaaacccagctcttcaccagtttttacaaggatgtccatttgcaccaaatgtcacatggtggaagaatttactgaagcctccaggattggcacacttaaaagttcttttctcaggttgactagaagtcttaaccactcaggctgggctcagtggctcacgcctgtaatcccagtactttgggaggccaaggcggggggatcacctgaggtcaggagtttgagaccagcctggccaacatggcgaaaccccgtctctactaagcatacaaagaaaaattagcttgccgtggtggcagtcgcctataatcccagctactcaggaggctgaggcaggagaatcacttgaacccaggaaatggaggttgcagttagccaagattgcgccattgcactccagcctgggcaacaagagcaaaactccgtctcaaaaaacagtcttaacaactacacaaaagtctcaatatccgcttatccccagtgcatatctaagtattttttccaacaaatagcattattcctcagaaaaattctgagaccagttagaaccaccctgttaaaatatcatcagaaattcacaaggaaaatgttggctttctgtataataatggcacaacaagaattcacttctacttgtatcatctattaaataatgaaatatttagtggcttttaagtagcagggcatatggttttgaattttgtttttccagttggagtaagaaacaattcttcatgattatcctaaagaaccaggaagaaaatgagcaagggactggctgggcttctaggagatgtccgtggcacacagtaggatcttggtaataactgacctactctataactaagcaaacctgctcttcagcacagggtagaacaccatggagtgaagaatgggataaaataggtgaagaagagtatgccgtctttactcagaaggggacctagaaagttttttttttttttttttttttttttttttttgagagggagtttcactcttgttgcccaggctagagtgcaatggtgcgatctcggctcactgcaacctcctccccccaggttcaagcaattctcctgcctcatcctcctgagtagctgggattacgggcctgtgccaccatacccagctaattttgcacttttagtagagacagagtttcgccatgttggccaagctggtcttgaactcctgacctcaggtgatccacctgcctcagcctcccaaagtgctgggattacaggcgtgagccaccacacctggctgaaagtatgtattttctatcatatcattctgtaagaccctcttagcttctctccaaaagatttactggaacggttcctcccactcaatggtgttagagagatgtcagtaatactatgagtctgcctgctgaggtgcacaacataggactctatagtcaggcgatgggttcaaatcccagtgggccagataccatttagctctaagtgggtccttatcctccctgagtctgtatttcctgtatttcccagtttacgaagaggagatcataatacatccctatgaaactgatgtgggcattaaagacgtaagtgcatagtataactcacacttagtaaaaagtagtcacaattttactaccatagatgctttctcatcaccggtaaaaacgacctttcatgaaagtctcacctccaaccctgcgtataatctcagaaactcactcaataacatcaactcaaagtttatgtatgactattctatttctatataatattgatgtatctttttaaactgtactttgagaaattccaaaatatgttatgatttttagtgtaaaattcctggcctgagatgtcattatatcttctttcctaaaagaataatttaattacatttccttttatgttaatgactgaatttattattattaatttggcccccaggaaatgttcaatgttatctgtggagaatgaaaaggaaataaaagacgaggctttggagcaataaaaatattatcctaaaaagtcacttgggtatttgagaaataacttccaaaatatggatgagtgaaataaaccagggaaatgctactcttcggctactcttagtactattatggattttttttttttttttgagatggagtcgcgctctgtcacccaggctgcagtgcaatggcacgatctcagctcactgcaccctccacctccgaggttcaagcgattctcctgcctcagcctcctgagtagctgggattacaggtgcgcaccaccacgcacctgtaagatttgatagatatggggttttagcagatagggggtttcaccatgttggtcaggctcgtgtcgaactccagacctcatgatccgcctgcctcagcctcccaaagtgctgggattccaggtgtgagccaccacgcccagcctattatggatttttatgagcttgaaggggtcatgaggaagagtcccaactatatcatagaacatgtctatgagaactcagttaacaggagaaaaacaacagtattgtcataaaaagatgagaaactttacttagaacctaaagtaccttggagtgtttttactttgagacctcaaaaactagttaagtcatgctaaaatgtgcctcaaaatacaattgttagaagatgcatgcaaaatagaataaaatgatctgttcctaaaattcaggaactccactgcatggagatcaccaagttgcagcaaaagatcaagttagatcttatttgacttgaccctaactcttcttctgttatggttatgccttacatatcatatctctcctatagatgtagtcatttgaaatattaaaaaaaaaaaagctcatcttcatctacaatgtgtatcttttctaacttagcctgcttgtctgtctagaagccaaggtagaaagactactgctattatactgtgtggggcaacaagccctacaggaccaaacttgaagaggaatctaggtcattgtcctgacagatctgagctttaaaattttgaagagacctacgtgtctagaaccatcccaaatagtcacatgaattaaggctttgctcctgagatttatagtggaataaaatgcaatgtcatttgcctcttcctttaaaaaaaaaaaagtcaactatgcaaaaattactataagagacttcataaagtataacacacagtgaaattactggttccctaataatcttctatataaattttattttataggctctgctggattgttaaaaatcatgatgatattcttttaaatgtttatggttaatttcatctctttcatcagattttccctctccattcttctaaactctcatctctcctactaagcttttttccaacacagctaaagtttcttggattctttcgaatatcatgggctccagcttctctctgctggatctgttctgattaaggggaggaagagagacctctcagctctaccttttctgctcagcatatatcttgttagccaagaaaagtactttgtttagtaaagacactaccagtcaccaggcaaaaaaaaaagaaaaaaaggaagacgagtccaatcaaaagttcagctttgaaattcagaccaaaagcacatgctctcttctacgtgcaacctcaggctttcccacccacctgtcttggcaagttatcatctagcccagaaactggaggaagatgccaaaaagcaagaggattccagtcaaattggtcatccacagataatcaaaatgcaaatatacatctccactccaacaaatacaggaagtccccaattttaaaacgtagtgaattacagtgtacttgacggtcagatgtttagaaccaatttggaacacttagtgttacaaagcaggcccaccaaaaatcccatgtaagtcccaacaacttggttatgttgggtgttctatgtacatctgtgtttaaaatgaaaaaatagaaaaaataccattgcaattctaatgattaaaaatttttaaagacataaagtgattttgtattgtttttccaaagtgctctgctatggaaagatgtttagctagatgagtttattggaggcttatagaaaaaggaccatctgggtagtttcacagccttggatgttaatggcctcttggttttcggtgtagcattattaactcttgtatttgtcagtcaccattaggaaaattcttgaaataacaaataagaagtagaggttatatataaaggagtggcttgtttatttttaaagaactggacaaactttttaaaagaggaaaaaaatcaaaatgaaatagagagggaaggtaaggagatggttaacgatagtgtaagtagaagtgaaaaggactttgactaagatggaatttgatgatcagttattagtcaaaggctgaataaatagacgtggatacaagcaaggcatgtgaaagcttagaataagctttaccttagtcgcaaggtgataccatcattcctgacagtttagttcctagacagagacagcaggatgatgtttatgaagtagccttaaaaaaaacagacgcgtgaggggaggtagtatcccactaatacttaacaaatcaaatgtttgtaacacagagaatgaatgtcttttcagaaccttgtatagagcttaatgaaaccggtatagtgaaagagcatcatttgtagtcagaccaaagaggacttgaattcttgttcatgtgatattgggtcaaatgatctaacctctctggtgcccaattgggatatattacaaatgagcattcagtaagtcatctcaaagatattatatacagatggtgtcaactacacattcaataactgacagttattaggctcctgaagtctgccagtaatgccttacaggttgtgtcagtgatatccttgtagtgtttgatcctgtaacaaattcagtagctattttacacccatagtatattaaagataataatagatcaagaacaaggttaacataactaactctatgtggaattgtcagagttgctatggaaactttgctaggcttatgactttcaaaaaacagtctcaattaacagaatcttcttacagagtaatctatttcatgtaaatgaattatctgttttgcagctcaaggtcaaatgcatttgaaccagtcattttgggatttgttttcccaaaggaatgataaatgactaatccaaaagactatggattagagaaattgactagatgtcattaaagaccccaaataaatgtttgctgtccttgacctccatgaggataagttgtggtggggcctgtggttatccgctgtcttttattgaatcaataacttggtttctttaacaatacctgtttatgtgcatgcctagaaccaattaaatactgggctattttaagtttcccaatgcagctatattttggcaagtgtgaaagaataaattagacacttttccaaagcacagtgatctactgagatctgtactatgtaataaacatgggatgatgcctaagcctgtggtatggtggggcccaggggtcttctttcttgtactagttcacatcgtttatgataaatgcttaaaagactttgaagtctttgtccaaaacacttattatgtataattatacagatgagcatttattaaagtaagtgtattggccttttagtgccaaaaccatccctctctatagatgttagcagttttcacttaaagtgtgattgtatgagtaaatgtgttaacccatttatagtgaagcaagacagtgtctacaaattgctgtgacaatgtccttggctcttcaaagtgaatatggttatgaattcagtcgtgagagtgcaggacctaagaaacctaaaaataaaaatctggcctacagtgtattatttttgtctgctcaacagaatgccagggtgagggtagaaaaactacctatcaggtactgtcctcactacttgagtgacaaaattatttgtacactaaaccccagcaacatgcaatttacccttgtaaccaacctgcacatgtaatgtaccttgtgaacctgaaataaaaattgaaaaggaaaaaaaaaaaaaaacagaatacccaactttcaattatgaccaaagcaacccataccatgcttgtgttgttataaatgtactactaatagtaattagattttttggtagtttaagtatactatttatactccatttaaatcatgtttatagactttttgtacattccacaaaaatgaaaatgtcttgagtacctattattgccaaaccctttgctgggttctgtggatttcaagatgaatgagacacactcctacctgcaagaagcccatggtctaatagaggagaaagatgcagactatatattatattatacatatcttaagtgctataaagatactgtaaaactactgctatggaaacttcagtaagggtgtgattatttattccttggaatccagaaacatcttaatgaagcagcatttaaagtgggccttaaaggacagaagtagcttgccaggcaggtgagcaggtctgttgtcctggggaggctactgaaagaaccaaatgtgtttctatgtagggaactcttgtcttctgtatgaggttggcatggttcactcatcaaaatgtataatgagctaagagcctggagaaatgacttttggacatttcatcccagagagaataaacagaggcccttcccatggaggcagcagcataggtagcttaggtttgtacttcagggtcacttcttgacaaggaaaatgcaagtcttatagattgggtcctatagatttcctcaccaattccaagtatagactaacttggccttgttaaaaaaaaaaaaaaaaaggaaacaggaagaaatatctagaatccttggtttctaaaaaaaattataatttaccatctctctgacttggagaaagtaagccaaaatatctaggtttttatgtttcttaaactgtgcttatctcatttaaccttaaaggtatttgattgagtcaatccatacttaagccccaataaattcaatatagcacttttacccttttcaaagtgttgtcatcaattggtaaatctaataaaaattgaatattttttaatgggaaaaaaaattacgccataagcaaagtcaaagaatcaacaaataattgagaaaaggatttgaagcatgattgacagacagagagataattgtgttacagtcagaattgtcacagatgaatttttttaaagacaactctggcaaagataatgaaagggatttctatataagataataaaatgctcagcttaatttataattaaatataaatgaaaaccataaaaatataccatatactatttatcagattggcaagtatacaaaattttaacactacctagaattagcaagagtgtggggaaacaggcactctcataaattcagggatggatccacatttgtgcctgaaactcatacagttttggagacttctttaagaaaaagaatacaatattaagcatgctcttgaatttttatttagaatgagaatgattctaataaattataaatttttaaaacatgacatataccacaaacattgcaaaatctagaataataacataatatttattgatgtactgcctggcatagctctctactaacttttccctatatttttgatacattctttctgagtatcatttcatgcaacaatgttataatacattatgtagagagaatagaaatataagtcatttttcctccagcatggttggtcaaaagaaaattttttatttttgatatttgaaaaagtttcttttagtttcacaacttattggaaatatcttataaatttttaggatagctgataaatttgaaaaaaactctaaaacatttatttcatatatgatctgtaatatttcagggaatttcaagttggttgctatgtaaccatatcaatgttaaagaccatttcaattgatggcacttctttgtagttgatgtgcttgtcacagtggtgtgttatgagctttacattattgtccatgccaatatttctgtcaaatcaataagaacttcatcattttcatgtatttatatgatttgctcttctttataaacatgattatcaaataatccaagagcctatttactacccctataagaaaaaatgtatatccttttaataaattactgcttttcagagtgaatttttttaacaatgcacttcttttttaaaaatatgtataatatttatattattgaatagcaataggcaatacaccctgtatctgtaaaactttggaaccactggcttatttgttaaatctagtccatgccagcctccaaacaccagaaaaaaatttagttagcttcattctttgatgcctcaccaaaatattctacaagatctgaaacatcctcctcctcatcattgtcttctgggtttggtgctttgctattcaagacttgccatgggaactgtttggctaacttcctgagacttgttaagctgtcagcaccaagctgacttaatattccaggaaacatttctgtgattggtttggcttctgcatgactggtaactgcaaaggtgttagcagagagagaagaactagagagaggagcagagagaggtaattgcaaagatgttaacagagagggggcagacagaggttagactttgggatcgttgaaatgaaaaactgtcccatcttcaatcatgttcacctctttaataccagctatattattcacagccagtttagttacggaactctgaagctttctgtcatctgctgtaactctctaggttccacctttgttttgcaagctgtacccttgcctcctatctggacctgagcctgaagtttggctaactttcttgattcacactgttggtaaatccaaagcagggagggtcctccaacaccagcatacagcaacagcaaaatcacaattcacttctgtatatcaaaataattccatagatcccaccacacatttttattgccttggtttcatatttcactgacttttaatctgaattttatttctttaataaataattttaaagatgaccaaaaacatattcttcctatatgtcaacatcaagggtctgtaattccttattatattgaaactttctaaaaggtctttataaaattctgttaaaataacatatcccaactcaacttctccaagcctgatccccaaaatagcgaatagccactccaactccatgtggcaagtaaggggtgtaacagtgaagaattcagagttaagagatggtagtcataaccaattgtggttgaaatgtcttacttttgctaattttacaaaaacattagaaatgtctacatattttaagggctcatgcagggccttggaagaagaccatacaagtaagatttgaggttcacaataaattggcttactataaatattcctcagtacacccttaaggtgaaagtcaaaattctaatcatctatttgaaggacaagttggcagcatgtaccaaaatttagaattaaacatccttggatccaacacttccacttctactaattcactgttacagatagactgtcacagacaaacaaaacattttgtacaaaaatattcaatgaagcattgtttgtaacagatgaaaaaatggaaatgccgtaagtgggagaatagtgcaagtaataatggatatcaacaatataatatgctatgtagttattaaaaagagcaagttagccaggcatggtgacacacacctgtagtcctagctactggaggctgaggcaggaggatcatttgaggccatgagttcaaggttgtagtacactgtgactgcatcagtgaatagccattgcactcctgactgggcaacatagccagaacctgtgtctatagaaatttttaaaataaaataaaaagaataagttaaatctttctatgtatgtaaccatgaaatttatccaagttgtatttcaatttgaaaaagtagtttaaaacagtgcatgtgtgtgtatatcacacacacacacatatatatacacatgcactgttttagactttttcaaatatgtgtgtattgtatacacacacatatatacatacatgtgtatacacacacgtatatacatacatgtgtgtacacacacatacatacatgtgtatacacacatatatacatacatgtgtatacacacacatatatacatgcatgtgtatgcacacatatatatacatacatgtgtatacacacatatatacatatacactatataaactgtgtttgtgtgtgtatacatatataaacggtgtgcgtgtgtgtgtattaatagtttggccacaatttagtttacatattatatttatacagatttttcaacagttacatgttctaccattcctagtggctatttttggggattagactaaaaggacagaggacttctacttataaaaatttgtctatttttactctattcctctcccccttttaagcaaaatgttttactttcataataaaaaattatagctgctgctcaaatcaatttctatgacttctcatgcttaaattactttccctctttaaactcatctttttaaagcaataaataaatgaaaatatttgagaacccctgcttgcaaatcatatataccatttttagcttttaggtgaggtcttgttttttattcctctattttaatcacaatctgtgaccagaactttaggaaaaacatgaacccagaatttctcaggatttcttaaataatgccttaacataattaaatataatgatgattgagtaatcagaaccattttagtatattttgttcaaaaatcagaatagttttatattggggggcagcatcatgattaaagagaggatgcaaagaaagtctagactgcaagcagttaccaacagggcacaagagactaaaagacttctagtcatctcaggagagaatgatgggagtactctagaatacttgcaagagtgtcttccttaaaaagaaaaaggtaactcctaaagacggctgtgatatctatggtgcaatgtcaactttgcctggggagagaggggaacgtccaggcttgccagtgagctgtctttagcataatattctaaatgatgcaaggatattaagaaatcaatgatttattgctatttccttgtgtctcagtgttttttcttctgcaagtttggatttgccttaggctcttctttaaaaaaaaaaatcttagctagttgtaacataggtccaaaattcctagctttttaagaaatttgttaattcagtaaaaaaatctatctataggcacattagattgcacatagagggaaagaggcatctctcacatcccgggagactgaatgccttgttttagagaacagcttgtgcacaaatggcccccaggtgaataagactcattatggtcattttggtcacctttggtccagaagacctcaaggcattagctcaatttgtatgtcatcagaaagcaatgattcataaacttcaatgcgtagaatgccatgaatagcctgttagagagaaccaccctccaccactaccaccgtcaccaccagccacacacaatcctgattcaggaccacattgacaaacctgccttaggactttgggcttactctagagaaaattcacatgcacaaagccaaatcaaactccattcctctctctgaatagatccaaccctccgcttcctgatctgtattaaaaaaaagaataaaaataagttgtctgataatctaacatgcccaggttagcttaaataacagaagttgaatgcaaggacacaggagatatcaaagaaagcaaaatctcagcaattgcacagcttgatttggagaaatgggaattcattccttgctggaaaagaatatttcaggggctccaggggccaagggtagctcttcgagatccaaaagcacgagtttattaatgagctcatgacccctcatctctacttttctatcccttcagtatttcctcctacctcttatctaccttccctctatttggtgtttcatggcataacttctgccttctaagggccaacttccagagcctctctactttctaaccactcaatctaaccaagacaggaggggataatggggccgggcaaccaccatccagcatagagcactcttgtgactccggtgagtctgcagatattaatgtttgagtcagacagttggtctggccagtcagggcaagagtgcagggtcacaaggtccaaagcatggcaactaagcgtcaaaaacccttcagggtgagatttggaaatggacagatatctgtcaaaagagagttatgtactcgccaggcaggcactttggagaccacttattcacccagccattccaccatttgttgaatgcctactaagggttaaacactagaaacaaacactgattgagacatagactctgaattccaggacttcgagtacagggatatggttaacaggtaaatcaacaaatatcacccagtgtgacaactgccaaaagagaaatgtgttcagatctagggaacccagagaagcagggaatacaaaagactccatacgtgaactctgagcaaagttccattaattagatgaagccatgcagaaatattgccaggtatgaaggcacagtgggatttgcccgtgttcagcaggctgaactctagctctgttgctcagcgtatgataagtttggctttgctctactcatttccagactccattttagccatttcagatgttataaggaaaactaaaatataaattaccttaaaagtaagggactgttagtatccacagaactgcagaaaaacatggttcctggagggcggctttggaaagaaacataccaacttgaatatatacagagagaaaaagacaaggtctcactctgtcactcaggctggagtgcagtggcatgatcatggctcactgcagcctcgacctcccaggctcaagcaatcctcccacctcagcctcctgagtaggtgggactgcagcaggcaccaccatgcccagctaattaaaaaaaaaaaaattgcagagaaaaggtcttgctttgttgcccagtatggtcttaaacccctgagctcaagcgagcctcccaccttggcctcccaaagtgctgggattataatgtgagccatcatacctggccctgaatgtattaaaactatgcagtgataccccagtcatggattaaccactctaaatataaattgtttctatcaaatacatatttatctctaatttaaggactggcaatggagaattttttaaagatcctaagcaacccattgccatcaaaacttccagtgtttatcaacattttaatagaccacttaaatattcttgatctaagttataattaaaagtatctcaggatttatttttctgagaaaacatacagcagttttttgttcatctaaaaatctttatattgtaaactttatatcataaagtactttaagactgttgatatgctccttagtagacttgcagaagagtaatcaaatgttatacagatgaaaatgtgtccagttaattatgaatgtataattttatcaatgacattttattaccatttaataacttcaggaaagacctatttttcaaaattcagaaaagtacagcttgttctatgttaggcacagctgcttaaatgtgttcattatgttttgttggggatgtttcttgttattttcatagtagccctcaggctacaatgcatttttgcaaggtggtagggataggtgtcattctcttcgttaaaaatgaggcaagtaaggttcaaaaaaattaagcgttgtgcccaatgttacacagctggtaaaatttgaactcgtgtattctttccatatttcccaaaaggttcacaggatgcaaaaaggttccatagtaaaagtggtttggaaaattttggatgaaacaaaaattaaacagttctttttaaaaaattgcagacatctcagtgaatggatatacacaaatgtgcttcatcaatctccaagtagaaagatagtctgcagcatttcccaaacatacttgagtataaatcccttttatatccagaaatatctcatggtattaatcgtgaaacataatctggaaaaaactattctacattattaggcttcttctcgtgtagtaattgaaaataactctgaaaactctcccttaggaaagtaattcatgagagctgcagtgagaaacaagaagggaaagaaaataaacaggcctgacaaattctgtagaagctgagaggttagacagtaacatcagtagtgttatacaaaccaagaaggacaaaaagacacttgaaattcattacaagccaaattttcctctggatcaaggacagctataggggccaagagtaaaccagatatccattatctttatgtttctcagttctgctttaagaaagaaatgtacctaaccaaaggaaatgtctcaatttatctatgaaacacacaacacccagaaaaatctcataaaatctcatacatggaacacgtaacatggccagtttaacaatcggccaaacaatctgcaaaaatgatataacagtgcctgaatttgaacatctctagacataacaaatagagcatagttacattaccagactaacaacgcttgattaaggcatacagagaatttggaagacacaaagagcatatgtctataaagcttaagtttgttatgttgcaatatgaatattaatagtgcatgggatttaatagcaagaaagttacataaagtgcatgtctctgagaattcctgctgtcagtgactggaaaggatcccactggggaaatgctcgctacctaacaatgccactggtggtgactcatccaaaattccgacacagacctaatgagcttctgagagaatgcctggcagactcagtcctattcagtgtgttaaatagagggtaagaaacaaagttctcaactgatagagttttctgtaaagctctattgtttctgcgagttaagatatactattacattggtcaaaggatatttgatcttccagctaccactttggttaactggagaaaggaaaaacgccacaaagcaagtttgcttttttgttttgtgtttgtcgaagtctttgtactctgataccttctttggaatatcaaatataaactgcccctctggtgcagagtgtgatcaagggggtaattaactgagctccaaatgtgatgtttctggtggtcacttcaagtcattctaaccaattaatcaatctcctggtgctctgacttggatcctatgttttcagcccctggagcagtggttctcaagcctggctgcccattaaattcatttgggggattaaaaaaaaaaataccgatgcctagaccccaccctggaccaactagatagaatctctagggatagaacttctgtatttgtgaaaagttttctaggtgattctaaataaagtcaaaagcctccaaaaactgctgttatgttcatgtccagctactgagtatctagtctccaatgagtgatccaaaaatctcaaagaattaagcatgaaaaaaatgcccccaccaatgactgccatacagctggctgtttgggaccagcacataagacattagaagacaggcccatgttgaagcaaggaaatgtgaggactgtgatcaatgttggtcagcaggatccagggaatgactcacagactgggcaggggagcctggactgaacgtgggctctgcagagctgtctggacacactgggcttggtgcatctgcggaccagcggctagcatgtttgttctacccagtctctgtagctgctaccacccatgctatcacctctaccagtagtccccaaaaataaatagacataaaatggttttcttctcacaaaaatttgtaagtagtgtaaaagatattatatattgaaggaattcttgccaccagaagaattcactgcttgtattttggtttgcagacttgggctacgccaatgtcaatatagatttttatccttttttttaagagtttgcccaatttttttttagggcaaatttctagaaatctctttttttcattaaagggcatctatattttaaatttctacaatcattgctaaagtaccttctgtaaggcttgtattaacttatattcctataagtagtcctctttctctgtgtccttgcctgtaaagtgaattagaagttgttttaatctttactagtatgggaggcaaaaacagaaacttatggttgttttagtttgtgtctctttgattatcagggaagttgagcatccttacgtgtgatttttggacactttattgttgttgttgttgttactttcctctttgtgcctgtaatttattttagtgccagtggtggctgctgctttcagaccctcgccacccaggacaacagctcagctatgccctacttgccccgcgtcagctggagttgaagcagtgcccttcacttaagattaagcttcctggccaggcgtggtggctcaggcctgtaatcccagcactttgggaggccgaggagggtggatcacgaggtcaggagatcgagaccatcctggctaacacggtgaaaccccgtctctactaaaaatacaaaaaattagctgggcatggtaacggtcacctgtaatcccagctactcgggaggctgaggcaggagaatggcttgaacctgggaggcggagcttgcagtgagcccactgcactccagcctgggggacagagcgagactccgtctcaaaaaaaaaaaaaaaaaaaaagatcaagctttctcagagtcagtttcctcatataaactacatgttctcgaaaaagacaagagcttggtggctgaacaccccagcagtctagtgtcccctttgaatccctactgccatcatcttcagagcctggggtgggaacacccatgaatacactgagggccagcaaaacccacatggcccctaggccttcctgagatcagaggagccatcttgaggcacaagctgagattttctcttgctcataacattgagttccaaaatttaagatgtaaacaagatgcaagataggccggccatttttctttaagatgagggagaaaggtaaaatcatattttgtatgtgtttcactaacctatgctaagaacctaagatacaaaaggcacgggggctgggagatggggatgggagttgacaggggaacattatatataggtgcttgcaaggaagttgagaaaaggtatgatatgaatggtacaaaggagggagtgaaaggaagaagagacagtgcagatgataagtcatatctgcggaaataaatttagaatgataatgaaagcagattccctccctcatattctttggagcatctgcctgtctcccctttcattcccaccacacttaatgtagtttattaaaaaacaaacaatgacagagggaactgggaagtacaaaacacacagtgaccggaggtgtaactgattgattactgttctgactcatgtaattttgtcgactcatgtaattttggcactcggtgtgagctttttttctgtaagaattgaataatcaactacagcggacccttgtattccaggctttgatagttatatatccataatacttataacagataatatttattgagagccagacactgttctgagtgctttacctgtgttattggcacttttgattatttcaacaaacttgatctccatttaacaattgaggaaagagaaagttgaagtaatttgttggagaccacagaactaaggtaatttgatagccaagtagttgaggctgtcatgctgttattctgttcctctataatgctaattatttgtgagtgttttctggaaaaaaaaaaattggctgcaaggaaaagaaaatccacctgagctagcataagcaaaaataaaagagtattattagggtaagagaaatgaaagacagggttcagaaaccaggcctcagaaacaaatggtaacaaggcactctacactgttgggattctgccctctgcctccctgtctttgctgccaatcttactctgttcctgcagtccaaggggctggaaatatggctaccagctgctcacaagtttgcattttataggtcccaccacttaaagagctggctcttgttcagtaggtcccgtttttacaattccaaagaagagaccttggttggtccacctgtttagttaaacaatcgctgtggctgtagagcagggtcgcattgggagcagcgctggcaacctataaatatgtggtgcagaaagagagatgcttgagcagataaataggagcccattcctgtgagtaactccatgctttataactaaagtggtctgccgtttctcagaggcatgaatctgaagcctgctcatagcaagccctgccaatgagctcatccaatgagccccccatttgcatctcaagacggttttagtctccttttaaatgataaaattttcaggacatattatagtgttggtcttcatgagactgagacttcatgacctacatcagtatgacatcacttcccaaagaaacatgaatccatatccaaaattcttgcaatacataatgtaagcgttcattgaagtttcttgaagcggctagaagaggaattactacatcatgtaacatgtatcaagacctctttagaaagcctcattagatatttctcttcttcctccccacaaactgtcttttctcttaatccatctctgatatccagggctgtttgttgttattgctgctgctgttgttgttgctgctgctattttggtttttcatttgtttggatttttctataccctaacttctatgaatcactctggcattttttagtatctgtcattttttttctactaccactcagatcagtgaaacaggcataggataatagaagatgaggaaggcggaaagctataactattttttttttttttttgccttaccaagttttgtctcactggaatcattgcagttttccacaaagaaggggacatccccctgaggcacccagagtttcttccagttcatgtttcaacacacacacaccccgcttccttcctgtatcctgctgagctgagtagaattatctccaaggccttaagagcattacctctccataaaattgggtgatctggagttgtcctgaatttcagcagcaggactcaaacttcctttattcagacgctgtggctcgggtcaagatacatattagccagaattatgtttacctgtgaataattggcagcccaatttgcagtggcttacattaataggggtctattttttactataacaagaagtctggccttagagagttgctgatgttggtttagcagttccacttgtcaagcactgatcccaggagacaggaatggaggacgaggagataagaaagcaggagtgaaagctgttaccaaaaaaaaaaaaaaaaaaaaaaaagttctccaggtggatgactaggcctgttcctgttgtgatccctccaggacatctgtacattgtccttcagaaatgtccaaccaacagatgaaagaaaggtgcattgatccctcagtccctgaccccacattgggcaagggctgccctgtgggatgtcaccagcacttccagctgtgcatgcttgtttgctgagtagggttctggatgccttcatgcgggggtatcagagtggcctaggggcagagcacaagaggtgctgagggcagcttagtggatgtgggctgtcaagatgtccttgcagggagttgcgatggctggagtaaaaggtgggctcctgtgtggatacgatgtgggacccaagacgcatctcatacagctcagaaccttctgaatctgaggtttctatgtgcttccttaattctgggaagttctctgttactgttccttcaaaaatgtcatcccaagtattctcttcttttcttttgggattccttctatatcaatgcagatattgtcctccacaatgcttagtttccttttacaaataccctctccttatatcccctccagaatcctttagagctagctctgcatcccaatcttcctacttgctaattcattttttgtctatgttcaatctgtcattcgatccatttatgatatttgttccaatgcatatatttttctacttagtatctccaattggttcttcataacttcttattgctgtttcatgtctatcttccctcaactcttttataatatttgatatgcttattttaatcttcctggcccatcaactatgttgcatctcggatagctttccaccaggagtctttctctttattctccttggcagtctcagtgtttttccctcagagctcctgttctcctgagggcattcatctccttgattgattaagtatctctggagtgagggctagaagccagggcctccatcggtccccttcctagagggccatttcaaggctgagatgctcaggtgctactctctgggcttaatcacttcatgtagggcattgccccattccccaaatgggtgaccctgtccctagggacttcgtcgaaggttgtgtgtggaggggtgctggggaaggcaatgcatgcagctggccagacagcttgagcatttccttatcagtctctcatggagcagaagtttctgcctcaccacgtgctctttagcagccattcagtggcaatctggcaatgcacaagaccaaaggggtagaaataaactcgtgctcccaacccagaccctcctctagaggccaacttccattcggggccagcacttttacacaaacatcatgatccaaccaccttctggctctccaagtgttcctcttagtttttccagtaactctggcttcaacatcctccctctcacctccatgcatcttcagaattgacttcaggagtggcagccagcagcctggtcatttctattctgtcagattccctatctgtagagatagggagttcttttctccatgggtacagggtgacctctttgccacaactaataaaagctgcatgtggctccatcttcccaaatcttgtgcagtcacaggtatattatcaaatctgtctcccacctactaatatctagagtctactcctggctggaacagttgaccagtgtgatgaatcctggaagcagatcctggaagctgtccatgattacataccaggaggctctgactggacccttggtcactggggaccaggcccttcctggtttggacctaatatcagcaaacggagttgttttctggttctggggtctactccaagagcctgcgccatactctgccatttgctcaggtttcctgacagctgccacaactgctccttcctctttcttccctctaatgagctccaccaacaatgaaaattcagaccatcccaccagtttgcggtgaagtctaagcttgtttaaaaactccttgctataaatcactctctgctgaactgaatcgattgtctctgatcctgtgagctatgttccatcacatcctgccgggggccagctgccagagctcctaaagcacaaacacaaaggtagcaccttcctctcttcttcttgttaacatacaaggaaacagcaaaacaaaaacacctaaacctacagatcgtatcaactcttcaatttgacatatgtatctgaagactatcagattaatctataagcaaaactgaggtccttgaagacttattctatgaccaaatagtaatgaaaaattctgcaggctacatttcacttctggcatttgtctgttttgaagttttgcctttctggtaccattttaatgctcaactacctggaatctgggctgatactgctcacggatttttcttctttctggtagtacatgtttctcaccagcagtcttaaagcctgcttgattctctgtcctactgaaagagctcagaggatgcagttccattaatgagtcagattcatcagtgtaaagatgtccaacaggccaggcgccatggctcatgcctgtaatcccaacattttgggaggctgaggtgggtggattgcttgagctcaggagttcaagaccagcctgggcaacatggcaaaaccccatctcaacaaaaagtacaaatattagccaggtgtggtggtacatgcctatagtcccagctacttgggaagctgaagtgggaggaccacttgagcccgagaggttgaggctgcagtgagccaggatcgtgccactgcactccagcctgggtgacgaagtgagaccctgtctcaaaaataaaaataaaaatgtccaccacagacctcttctaagtttcctaaaatgcctacttttaagaaattcagtgtccttgaaatctaggtttacaaaaaaaaaaaaaaaaatgctcatcttataatttccaaaatcatctcttcaacccccttgaaatagggaactgatatatcacatccccatgtggttccacccccaacccaggatttctcccatagtgataattctgatcccagagacgtctccacagttttctgattcgtggatgatcactacaagaaccatgaatgcttgtgtcaagttgagccccaactcccttgctccaatctgtccagcagctgaacaatggtgaaagttttccttggctgcattctggggtaataattttatctaaggtacagctgtgcattgttctttaggtcgaaaatctgggacatttgcccccaaacgtaaggtgaattaaaccagactgccttgcaactgcctcaaagtctgtctcaacacagtgactcatccaagagaaacagagatgtgtcaccaaaaatatctataaatttttttcctgttttactagaaactccttagggatagagtcgagggactcatgctgtgcttagagctaaacttcctgaaaatcttctcccagggtcctggaggcaaaaagggcagtgcagaatgctccttagaagggagtgtggaggaaaatgcatgcttatattagagaacccatgtctctgaaaccctggaattcaaagagctttctggactatgccctcactggattcggaactaccaggctttcatcatcaagaatccatcttgccagcatggggctgaagtttctgcttcctgaataccttttcccccatcaacttccttcagtaactagtggagaaaaatgaaaatattctgggaggtggcatgacagaaaaactgagtttctaatgtcaccctttgcaatgcatcacacacatttagatatctcaaatgcctgtgtctaggtgccttgtagagtgaccaaccatcctgatttgcctcggactgaggggtttactgggatgcaggacattcagtgctgaaaccaagaaagtccaggacaaacccaaatgaattgttcaccctagtttcatgctcaagatgaatagagacaccaaaatacaacaaagataaacatcttgactgaggtgtatgtatttctgacagccataccgcatcaaagagcatgcaccgtaattcttttcagaattcccctcacctacagaccatcctcagcctcaatctttacctgtccacatcatcttctcctcatcttttggatatgtgtcagcactctctgcaattaattgtgttgcatcctgtattccagataacaatgccagaaatggatgcagattttggttttggctataagggcttggttgtgaaacatacatatttatattgagaggaaagtagtggggagaagaatcctacctcctttggctggtttgtgcaatgagctcaggactacacatttagatatgaagtaattagaaataatgaacctctgggattaccccaagacttccaggagacagagtgtgccccaagtcatgctggctacaaagactagaactcgttatggataaaaatgggagaattcgattaaactaattcacgggtgtatatccaaagagtatttaaaaacatggtagtggtgccacataaataatacatagatcctacaaagtcatgccaacatcgtgaaaagaaatctgagtcgtagagctccacatcctgctgccctccagacctaatagtgttattcttctggtttgtagctgggaattcatttaaaggctggagaattcggtttcgactgttctttctctgcttaagtcatgtcataagtaatgtccatcagatgtaactctgtggatggcgccttcactttagcagagaatctccagtctcaggaagaaaatgaaaagtgtattttcctcttggctggattcctgcctcctgtcttttttctctatcatattgagcactctactggtcttaatcattttttctaaaaagtcctggattgtattattttttaaaaagacactgtggactctgtcactcatatttttaaaataataatagtaataaattaaaggaaggcctatgtcagtgaccatgctgcgctagggagacccttgtgcccaaaacaacagctcccagctcaagagagggagagagcagccacactggctggcctagtcaatgtttttttgccaaagatttctttgtatctggaaattgctcttatgtgtatcatacatgtttgaaatagctttctccaatttgaaaaaccataaagcagcaataaacaaatgggactctgattaaaaaaaaatactttgtaagtatcatgcatacttttacaagtgtttattagatggtatcattttgcctttgcttttgcatagtggactctcagtgctcatgtaaacttccagatgtagttaggtccctagaccatccactaacttgggtatatttttctctattaactatttaaaaaaaaatcacaggaaaagaacctaatgctgaaaaggcagccaaaagtacaatgaaatgaaatcaatcctaataacaaagacttctcttctttccaaaagcatgcgttcctccccagtcctgcacggtaaaccacatcagtgtgggatggtaacatttcagtaagttatttgaatatcccaagactaagaccatgaataaaaagcaacagcagcaagattgccaataggctgtgggtatttaaaacacaatggcagaagattcctcgaatacaagggatagctagagccaataagccccagtgcatggatattaggaggttcattgattagggttacatgattaaagaaataggctaagggaataaactgctgtatacagggtttagctcatatttcttgcaatgcattttttgagtacttttgccctcgttcctgggaaagatggtaagttaaaaaaaaaaaaaactttataaagcattacattaaaaaattcatacaaaaggtactaagaatagaaatcacattcatgcttcagtttcacacactttctgtcccaaacagcatataaataaatatgatttttgtaacagctacattgtggcatataccacaaagggctcgggtatcaggcaagggaaaaacaatttatcttcattaccatctatccacacatactttggtaatcatgaagacatttctccttacaatttcacaaggaaaataacagaacttgggctctgggtgtcagtatctggcccgagtccatttagtggcaaaaggaattcttaagtactgacattacatttcaacggggcacaaagagacaggatttacattccttcttggattaggttttgttttcatactcattctctttagataatcaaaagcatgtgtccccacaccttgccagttccaccaagggatcctcagcacccatctcagaggggtctgatgtgacatctgaaaggcgatgttgctgcctccccagccaaggggggtgcttgtaatttctcctgcattatctttgaggtatcactcaccaaagcaatgaagggtaaccattccgaatcccaccagtgactccttctgaaaaacctatcagtaggagccttcagttttaaataatccctgccttgtagtcacacaggggaagaataccccagtcaatttatgaggtctttgccttcaagttgtagatgaaaggagtttgttgctagctgggaaagcttatttatgacatgattgttaaggaaggaatggtagtgttcccatttttttctttttccttttttaagccatccttgggttttgatgattgtgacagtattttttgcctatgttttacatactccttttggccttgagtttaaactgggttgtattcaaggagtcaactttaattttgtgaccaaaaaaaaatctgtcatcagagctatcctgccttcattttgagtactccccacgctatcttctctttaactctaacttgttttattttgaatcgcacagagaaggaatttgaatggctgcatgcatctttggagatgcttaaaccttttctcattttgggtcttaaggataagtagatctacatcagaaaaatattaaaggagggatcctatattctaaaaatataaaaaagtaattcagagtagagtagttcatcaaattaaaagactatttgttgacttcatcctctttagtgacaaaggagaatttagttgcacttctttcagtcagggaactccactgtggatactacagaagcaggccagatcatgtatataatttcactaggggagaaacagatggaatttattttcttacctgagttcaccaggttttctcatacctcggcctctctactcctggtttctgattggaatcccatatggtatttctcaagtgggaggcaaatccctaagcatttgcttcaaaatcaatgaaatgagcaggtagggtgcttgagaaaaataaggattcccaagccccatcccaagtctgctaaatcagcatctctaacagtggctccaggaatctgaatttttaacaagcttcccaggcaattcctaagaccctaaagtttggggaatgactactgtgatgtcataagagattctagaatggagactggcaggattgctgttgtttaccccaagaccagctttgccctcatgcctcaagtaatagagcccctaagtcttggccaggcacaactctcttactgctaggtatgtccgttttatggttccaggccaccatggagatgcaagcataagtgctgtgagcagcttaaaagacagttaattgacacacgcacttgcttcctgcttcttctttcttgctggctggaatcggggcatcatggctggcactcaagcatccattttagaaaggaggcaacatactaaaaagcaaaagggaaagaatttgacaacaatgagcctgccataacaggcccaaatagcccaactctccatttcttctatacgatagagaaataaatgtctgcctggtttaattcgtaagtctctcattttggtgttttgttttcagttgtggaatggagtagggtagacggtatgtgcagctaagcctaaactaaatgatatagactccaagaaaaaaaatgtctgctttttcttccataatcctagaacctgcctggtactgataagctgatttcttataagcaagcagtccattgtgggggatgagatatggagatgggtttccatgcttgcagattcacagcctttgcagctcctgggtcaccagaacaagactaggggccggccagtcaagcagtaggaagattatctgcaaccttatgcaatcattagaattaaagagagtataatgaggggatgaagagcaaagactataggcagagtcagactccctgggtctgaatactgggccctcactttttcgtgtgcatttcagtaaattgcccaactccttcgaacttcagtgtccaacattataaaacgaggagacttagaaaaccaaccatacaagacttactatgaggcttaaatgctatacgtaaagtctggcatctcaataacaaattttctcaataaatggcaaatattatgatggttatttttgaaaactgtaagaggaaagaaaatgaaacatcaggaagtgtagttatgaagctccctccaccagctaccccagaacctgattttcttccaccttgagaaataaatactgtaagcagttgagttttggagagagaaagagagatgtttaaataggattttgaagtccctgctcttgctttgcaaagaaatcatcagtaaagttctatatttttcttaggaaagaaaataaagtaacaccaatgagaacagggaagtggaataagaggccactacgaagtgagaggtagcttccagtcctaccacctctgattagtttattggctggatgatctcaaccaagtcgcttatactctaagcctcagtttccttttctgtagaaaggaactcatctgcctcagatgataactgagataagtgaatgaaataacaatgtagttatatgtaataatcatataatttggaatttataaagaactataactttctatggttttattacatattcagactccatgctacattcctggggatagcagaaactctctcatgtaaatcttctctgtgccaattaatctcaacttcagggaggatctgggtagagaagctttgggcacgatcatctccagttgctgactttctagggttgtaagggccatactcgtacaggtaagccaccagaataatatatcgaagcatctaaaaaaattttgttacacacccatcttagtctctatttaacccctttcattgtacaaaaggcaagtgctttgaaaggccagttataatcaagtattaggaggaaatgcagaaatcactttcaagtaggttggctgtgcatagcatggaggctgtacttagtccatcatagtctgaagctcttagatgacatcaggcatcaaaaatgccacctgtcactgctgcccagccacaagaatgagtccttccctccaaggaaaatactgactgctatcaaatatgtatttacttattcacaagcttccctcccgctcagctcctcactggcgtcaccgattaggtccttataaatcccagtacagtacattttttcttccacatggatcctctctgtaacactttcaggcttctagaaggcagtgataatttctatcacactcaacatccatcagatctagatgtttaacatgtaatgtgcagttttaaaggatgtggatgccgagccatgacgaggcctgctggctccatcttttctgagtgtccacactgggccaggtctgtatcaggcactgagctgtgaataggaacatgctcacggaggtcacctttcagcaggagatccactttgtacaaagacacacatatctttgataagccgtaggaaagcagagtctaaggctgaaggaagagtttctgaagcgagataacttggcaacttggaggatggataggaactggtgcaaaggccatgtaagtgtgaaggggctgatatggattaggagctgaatgaaacccagtgggctggaatgtggaagggagctggcaggagctggagaaggaagcagcagccaggtcatttggttggcatttaaatgacttttgcttttaatctaactgaaataggcagccacttagctgttttaaacagggaactgagctaatccaacctgcacatgaagatgatgtcactgctgttgtagggatagccagttaggaggctcttcaggtgcctggtctggaaagagttgtgtgattcaggttgggctgataactgtagttagagaagtttggagatcaactgtttcttatactgtggtgggaaatctttcagtagaaccaactcagatctatggatccttaacagctggaggaagacagtgatgggggagtctgtacttatgacgagctccagggttatcttacatacacaatgttcgaggcttggactgacacttctgtatcttcttattgctagtgaattccttaaaaggactaaattcatgagtctggatccaccccaaacctagtctcctgaaggtttcctaaaacatcagatttaactgtcactagaatggttgtccccagtgaaaagcatagttctcctggccaatggtcagtaaagtctgcactttaagctcttccaatagtagtgatgagtttgtgcaaattggtccacacattttcctgactcacaatgtaaatgtttaagactagtgggcaaacgcacaacctgctgacatggaacagagcaaaatcagctgactccaagccacaaaccaccccagccccatgctaaaaatgtcattaatgggcttgattaatgatacttaattttgtgtttgctttaatggtatttcaataaaaaattatctggctgggcccagtggctcacgcctgtaatcccagcactttgggaggccaaggcaggtggatcacgaggtcaggagttcgagaccagcctgaccaacatggtgaaaccctgtctctactaaaaatacaaaaattacccaggcgtggtggcacgctcctgtaatcgcagctactcaggaggctgaggcaggagaatcgcttgaactcgggaggcagaggttgcagtgagctgagatcgcaccaccgcactgcaacctgggcgacagagtgagatgctgtctaaaaaaacaaaaaaaattacccttcattgggcaaaaaaccagggaactcaaccaaaaagatgtccaaattatagtgctcagtgaaaaaaatacatcacagggtaataaagtataatattatgccacagtcagatttgcatttgatagataactttgtgcactatgtagaggctggcttaaggaacaagccaggggacaaaacacatggcaccctagtctgtgcggccagcctcacacaccctgactttctgtccttttgggaaaagacagcagcatgcttgttaatggaagatcctagacttcagatgcagaccctcaccaaatttctggctaaaccatgggtctatacctcaaaattaagccacacagtatatgcaaaaagtatgagtagtaaaagcaacaaatgttactttcccccacttcttttaaaataaagtaatataatattctaagctagtgattctcaaagtaggctttgaagttcattttcatcaaatagctgagaacacttgtttaaaatacagagagcctgtgctggccctctgaatccaagtggtggggcctggcaatccacacgttgacaagacccatttgatctgatgcacacaacttgaaaactgcaattccagactagcagatgcatatttaattattttccaattgtttcaaatgactataagtttgctttgtgttatttttctcttccctagccattgataaacctctgaaagttcagcctaggcttccaccagacaacctagcagagggaaggctcaataaacaatgaatcaatacttgattgatctatggcatgcaaattatattacgcaaaacttctctcatcactactaaaacttttccagatgtacagtttattcactgttgccattgtcttacaaatccttatctagagtttatttctggagagagggtaaaaatccctagcccgcaaatgaggatctatggaactcccgctggggccgctacgtgacacaaaccagagtgagaaaaaaggtgccctgctcctattttcagctccttactccttccaccaccccagtcttgatagttaatcctagaaatttttctcatttgcttactttaagctttgctgtttatggaaatatgcctttctatctggaatttgtaaagaccatattaccatatttccatatttccttgttttggtatgtaagtccctctctcaaatgtatataaatcccgtaagtgatgaaaggaattttactaaatggcccttttgccatttgccaacctctctcttggcaggtgtgacccaaggggtccatcactttgttaggcggcagataagcaagctgtgaattccagtggcctatgacccacctttgcttctcagaagcttcctcctgaatttatgtagggatatgatgctgtgtaaatctaccgtaaaagtcctttgcacacaaaagacctgattcttcaggtctgcgaacacatgcttcttctgtttgacttatatgggcaccctagggtttgtatttgcgccaaaaagtggaagccaagctttcattgtaaacagatggtgctgctaacaaggaaagtaaaaaattcttccagtcactcctcgcaccagagacctgaagaagattctgctttaaaaacaaatgaacaaaactatcaaatactccctctcccctattccataggctctgggtcaaaacacacatacacacagcccctcacatgcagacaaaatctggtctccattcctcactttccccatcctcctccctatgccaaattctacattcctccagtgtagatactataaatataaaaagaacaaactcaatcccgaatcacgagggtgcttttctttgcatgaccacaacataagcactggtccatcattttgggatttttatgaagccttgaagaatgttcagaattccagtcttgctcaaacaatgtctctcaccagtcggcatgattcagatgttgagtttcaggacaacctggggatttctggttagaagaaaacattctcctgaagtgtctcaatgtgaaagatttccatgtatttcccccttttttctttcagcccagaagaaaagaaatgtggaaacgcgtatgttttctttaacatgagggaatttgaagttgattgcaatctccctgtccctaagcccaaaagagaagtagcattattatgctgtaatcaggtcctttcttaaattcctccattaggtagcatcttattacataaccactttatgcttttaaatctgaatatcgataacaatctcctgacagatcatacttccggtgcctaagttagaaagcgaatgacccagacactctgagatgtcctttgaagcattccagaggaaggggacactggaggttatccagtcacccgtgccttggggcaagaccacactcaagctgttccaaagaaatgaggatcccttttatttttgaagtttccccagagacgcagattccacagcctccctaagtaaaccctcagtgcttcaacagcattaacattttcataggagagttaagcccactatcaaggtacttattattgaattgacactctgtcctttgagccttagaaaatatctacatcaaggcctttctattgtatacatgaaagctaaattgtctatctacttgtataagataccatgagaaaatacacatttttggaaaccttacctcagtctctgccatctgtttattggggatacctgctctgccaaactcacagtactacctgaaggatccaaagagatcacatgtcaggctgcccaaggtactatttgtatcaccacctaaataactattctaaacctgaatctggaagtagttgtttaagctactttattatagaaataacagggattcctgaaataatactttaattataagcctaagttacaaatacaaacatgtggttcatgaaatatcactttaatgctcacataagcaaactatgtgttggcatctcacaaagcaccagggaaaaattattcccctgaagatgcaggacttgctctgaagagcaatggtagaaagctatctccatggtttagcaatcacagatgcagggactgggtaggtgaggatggaggcggcgaactgcctaacagaaggaagccctgtacaagagagacacacatagatcacagtggttcagaaagcctaagtgtgaacgcataaggaaaggcataccgggcaaacggaactgaaaaagcaaggttatgaccttactctcaggtgaagtgtaattcaggccagaaattaatatagtaagaaaaggggcactttgtaatgctaaatagtgaaactcaaaatgaggctacagcaattatgaatacacattcatcaaacaacacagtagccactgtgtaaagcaggaattacagaagaggaaagaagaaatagacagaaatgaaaattcagtccatgataaataagtcaacatatcttaagttcggaaaagacataacataataagatacatgttattcaactctgtatcctgaaaatatctccatattatctaacatcattttttcaagtggtcaggaaacatatatgaaaattaaccataggcaaggcccacaaagtcaacaaattccaaaagatagaaacattacaaataatatttttggtcacaatgcaataaaacaaaaaattgttatcaaaatctcagttatcaatatcgatacagaaaattctaaatgaatactggcaaacagcattcactagcacattaaaaaaagtaattaccatgacgaaatggagcttgttgtaggaatgcaagaataattcatggccaagaaatttattatatcccattaaattaatagctctatggagaaaaaaatatatgatcatttccaaagataccaaaaagagcatttggacaaaagtcaatactcacacctgatccaccccccgcaaaaaagcttctaagaacaaattaatattctcttagcataataaaatagatcattctcatcccaaagcccacatcatgccctgaatcactgggcataggtaatcactgaagccatttccattaaaataaaaaataagacaagaatgcccactcttactactgttatttaacatcatactagacctaatagataatgaaatttgaacagagaaactaaaagtataaaaattggagagcagatggttaatctttatttttagattacattatatagttagaaatacaagagaattgggaaatatttataaacaatatgagtaagatagaatggcacacaaggaatacactgtaattagttgcttatatccagctagaagatgtaatgagagaaaagaccccatttacaatagtaataacaaagataaaatacctatgaataaacttaatacatgtccaagacacatatgaaaaatctgtaaaacattcccaaaggacacaaaataagatttgaacagatagaaagatctacctttttcttagctagaaagacttgataacatgaagaagtcaactttctctatgttaattatttaaatttaattctgatgatacaaacaggaataagagtttctattattgtttactctgaagtttatatggaaaaacaataaggaaaactgggaaactgagaagagcaatgagaaacgatattaaatgtataatagaagtgattagatattagatattaagaaaatattaaaaattaaaagcattgataattaactggtgtggcggtagcacccaaactaaaaaaaaatcaaccaaggaaatataatgtccagaaatagactcagctatacacaggaatttaatagatgatgataatagcatctcaaaacagggtaaaagattattatcatgaagtggtggtgaagcaaagcacaggcaacagaagcaaaaataggcaaatggggctatatcaaacttaaaaacttctgtgtatcaaaggacaaaatcaacagagtgaaaggtcagcctatgttacagaagaaaataattgcaaatcacatatccaataagggattaatatccaggagatatatatatatatatcctataaggggttaatattcaggatatatatatatatctcctacaactcaacaacaaaaataacctgatttttaaatgggcaaaggacttgaacagacattcctccaaagatgaaatttacatggccaacaagcatatggaaagatgctaaacatcattaattactagagaacagaaaatcaaaaccccaatgagatatcacctaacacccattaagatggctgctatgaagaacacaaaaagtaacaagtgttggcaagggtgtggagaaattggaactcatgcgccctgttggtggaaatgtaaaatggtgcagccactatcgaaatcagtctcacttctgggtacatagccaaaagaaatgaaagcaggatctcaaaaagatatttgctcatccatgttcatagcagcattattcacaatagcaaagaggtgtgggcaacccaaacatctactgttgggctaatagataaagaaaaagtggcctgtaatcccagcactttgggaggctgaggcaggcggatcacgaggtcaggagatcgagaccatcctggctaacatggtaaaacctcgtctctactaaaaatacaaaaaaaaattagccgggcgtagtggcgggcacctgtaatcccagcactttgggaggccgaagcaggcggatcacgaggtcaggagatcgagaccatcctggctaacacagtgaaacctcgtctctactaaaaatacaaaagaaattaggcgggcgtggtggtgggctcctgtagtcccagctactcgggaggctgaggcaggagaatggcgtgaaccgggaggtggagcttgcagtgagccgagatcgcaccactgcactccagcctgggcgacagagcgagactccatctcaaaaaaaaaaaaaaaaaaaaaggtggtgactgggcactgtggctcatgcctgtaatcccagcactgtgggaggcagaggcgggtggattgcttcagcccaggagatagagaccatcctgggaaacgtggcgaaacccatgcctctattaaaactacaaaacttagccgggtatggtggcacacgactgtcgtccctgctacttgggaggctgaggtgggaggatcactggagccctggagattgaagctgtggtgagccaagattatgccactgcattccagcctgggtaacagagtgagaacctgcctccaggaaaaaaaaaaaaaaaaaagtaaatgtggtatagacatacaatggaatattattcagccttaaaaagaagaaaatcctgccacatgccacaatatggatgagcccttgaggatattatgccaaatgaaataagtcagtcacaaaaagacaaatactgtatgatttgcggtgattaaagcagtcaaagtcatataaacatggaaaagaacagtggttgccaggggcttggaggaaggagaaatagaaagtcattcaataggtacagcatttccattttgaaagataaaatgttctggagatcttttgtacaacagcatgaacatactcaacactacagaactgtacacttaaaaatgattgagatggtatattttatgtgttttttaacaacaactaacatttaaaaaattattctttttgaaagtggtagtggggcaactggatcattaataataaagcaagatccataccttaataccttatacactaaaccaggataaaatataaatgaacaggccaggcacggtggctcatgcctctaatcctagcactttggaaggctgaggcaggtggatcacctgaggtcaggagttcgagaccagcctggccaacatggcgaaaacccatttctactaaaaatacaaaaattagcctggcatggtggcgtgcacctgtagtcccagatactcgggaggctgatgcaggagaatcacttggacctaggaagaagtggttgcagtgagccaagattgtacaattgcactccagcctgggtgacagagtgagactctgtctccaacatatagatagatagataaatagatagatagaccaaatacctaaatatcaaaaataaaatcagagtatataggataagacaggcctatctatgactcttttaaaaactgataaattcaattaaataaaattagaaacttttttaatgtcatgagatatcaagagccaagtcgaaagacaaacggcaaaatgagaaaacaatctgaaactcctaacgcaaagggataatctccttaacatacgtggagtttcaagaactgaagaacaagaccaagaacccaataaaatatgggaacactatataaacaataaggccacaacaaaggaaatagaattggctcttaaatatataaaaaacttgctcagcctcactcaaaatcagagaaatgcgagtcaaaactatcttgagacatcacttttcacctatcagactggcaaacatccagaagtttgattgcacattttgctggcaaggccgtggggaaacaagcaccatttaacattgctagtggaagtgtaaattggttcagccctttgaaaggcagcttggctgtatttatcaaaattcaaaatgtaaaatccagtaatcccacttgtgggaattaatactatagataaacttgcacaagtgtaaaatgtcatgtgtggacgtttgtaacattgtttaatagcaaaagattggaaacaagtcaaatgtctatcagtgggattctgattgaataaatcgtggtgcatttatccaagggaatgctatgccacattaaacacaggcatggttactctgcactgatatgcatgtaagtctcatcgtgtccgtcctcttctcaagaccctccaatggctgtctgttgctctgagggtaagtcctgaaatacttacactggtttagcgggtcctacaccatctggctgtcctgtctctctgacttcatatgacattctacatctcactttctctgtttcagccacattgtcccctttgctgttcctcaaacgtgctaggcatggtccctccttaaggcctttgcactagcttcttctgcctggatcaccatactctccaaataatcccaaagctcactgactcccttaccatgatcaagtctttgctcacacgtcactgtctcaagaaagctgcccctggccgctccgttttaaattaaaattccccactgacatccccaacccccattatcttgctcagtgtgttcaactgctcttattatgtcctaactcaacacagaattaacttgtttagtatgtttgttttctgcctaatgtgccccttgcccaagatataaatgccaagggacagaaagttttgtcagcttgtcccctgctgtgttaccaacatacacaatagtctgtggcatgaagtaggtcttcaacaggtgtttgtttccaaacaaatgaattaatgaacatacaatgtggaaaggactataaagtgtatatgtatttaagtgaagatgtaagacgaagcccagttattgttctgcctatagtattttttttttttttttgagatggagtttcactcttgtcgcccaggctggagtataatgacgcgatctcagctcactgcaatctctgcctcttgggttcaagcaattctcctgcctcagcctcccaagtagctgggattacaggtgcccgttgccatgcccaactaatttttgttttagtagagatggggtttcaccatgttggccaggctggtctccaactcctgacctcaggtgatccgcccacctcagcctcccaaagtgctgggattacagacgtgagccaccgtgcccggccctgcctatagtatttttaagaaataaagaaaaagtgtaagaatgtatttaggccaaaagaaacctggaagtctacagagaaaactattatcagtggttacctggagggagatgtatggactgggcatatggggaagagtggtagaaaggagactgtggtgcatgtacttttatataaattatgtaaatgtattacttattcaaaacattaaattaacaaaagaaaaataaaagctgatgtcagctcccaaagattgtaattcagtagttctgagcagggctcaggggaatctgcattttcaacaagctcccccaccctcccatcccttcctgggtggggtagatcaccctcaaaaatcactgtcaccactacctctcctgaccccaaaacgccacaaaccgcgtaacgttgggatagttctcatttggagcacaagcaaatgggcaggcacatcacagaaactaatggcagagttttcagtaacatttgacaccactaacagctgccacccaaaaggcagcctccttgtgtggaagaacagcagaaatttcatctacccttcagtttcatccccacaagcaagcaggaccagtaaaaggagtgtcctctctgtctaagacatttatatatgttgggtgtttagactaaatttcagacttctaaacattcacaggtttagcgaaagtagttggaggggcttcttcagatttctgcgctcatggtgatcatatactgaaaccctccaaatttttccttcctctttcgcccaggcattttaattaatacaatgtccttcctaattcacagaggaaagatctttctaagaacccttgctggagatgagaaaggtggtaaggatctgaaatgtgtcttagcaagactcacccaacagggccaccctgcttcattgtgatgcctttcagataaacgaagtattcggctcttgttattcaatgaccctaataaaactttacaactgaagtgtagaggaaaaaaataaataaaaagatctaatgacatacaagaagggactgaacctgtcaaccccagaatattttcagtctgaaaagcaacctcatccttattaactttacattgattcccaaagagcggaaaatttaataaggaagaaaaaattcaatatttcatgactcaccacttcctcgggataataaatacgaactaaagatatatacactgaacgcttttaacattttattttcacttcaaaaaatactgtttgcactatctctactattgacctctcaagatgattctatttccggaacgcattttttgatatggtttctaattcaaaaatctgtcacatctttgatatttcataggctccattaaaattaatagcttcatgggtccctcatgagtttcttccttaaattttcaaacggtttgtggtctgtttctcagactggccaatgacaagcagttctgggactggaagatggaagtagtgaaataatctttaaaaatgtgtaaaaattaagcactgtctgccaggggctttagagttggcaaatagctaggtctttattaaacggttggttttgtttctcctgttgtttcttcctgatatccgtctgtgtggtaactgagtcactatgacataataccgcagagaaagactgcaggacaaccagacgtacacatgttcatccctcaatgagtcgcaaccttgggtctgttccctagacattggtggaaagacttgattaatggcagacttgttcaacataaaaaagaacaaagaccagatttattcttggcattccctttcctaggggcttacttgtaatggggtaattaatttatggctttgcagtaaggcggcatcagaggagcaatttaactcacaagaggtaacgcagatggagagtacaactgaaagataccttgtgtggaagggtacagaaggaacctcaagctggacgttgatttcttttatcagtaatacaaattcactactagctgcttcttggatttccccccttgagagctgcaacgtttcctaaatgaacagaggtctttagggaatgcctcaaaccacagctgaatggggagtggctttagaaatcgccggtggaacttgcctgttaccttcttacaattccccccgcccctgggcaacgcaaaagccgtcctaagtgcgataagagcatggagtgaagggagttatttctggagtttagcagcattcctccccaggacacaccctctccccctccccagcagcccggcactccgacacactccgcgcacacgcgcccctcggcgagacgcggcgcattcgcgcgctggagaccggcggcctctcaccgagcctgagtcgtggccgctgcgccgccaggaggcttcccgggagccggcggggcccaggacctctcgagcgcagcaggcaaggggccggccttttggcagcgcggctgccagttaattttctccgttgcattctgcaaacgagatcgcattcagagcccagaagttgcaagctgggaataagcgagatctgaaagacccccaagaggagcttgtttgggagtgggggcagacggcgttttgcgcccaactggtaagtggcagcattaaatctatgcagacatggaggaaataaagctttgcagcctttccaggcagtggcatgcaagtactcgtgcgaagagtactgtttggggtgtttagttgtagtggactcagaataccgtgttccgccacggttttcctaatcccttcttcggactcctctttgggggttggcgggggcgggtcctgcttcgcgggacttttctgttgttggagttagggtgggggaggggagaaaggcgtgaggttgaataatctctcctacccacctcacccttttttttttccattaaaaaaaatgatacttttagagaagcttctctttcatgtgtttaacttgcctgctgcgatttgagcccaatgagtttgtattttctctaattactttgtaatcggctccatcctcggttgaaatagaaggaaactttcacaaagcaatcaatttctgacagcctaagagctgctcagttgctgaatgaggtctagctggaaacactttgtttctcacaaggttttggtgatttttcccatgagaaatctgggcgttttcacacctgttgcttttcagttgcctcaaaattgtttgcttgtttgtttgttttcttgggtttcacttgattgcagttctttgtctaaccaaatccaatgctactttcccggttctcctctccctttggacggggtccctgttgttagcattcagttggcggtggttcttagggaacaagtggcaggcagaatacaatagggaagaatgcattcctgatgactcctctaccatggaaagactgaaaaactgacattctccattagtttttatggaaagcattgctgacgcttataaatattcaattttggtgagttcctgaaattatttaatccagaagtaaccagcatgacttttacagagagagttcccctaatctatttgcattacaagcatagagaccctggcacctgaacacccccagaatgctgaagtcacctttcacttcactggcaggtaggctactgacaaggaaaggggtgatggaatgttaggagaggggcagcggggaagaccccctgagaagggggctgtcctccaagggaccagcatgatttcagctttctgatgattaagaaaatcatcaggatattggagtgtaatttaacatcctagtaggttaagttgaattcctgtccacatgatgaaaaagactttctatcagcccttctcacacttccaagtggagctcaatggaatgcttgtttatttctgttgccgataaatccatgggaaatctctgctgaacccagcaattttaaaaaagcaagttccagcttataattgcccgtataatggcaaacaggttattttcagtaacctaagactcttacatttccccccgcggttgttataggggttacatgaagatgttatgagcatgcatttgagcttacccacccccaactgaaatggaaagttatccttgggtgtctgatggaaaagattgttgccagataccttaggaggctataaaataacatgtttctgaaaagatcataactagtagacatgagtgtctatagctactatataatttttcattgttcctttaggaaagagacctactttgatcactacagtgtttacatttgttgtttatttgttgtatggtttttctgagtcttttttcttttctttttgctattgaaaatctcccttcatttaaatgaaatcacagactagaaatagcaatgattgctctctagggctaaaattagaaactacaagagactttttagacacatccctcttgtctcatggaaggttctgccgagttttctttaaaactcccacttaagcaattattgtaagatgatgtttactctgtaaaatagcatttttatttggacaatttttttccatcaagctttaatcatactttgccaatgcatattgaactttgtttctctgaggtgcctaaagggacatccaatacatttaccatcccttcaaagtctgtatacttagctctttgaacagtttcttaaaaaaataataataataaataaacaaaagctccaatggcacttgcaagagacaagactgggtcctgtgatgtgatggcagatggcagttgcatgagctttgtttatgctcagaacaagctcggtgtctcttaaattaatcatgaattgaataattgatttctcacaccttgggctgcatttaatcttcagctgtacatttaaagataggttatgattgaggtcttgttcacttggacgtcctttcaaagcctatcaagtgattttacagttgggtcatttctaatcgtaacacatattataaaatgtaatgacataaacttcgagctttcctggcttttcaatttccaagatgggcttcagtgaccttcccatttgttggtcagccccaaagatggtggggctaatggatacagtggtttttctgtaaatgtaattaaacgtgcctctgccagctgcctgtggtatttgtgaatgttttcgtaagaaaagctgttcttcgactttatctgcccactgtggtttgtggcatgttgtgctattctgcagccttgcagtttttttcctgaatgattgggctatgatgtcatgtgctatctcagcgcagaaccttttcaaagctttgctggggtctgtgtgcctgagcgaggggagtggaggctccctcagagcgcacttggtagcgactccccgtctactccagcacattccatcgcctggagaccaaagccaccaaatgatttgcggtcagagtgatttggggctggttagagatgatttaaaaggaaggttatgggcatatgaagtgtagcgtaaagaaaatatattttactactttattgagaccacatggctccaacttgaactttttttttaaacatggaaattgttggctgaactggctcacagtgttttttccctttttttcatttttattgctctgagcgaagagctgtactccctatttattatatgcttgacctctccattatttctgaaagtttgaaaagctttttatgtttaaagaaaacaggaaaacgtaggatttatctgttgtgctcttcaagggccaaataccattgccagagaagagacccaactctctccaataactgaaagaaggtttctttctcatgtcaagcttgggaagccatcagttatgaaagagacaagggccagtctgtcccagggtacccgagggccacagcatatcagtactgacagtgtatccatgtctcttgttgactgggagagatggttttgctcaacctcctaagggttcaatataccctacgattaataatggggccaaataaagcatggtcgatcttttccaatgccagaatggtgatgctagggctcagagaccaggggctccttctcattagcggtccatgggaacacataacacttgggtgcaacacttcgtttgtgagactaagcagccatctcctgcctctcctatgtgggctaccacaaactggcacagtaaaccacctattacctctgaacaggttcccaaatctctgtccagcatgaacttaaagtatctattatcacttcactctgtggctcaggttcatcctatttcaatcctcaaggcatatgccatagtctaatagtccattacaagctatcagatagccagctccaacttgcaattcggtgttatgacactagctagagaagtgccatggaaagcatgtttgtgagcatgcccagtcccttggcagccatcaacccagggtctgagggccatgactgtgatgtaatggaaggcctgagatcttcccaccaacccttcatggttgctggtctgtgatccatctgagccagcctggattcccgcagtttgagtctgtgtgtgtgtccagggatttaaaggaaaacatgtggagaccaaattagtgtggcacctgatgagaaaatcttatagaattggaaaaatgtcaagaaggcaacattgtatgatggaaatcaaactacattggaattgaggatcctggttttgccactatgtgaccttgaaccagctatttagtaatgtaacattgataaagcactgtattacatttgatcatttccttcccaaatatgacatgtgatcatcagaaccacatttggaagcaggtagggcaggtggcgttatttccattctgcaagtatggaaactggagctctagaggttaatgacttgctcaaggtcacaaagcatgtgagtggtagaatttgacctcaaactcagaacttctgccagacacggtggctcataagcatgagcctgtaatcccaacactttgagaggccaaggcaggaagatcacttgaggccaggagttctgacaccagcctgggcaacatagtgagaccccatccctgcaaaaaataaaattagcccagtgtggtggtgggtacctgtagtcctagctgcctaggaggcagaggcgagaagatcgcttgagctcagaaattcgaggctgcagtgaactactattgtgccactgccctctagcctgactgacagaatgagactctgtcccagaaagtaaacaaaaaaacccagaacttctaacttcaaatctcatgatctgtccaccatagcaagcagccctcacaattctcaacctctatagaactcactctcctcatttgcaaaaatgagacatttggcccagaaaattacaggccattccagcttaaaattctgtgtctgatgaatcactggctggaagggactttaagaaatcacttagtcatattccttgcttccagaaggactctatctaaactattttgaaaagaaaatatcagcccttttcttacagtcccagtgcagaaaagggccccagagagtgtccaagtgcatttgggagtgagaaagaaacgaggagctacagagccagtgctcagcagggtgatccatttcttgggctcagaagcagtgagtcttgcctccctggatgtgaatgttcagccctgagatcaatatctgaagtaggagaggagagtcacaagcatgctttgctggttagaaaggaagtctgtaagagagatcagaaaactggtaactctgtgaagaggaaaagaagagctaagtgactcagtaatgatcttaaagtttattaaggactcctggagagtgcgatgactacaaatcagtggtaatgtttctacttaaagatagaaacggcagaatcctgctcattcagcaggtgtgacaagcagaaagctatgctaatctagccttactttgcttgtatcggaggggttggtggcagaatgggagtgaaaggggcttctccctgaagacggtgcctaggagccccactccagtcttcccttctctctcagcacagttctcagccggctggtgtaccagttagtgtctagtaacctttctaggacaagggactaccagtagacaactaccagcaagcacagcaagttgcaagttcagtctcacattgctcagctaacccggttataattttaaaaactgatttggctccatgttcttcctatgtcactcccatgaaatagatgttactttttatttaaaaaaaaaaaaaagtagtgactgagatcagaagacaagtaattatcacaactctacaacttacagagcttagacaaggcatttcctactctgggtcttgatttctcatctgtgaaatgggctaacaatagccacttcaaagttaaatatttctgaggattagccaggcgcagtggctcacacctgtaatcctagcactttgggaggctaaggcaggtggatcacttgaggtcaggagtttgagaccagcctggccagcatggcgaaaccccatctgtactaaaaatacaaaaattagttgggcatggtggtgagtaccggtaatcccagctacccggttggctgagacaggagaattgcttgaaactgggaggcagaggttgcagtgagccaagattatgcctctgcactccagcctgagcaacagagggagaatacatctcaaaaaaaaaaaaaaaaaaaaaaaaattctgaggatcaaatggggaaacatagatgagcatgctgtgtaacagtttacatcattattaaaaggagtccaatttcaggcttttctgtaaaccacaaggtcacagatgtttctttttattctgccttaattccattcccaagccaaaatcagaatcacagcagtttatcctcacttactatgtgtcaagcacataaccacctttaatcctcacaaaaatattatgaagtagatatattacccctattttattatctggaaactatattctcacaaagataagcatcttgcccaagatcacatggctactaagtaacagagacaaagcggaaaccaaggctgtctcaaggcaaagctgtgctctcagaccttcagggctctgaagaactggggccctgtcctacctgagtacagccccagtcctcttggtttcaagttgcagttgatctcctggcaggccttccagggggtctcctcagctgttctgagtctagatcaggtcctttgcttagtcccttagctaaagcttcatcttaatccatagtttagtccattctggcggctataacgaagtaccataaactggatacattataaacaacagaggtttattgctcacagttctgaaggctgaaaagtccaaggtgaaggtgccggtagattcagtgtttggtgagggcccactttctggttcatagatggtgccttcttgctgtgatctcacgtattggaagaactaactagctcccttgggcctattttataggggcactaaccctattcatgaggctctaccctcataacctaatcacctcccagaaggccccacttcctaaataccatatgaatttgggagggggggcgggccataaacatccagaccatagcaatcagcttaccccgattcacactccaccgtctcctctctttttcctgtccttattcctaggtggcttgctgacccctctcatgttcctctcccactccacacattcctctttggaacatcctacattctcttccccacctttctctcagaagcagatacttccccataaggatcttgtacctctccccagttttcccagcccatgacattagcccatcaagcctagatcaaatgccaatttccccagcatgtttactgtgtttcctttcactggaaataaattttagcatgttaaagacagcctctatattacttatgaatatcacagaatgtgaattttcaaaactgtgaaaaccacagaagtcattgctcagttgcctttattttatagatgaggaaactgaggcccagacaagttaatttactgcccacagttataactgtaggctagagctggagctgattccaaatgcagtcagtattgttgtcaaaatagtttaaactgggcatgttattgtatccgcatcctccagtctggtgtggccccttggtcaaagtttggaaaggagtttcgcccttgccacaacagtctgattggactcagaccatgaatcataagaaatgttttcttttacttaaacctgttcactcctcaataggctacaaagaactattggccattcaactttttttttttttttttgagacggagtcttgctctgtcacccaggctggagtgcagtggtgtgatcttggctcactgcaagctccacctcccaggttcacaccattctcctgcctcagcctcctgagtagctgggactacaggcacccactaccacgcccagctaattttttgtattttttagtagagacggggtttcaccgtgttagccaggatggtctcgatcttctgacctcgtgatccgcccgcctcggccacccaaagtgctgggattataggcgtgagccaccgtgcccggcctgccactcaactttaatttgtggccaggaagagttaagtctccccttagcttgcctgtcttttaggttcaataataccagatctttttgctttttctcacagttcttgttctccaacaatttcatcatctttatttctatctgttgaactatatccaagtgctccatgcatctcaaactgtgaagtccagaagtggacaaagaagtctcatgaaggtatgagaaagtgacgatgacctcacaattccttcaaactgtgcttccgttggtgcggccaactttcatgctcgtgtttcaagcgatagccgggcctcactggctcaagttcagcgtattatcctcatttggctggacactgcttagcctgtgtttgtgataatgattgtttcctccatgtagcatccagaacttttccgattgagcttttttccctttgttcctgactactactccaattcatcaactcatttgggactctaatcctattcttccacctcttaattcttaaccccagctactgtcccaagtagcttagcacattaaaagtccctggaattcacccctgagacttctggcccctcaaagcacttctccctcatggctccaggattggataaagccagtagtccatctcccagtacacacaaggcactcacacaaggttataagttctggataaaataagagatcaccagaaagccttccaagaggcatgtagctaagggtcattacatgggtagattcagagataactgactacacttagacctaacttgggtatgatggtgggagtctccaagattttcctttggctcagaaatgtgataattatgaatatttgcacttataaatcacttatctccattagcgtaagctacacttataatgatatacattaccccagtttacagatgaagaaattaaggctcagtgaggttaaggtcacacagcccagattagtacttatgtttcctgtctttaaattccttgaactttctgtatttcagcaggttttaaaatcttagaattcctaaaaatcccgtgtgtgagttgggtatggtgcttttgaaaaatagagattccaggccgggcacggtggcctacgcctgtaatcccaacactttgggaggtcgaggtgggcggatcatgaggtcaggagatcgagaccatcctggctaacacagtgaaaccccgtctctactaaaaatacaaaaaattagccaggcgtggcggcatgtgcctgtagtcccagctactcgagaggctgaggcaggagaatggcatgaacctgggaggcggagcttgtaatgagccaagattgcaccacggcactccagcctgggcgacagagcgagactccatctcaaaaaaaaaaaaaaagagagagattctagggccctggctctaagacatactgattgcttaagtctgagtggagccctgggatctgcgttttaataagcaccgtagagggttttgagtaagcctttgcatgccatacttgaagaaaccctctcctaaactatgctgtctaggccagaccctttaaatactacagatctacctttgccctgggataaagctggcacataaaaaccagccacagaaacctcctgatccagacagtagctcagagggctctctgatgaccctaagacccaggactgtggtgctcagagcctgccaccaaccctggttccgtcctgtttttgtcctcttcagttttgctgacgcattgaactcctctctttagagcactctgctttgatcccactcaggtcttagatatgctctcacccctgattttgtcggcctcggctgctccagatgagaaagcctatctccctaaggcctttccagatgccgctgtaaaatggatctgaaacctgactcatgagagacaatctgaagactttatctggggaactttctactcccgtgcaccccagctgggcaacatttacaaactgctctgagggaaagcttcacagccagtttccccagagaggcatagtggttcttacagtcctactaaactaagtttacaatctattgttcctgaaaaaccagatactccaggaggcggatagatgactagggaatggacagcgcaatgaatgttgattgggcatgcacagtacacaggcactgcactgatttctttccatgagttgtgtcttcgtctcctttcacccataaggagcacagccaggatggtttcacctggtgcctgctctctactcccagggcacttagggattgtgtgttccttggattacaaacatagccctgctacctacacatccctcgggtctttcaggatcacaaaatgtgcaagtggtctctggctggattctcttatgtgtgttttatcaaggaacaagtagattcctgatgaaaaaaagtttttagactgaaagcagactaacagagtggttgaaaattgacatgggacgcaaccgaactcccagtcttggtagacacattccacttactgcctcttctctattcccttttccaagtgcaggaatcttcttttttatttttatttatgtatttattttattttatatttttgagatggagtttcactgttttgcccaggctggagtgaagtggcgcgatcttagcttactgcaatctctgcctcctgggttcaagcgatcctcctgcctcagcctcccgagtagctgggattataggcgcccgccaccacgcccagctaatttttgtatttttaatagagataaggtttcaccctgttggccaggctggtctcaaactcctgacctcaggcgatccacccgccttggtctcccaaagtgctgggattacagacatgagccaccacgcctggcaggcatcttctgctcaataggcttgagtcttcctgcactttttcagaagcaaatccagcttgtgatagtggggcagcatgcaataacatatgctggcagcaaatcccaacacagtgggaagaaactgcttttcctgtacattcgtctctactgtcttgtgacaatctgaagagaaattcccaaacataagtctcctgagtgattgtcaggtgtataccttgccttattgttagcagacgtgaaagctctttgagaagacagcaaagtatttggagctggaaggaaaggggtgtttggagccttgttagagaccagctgtagagccttagaatgttctctatataggaaagcttacattgtgctgaaagaaacagttgcctattgggttataacttggcgagttatgtaatgatacaaatgttggatgacttgttaaaggatctgagagcattatggcaaaattctataccctatccttaattagatcaagttaaactgaaagggaaaagcagtctggtttgctaaccacagtggaagtattgctttcgggtggaattcatatccggattgcattgtctggcttgaggataatacacaggaagcaatctggagtttttctttcttttggttttgatatttcagttacaaggaacttgaagtctaggaactggctttgcaatgttaacagttatcacagccagctagccaaaatgtccctgtttaagatcttgctgtttatcataacatgaagtgtgctctatgccgtgtatgatttccaatacacatgtgttagtaattactaccaatatgagtatctacccagccattaatcaaggcacccaacacatcctgccaatgtactttgaaactttatctgctgaaaaagcaaaattcccctccgctaatgaacacttttaggaaagcaggctggttaagagtgtctgaagcatttgagtgacagctccagagaactcccatttatgaccgcaggtgacctagcaaaaactgggaaatataagcacagttctacattttagtttctcctaaagatcatcagtttaataataacagttggcctttactgagccctgatcaaaagtctcttgacatgttttttctcctttaataatcccaggacataaggtctgttaatatccctacttcccgattaggaaactgaagctcagagaggctaagtagtttgcaaaaattcattcatggaggaaatgacagagccagggtactaaccctggtgtgctgactccggaactcatgcttcttggattccattcttctttcaaaaccgcttggtgcctccaaagagaaaaatggtttggtaattagtcccatttgcttccagtgatgaagaggaactctttgatgttgatatcttttttttttttttttaatggaatctcactcttgtcatccaggctggagtgcagtggtgcaatcttggctctctgcaacctccacctcccgggttcaagtgattctgttgcctcagcctcccatgtagctgggattacaggcgcctccaccaagaatggctaatttttgtatttttagtagagatggggtttcaacatgttggccaggctggtcttgaactcctgatctcaactgatcctcctgcctccagccacccaatgtgctgggattacaggcgtgagccactgcacgtggccggatgttgatatctttcaaacatttattgagcactgaccttgtcccaaggggttaaacagaccatatcactgaatccacccaataaacaaataaggtaggttgtagcatctctgttttactgtcaagtaaccacctgttccgtcccatcatccagcgttgcccctgtggccctaagggttgaccgactttctgtttgagtggagtatgtaaataggaccaaaaagccatgtggtagttgtaggagagaggacacagcaatggaagcccaaaagtgtggttctcatcctggacaccatcattcgtgataactctcttcatctcctctgtacctgtgttcctttttcgtgcctatagtatttcctttaactaaagtggaagtgttatctgaagtttcatgaaaatagcatatgcatcagaaatagggagatatcagctgggtgcagtggctcacgcctataatcccagcactttggaaggccgaggcaggcggatcactggaggtcaggagttcaagaccagcctggccaatatggaaaccctgtctctactaaaaacacaaaaattagccgggcatggtggtgggcgcctgtaatcccagctactcgggaagctgaggcatgagaattgcttgaacccaggaggaggttgcagtgagctgagatcacaccagtgcactccagcctgggtgacagtgtgcgacacagtctcaaaaaaaaaaaaaaaggaaatagggagaaagatattttttctaattcaggatcttccactaaatatcagtattcaaattatgtagcctttttgaccctcagtatcccaatccgtaaaatgaaggcaatagtacccagctctaaatgttgttgtaaagattaaatgagacaacacctatggtatgtgcagcacagtacctgatatgtatcagtagtagggccctttaaatgtcacttctgtccctcttctcaactccccacctcaccacccgtattagtaagtagtgcttacaatacagataagatggggtgtttgcgaacagcgtcgtgccatccacagtgtcacttatcgggcggcaatatcaagtagtggttaaactctttgaatccctttaagtagactgatgaagttgaaatctctgctccaccatttcctgtgtgactttgagacatttattgaacctccctgggcctcagtttcctctttctttaaaatgggttagtacttctctcatggggtttctgagagggctgaattcattatatactacattcacttagaaaatacctggcccagagtgaacacttattcgatgttagctgccattattattagttatttatttatctctgtgacctcttgtaagcttattaaaggagctgtgcagagtgagaccatgaaacagattttctagtgcaaacggggctgctcacaggaggctcgtggagtctgagttgctgaccttggccccattagcaccgttctctaaccagctcaggcacggggctgtaatgaggattattgaagtaacatatggaaaactcttagagttagctcttgggaaaggaaaaaggcactaaataaatacaaggaattattaaaaaccgggagacgacctcacagggatgctgagccttgtatgttatttgctattctaagaagaaactggggcaagaagccaacttcatcaccaggcgacaaagtggtctcctggctgctgttcaagggatggcagcatgcagcatcacctccaggccatcacagcctcttcctggctgcaggaagctcagctttcccacgaaaaagaagggctgggtcctatgccagatgctatgcctgctgcctcccatatctcgtgcccaaatacccctcctttgaggagagctgggaggtgatattctaagtgagaacctaccaagtagaatattgatggtaaattccctctggtactagtgcagatgacttcggggccaccagcaatctgcttccacagcaggactccagtcccagactgggccaagctcggggcttcgttgccaagccttaacaagtatgtggagagcacacagctctgtaattctggagataacagtccatcagtctctacttacaactttaccacccacccctgtgacattcctctctccagaaccaatcctaaccctcaaatgaaatatacttaaagtggtctccaggtatcacttgtgaaatggtgcacaggaggcatccaagaatgaatcaagatctggcccacagccaccacacagcttggggcctctggtttccccgtggtatcagtggcataagattaatttctatggctccaagcaatgattacagaaacatcctatttctctttgctacaaaatagagaatatcttagccatgatgtcttacactataaaatcttagaagatgaggatagtgtctaagtctcatcactcaagaatatagcacttcatgacatgtacctttatttatacttttctggtaacaatatagttttaaaatactcaaggcctttctaaataatggtataaatatgatatctcaatcctcaaaactaccaacaaatttaaggtatttataacacatacaaccaatacttatgcataaatattataaaaacatggcctacctctcaatgtgcatagcaaaaatagtttggaaaagaaaaaacagaaataaaaattccaccactcaaaataaaaaatagttatctttccttcttcaaccagtttcaaagatgctacattaaccatccactatgaaagggatcaaacatttcagcagccttttaaacctagaagaagtccttaaaaatgtaaagattagacagtagaatattttctctggcatttaagatttttgaagggtctagttaggatctagtaagttcttcagaaaggttaggctgactataaagacaacactgcaaaatttagaagattctctagttcacttactacaatggactgtgttttttcttagagatcaggattaattattaaaatatttaaagaaaaagatgtttctaaggctgctaggaagacaaatcataacagtagatcccaataataagcctatgtgtaaaacagtctcttaaaaaagaggtggcatgtggccgggcgtgtagctcatgcctgtaatcccagcactttgggaggccaaggcaggcacgtcatctgaggtcaggagttcgagaccagcctggccaatatggtgaaaccccgtctctactaaaaatacaaaaattagctgggcatggtagtgcacacctgtaatctcagctactccggaggctgagacagaagaatagcttgaaccctggaggcggaggcagcagtgagcggagattgtgccattgtactccagcctgggtgacagagcccgactctgtctcaaaaaaaaaaaaaaaaaaaaaagaagtggcatgcatatttaaaagtagttacaaagaaagtcttggcagtttttcagagctcccttcatgtaatcactctattacagtgcactcctcaagttgaaaagctcccatttatttaacatttttttaaagaattaaatattttccttatttatccaatttgcaaacgtaaagcaaggctgcatcatctctcctttttccgcatccttctttccgtccactaaggtagttctctgggactgttgacagcttctgaaggtgatttgatgtgaactcccccctgactcctggtttgtctgcttcttataaagagatagtatgctccagagagcaccagaggcagttcttacccagcaatcccggaagcaattttcttctgcttttcttactcaccagagccctcctggaggtttcaagcaaaggagctgagcagtttgcagtagctactagatagaggttcataatggaatagcagcttcaggtttttaatccatcattagaaatagttgttttgcaacttgagagagaaaaagtagaaatctatggcataatgaagggggaaaaatgggtcatgttactgtagagatagatgcaaattctatattatgtcataagtgaaagctttttcggtccatatgggtataaattaataagagagaatgctgtcagcgaagaaagtgtaagtactttgtctggagagtaagagaccggccagttagtcctaataaatccgagggtttggggagcctcttttgagataggtgatgcattgcgcattattagagaatctcttggcatgagtacttttgcaccaagcatctgcttttaaggtctcttcatgaatgttcttcttatgtgctgatatctttatgcttacacaaacttggtggaaggcactattgttgcatcattaaattacctcactgtattctacaactaccctacctaatatgctccaatcactcttactgtattttgttttcttcataacatttccctgtctgaaattattttattcatgtggtatcatttaagtgcttattatctctctcaccctgctcccatcaccactggagtaaaagctgtaagtagacaccttgtcatcttctcctgtatatgcaagtttccattttgtttcataattagcttctctctcctcccagcaaggttttcaagatccaacccaaagactgcttaaggagtggaacttagacttcttttacttcttcaagagtcacttcatggataaaaagcatcctgttcttgggactttgactcagcagagccaagaactttcctataagctattgcttggttgttaaggaagcacaacagaataccagcctgacgtgtcacattctgcatgcgctcatttataatacagtgtggtatttttcacctcctatctgcagcaagatgagataatcgctggctggtgtgagtttttttagtatctctttgcatcaatagatctagttttcagactatatacttaagtttataaaacaattgctaacatttgttttctttaatcagattcaatttgattcttattaagaccatgttttagaaagcccccaatggccctcataatagtgggaagttttagaaacaaaggccaatattatgaacacattaatatataacccaggtgtcatggaagtgctctcaaataggaaacgtggaagacattagttgcctgcatcccaagtcagagacttattttcttaatttgctttctgtgcctccacaatggtctttttccttagctttggaaagaaattataacagccagctaactttattgggtaacatgcatcaagccccatagcagaggttagatatgcattaccttgtttgcataacaaccttatgaggaaggtactaataaaatatgggtataaaagacctccatagttaaggaatgaggaaataataatgcaagtctcttttcctacaacataatggtcctaaaacgtatgtatttctttgcatcttttaaaatgcagcataaatggggtattctaatatcattttgtttttcttcaggtttctcttttgtacattttaataagtttaaaatatataaagtggccaggcatggtggctcacgcctgtaatcccagcactttgggaggctgaggcgggcacctgaggtcaggagttcgagactagcctggccaacatggtgaaaccccatctctactaaaagtacaaaaattaaccaggcatggtggtggatgcttgtaatcccagctactcaggaggctgaggcgggagaattgcttgaacccaggaggcggaggttgcagtgagctgagatcacaccactgcactccagcctaggcgacgagagtgagactccatctgaaagaaaagaaaagaaaaaaaagaaaaagaaaagagaaagatttatatttgcttgcagtgaaaataaatgcagaattttccacagtgaaaagttaaagtttttctctaacttcttccctcagcctctgtccctcctctcaagataagttacaaccctccaaaaatatattgttcagtgaaaccacgatggtatagaatagaagtctacagttagtctacgatgtgttgttgacagctgcgtctaacattctttttaaagattgcatagtatttcattatgcaggataccataatggccgtttcctttttgatggacatttaggccaagttttcctttgtgaaaagtgctgaaatgaacattcttgtctttcctgtgtctttgtgtccttttgtgagtaaattaagcacaacttcttagaaatgaaactgctgggtcaattgtatatgtatcctaaattttgtcaaattctttttttaacagcttacaccaaattatattcccacattggttatagcaattttcaatattatgagttttggcttgtattttaaatatcttcattttccttttagatgttcacatagctcccaactggaaaactgtacccataccctgccaccatctccaccaagaaccctcttgccctatgcatatcatatgtgtataacagtattaccaagtataatagtactttctgaatatccctttctttcctcctttatgtaaaatatgtacaatctgatgatattatttgctaaatacataaatgtatttacagatggctttctaaagactaagtgatataatccaaactttagaaaatcagattttgctcacaaggggtttggaaagtgccttttcaggatcgtaattaaacttagctaattgtaattccaagattgatgcaagaaggcaaaaggttcaagaatgaagtcaatttttcctgaggttaggactaaatctgtaaattctggttatatgaatcgctaaagaattattgcgcagggatcaataaatcacttctaaagcagtgttagaaggctgttccacctcctcagtatactagttattaggctcaagagtgttgggcaaactggttcttttagcttttaacattgcagtaaatggcttggcaacagatttaacattttctttgtaacatccaaggttagctctttttttttccttaagatctggaatgttcccaacacaaagaaatgataaatgtttgaggtgagggacattccagtcactctaactggatcactacctgtcacaaacatgcatcaaagtaacacttacaccctagaagtgtgaacagtcaccatgtatcaattaaacaaacaaaaaagcccagcccgaccttggaccaattaaaacagaatctctgaagatggaactctttttttttcccccccgcaaggttagctctttagtcactggccagaaaacctctaatcccagcagaattttagagctattaagtactttagttcttagccacttagaaatcacaatgacataatgatgctttacaagaagaagaggtaggggaggagggaagaatttctactcctcctcctcagtgacatgagagtaaagaagaaaaatgagaggttataaccatgaatatctgcatgttatgtttacttgaacaaaaatgcaaattttatctcttattgaaaagaattgtttttgaacaaaagtgaatagctaaaaatagtgattctgtacaaccaactgagggactggttttcctttagtttttttgtatttgtttgtttgctttgtttttgttttggcttctcaacactgagcatagctggtggggcagaggcagattcaacactccacaccctctcaggagggtaggctctgagggttaaaatgttgaggggcagatgtcgcttgtgaagcgtcacataccgcgtgaccatggcagagagttccttgagcagtgaaaagcactttcctttcccaacagatagtcttatgtgtgcaccaatcccaagcagaaatcatgattttctttactctataggtgataagcatgagattcttccccaagaagaatgctgaaaaatcagaaaggatataaaaatggaggaaggggtgggatattcaggaaactaccaaaatatgtacatgtgaaaataaatttcatgaaactgattctttggttaaatagcgttttaaaaatctcttcaaagctctcaaatgggcctttgaaaaattaaattacaccacattggatctgaatttagcatgtaattttctaacacatttttatttttttattttttatatgtttttaattatactttaagttctagggtacatgtgcacaacgtgcaggttaacacaaacattttaaagttagaggttctacgtcaatgaaataaggctaaaacatgaaccttgggaagaaacattggaaactttagtacaaaggaagttacgaatgaatatgattaagtttagaaagctttcctaggagaggaaatgtgagatgttgattcaggttttcgttcaaagaatgaaagcattatttaaaatatattttgtgatgcaaacagggaaacatcatagtatttttgtgtgtgtgtgctgaatctaagctccattttacagctagtgtgtccccaataaaccatcctaattagaaagcccctggaaatctccagcattatcttaattaaattagcctaatctaataaatgcatcataattaagaggactgtgccattctttagtgttcagcacaccaggcattagatgatttgtcccactttcagccgtcagttgtcatgcttgctaaaagaaaagaaaaatgatagcaccagtcatcgtagtccctcaaggaatcatccatctagttcttgaattttctttacaacacctctgtcaattatttcttcctcttcagagcatctagtgacagggaactcactaagccattttgatctatttcatctttgaacatatggaataattttagccataagaaacctcagggaattttttttaattccttcaacatagacctaacatagtacccagacaactatttttacgtccaatttcaaacaacctggaaaaacagcggatcagtggaacactaaaggctatagggagactatgatcattcttgcccaaaggaattgcaaaaaggcaggtgtgtaaatagtatttacatataggatggacctctccacctttttctagtacagattaatttttaattttcccaacatctataaattgccagaatggtaaggtagtggggaaacactttctcacaatgtacacagacttgaaagctgttgacctgtcctccttatgacagacagttcttggcaaccccaaggagagatatggctgaggcagaaatcacattatctagctcttcggctatacacatattgggctctgataattagaacattgatccacaagacaacctttgagtatgctgttcttttccttcacagcaaacacgtatagtcattatcgtttgcttgtttgtttgtttgtttctttctttctttcttttttgagacagagtctcatctggagactcccaggctggagtgcagctcactgcaacctctgcctcccgggttcacgccattctcctgcctcagccttctgagtagctgggactacaggcacccgccaccatgcccagctaatttttcgtatttttagtagagacagggtttcaccatgttagccaggatggtctcgatctcctgacctcatgatccgcccacctcgacctcccaaagtgctgagattacaggcatgagatcagttattttttttttaagacacagagtctcactgtgttgcccaggctggcttcaaactcctgggctcaagcaatccttcaacctcagccttctaagtagctgggactacacatggctcatcagtgataattttaaacacaaaaatacacatttttatttgcttatgcaaacaaaggaacgattataatttcctgcaactagtaaatatcatatgctaaatcctttttttctaattccacctcttccccaccacaccatgtaatagctttagagttgttttttttggggaggagggaaggggtgttatgtgtatttttttgtcttttgccaagtctctaagtgcctctgaagccaatttttaaaagttgtgcattgtgagatcacagttgctttagggcatacaggatataagcacaaaatgatggactgtagccaggtagtgaggctctaattgtgtcagaaagaagaacattttcatcatgacataacgaaaactgtatttttcaaagaaaaagatctaaatctgtatcaagtgataacattagttttcctacttttaaaaacaaaatctagtctattattaatagaatgaaatgtcagccttaggcaatttgctgtgaaaaaccaactgaaatgaaacatggcattttattcgttattcaaatggccaaataaaacaaggtgtaattagtcctgacttcctgttcttgctcacacacctgaggcccctccccgctctgctgcagctctgcataaccaggctctcaggggaagcagtggaggcagccttcttggacaacagctcacttgtctacacagtcaaaagtatgtatttgatcaaaatggttgggaggaggacaggtgttacttagagaattacctgtgtaactagaacaagaaaaggaggcagcatttgcagaatgtttgcaaatctttcaggaacttgattcaaggagtgtgtcagatgttaaatccaggcatatatgtatatggctacttgtgtgtgtgtgtgtgtgtgtaatagtgtaatttcacttttttaaaaaatgaagacattcacaattttagccagaatagttggtgcaaggtccataagtgctacctgctaagaatataattccttctacctctaatgtttcattatcaaattaaaagagttctctcctcagtggatacttcatttatcatagctctccttggaaagctgacctctaaacatgaacttctagaaggaacacagaataagaacaagggaaaagcattcgggaaggagggtggctttgaaaggagttagctgggaaaacccttgaaaaagaaagtgaatccatttctgtacatacaattattgactgacggggcagtttacagttttaagttcgtgtgcactcatgccctgtttgagatgcctgttttgtggttcctcagagaccacactagccacatttgaacaccattagattagactagagccaggactctgcaaagggaggctcttcctcagcctctgacagaatcaccaccaaatctggctgtcctccttgccctgagcaattgaacttggctctgtggagggagcctcaaccaactgaagcatcatttggagaacagatgaaaaataaagaagcgaagccttttgaattctaaagttttagctttttccaaaagtaaggcattttcctctcattctcaatctcttcttccattcagttttctcctcccatattcttagtcgtgattacatagattaaggcaaggaactgggggtttcactaatgaactcggggaaattttgagggacatctcctgtcctttgactttggggaaagttcttccattgctaaggaaaaaagttgtattggatgtaattgtttgttaaatgcaaagaactaactgctgggcattctaggagtccgtacatgaactgttttacgtgggtttctgcaattccatagagtcgaagacaccaataggagctgtggcccctttgcctagtttgactttagtcctttggagtttcataattctgaggggatcattgtatttcagtggacaggttccaaatgcacagaagactgacagcattgtctgataaagcatctcccattttatcccatttggaatgtaatccaagttacaacaatagctaataattacctgctgtaattgtagcaacagaatagctgaatgtgcacctctagctgatttatgtatgcaatttctcattctcagctctctataatccattctccacccccccaccccccacccccaacgctttggagccttgaaagcattcaatacaaattttcacaatgtaggtaactttgaagtgtggcttgtcaggtcatgctgacttatttttgtacttgcatagggaattggtgaggatgaatctatttttttagctaacaagtgtaacttgagaatttgtgaatgagtgacagatggggtgggaacctttttttccttcacgtattgtgaaatgtactcctgtctactcatgggaatgagtcacatttgcaaaaagccataatattcattagtgccaaaacgacattttttagttgctcttgcaatgagctgtaagtaggacaactgcccatcctagtttacccgaaacagttattatttattcctataattatcaatggttacctatttatttcatcctcagaaatgtcccggcttgggcaatatatgtttaccctgcatatccagattgtggggggaaatccagtattttcatgtgccatgcccaaatggcagcttatttaaaaaaacagaaaattcttggaattaacggtcaaggatacgtgagagattagaaatcaacatttcacattaattcctgtgtaagaaaattatacgtaaacatagactgttaaaacaggcatagcaaatatgtttcaactcaggggccaacactaattggttggtagtggctgcccctagcatcactggagaaggactctgaaaccgagttggggatcaatgggatatagggcttgccgtattactgatgtctgccataagctctggaaaagctagttgtaaaatgtatgctaggtattaaatgtcaccaccatagagccagatgaggttttagtgataatccaacccagtgttttcaaaatgtgttcccagaacactgatccttcaacatgattcacagaacacatgttccatggtccagtaagattgagaatgatgcctgccatatttctctctcagaaattcagtgtatattggcacagagctctaaaaagttctgtttaactttctgacagatgtttaactttgtttaacccagtgcttggtaaacctatttggccacagaaaccttttcaatgttatctgtcaacttgctacagaactagtttcttggtacacatttgaggaaactctagtcttagcccattccttgcatttcacgaataaggaaactataaccccaaatgagagactgactggaccacagtcaacttagttgatctatggaccaggcaaaactggaactcagtgatataagagttaagaagaaattatttaggcagatagtgagggtataggagtccttggtaaggttttccttttaatgaaaagcagccccaaaattatactaacgagcagcctgtaaaattgagctgcagacacagacaagcaagcgggaagcttgcatgggtgaatgccagcagttgtgccaataggaacaggcacctgagactaggcatgttcaaaatggcagctccaccttcccttttctttgccagccacatgtacagtaaggagcagatgacatgggctagccaagtggaaagcccatttgcataataagattagggtggggtggccagccttcccaaaacgtcacacctggtccaaccaatctgtgggccctacgtaaatcggacaccaccacctcaaacctgcctataaaatccagtgcactcccattcgggagcccctctgtctcaaaaaaagagagagagctgttctcctttatctttctttcgcctattaaacctttgcttctaaacccactccttgtgtgtgtccatgtccttcatctttttggtgcaaaacaacgacgaaccccaggtatttaccccagacaatgaggctgcttcatcagaactgctgactccaagtcctaggtcctttccactgcatcaacaatgaggaaaatattagaagcaatctaagattttaatagcttctggcagcacagatatttagtagatttcacttatctatttttataggttttggttttttgttggtggtgggtttttatttggtttttttttttttttttgtgatgagatcttgctttgtcactcaggctagagtgcagtggcacaatcatagctcactgctgcctcgaattcctgggctcaagtgatcctcccacctcagcctcctgagtacctgggactactgacacgtgccaccatgcccagttagttttcaaattttttttgtagagacagggtcttgtcatcttgcccagactggtctctaactcctgggctgaagtgatccttccaccttggcctcctaaagtgctgggattataggcgtgagccaccatgcccagcctgtatttgtttttaaaagatggtaaataaatatctgtatattcctagtgtcagacactaagctacctctcatggtcaaaaagaaaaaaaaaaggcaagataaaatcatttttgtagttgagttttatctgggctggtccatccttctattttatcctttttccttaggagataaagtggttatttgaggaaagacttgctagacatgaatctggttttggttcaaattctattttattatttcctgggctttgaatttcaaaaagccaatctatttattggtctctttggggccataaggttaaagtacatctgttgtccacacaaatttagctattggccttcgagctaagcagtcatgaaattatagccatagtaaatttagacaacgattaatttcacttcggtctgcctataagtccacatgacagaataaacatagtgtgtcatgtggttaatgtgaacacatgtaaaaaattaagaaatctttggtgaccagacaaaaaatactccataaaaattaattagtgtttcattgtggatgtatgaaatgcaatacttatagatggcctgacttggagcttaggcagcaacaaaacttatcttgggcatcactttcaaatttcgttttggtggttctccagttcgtggcagaccactgccattcctttgaggaaaaggaacacctggaaaatataaccattgctgaagcacttatctctctggggttttttcctaccctttattttcattattataccattacagaaactggttgcttcagttttcttcaagtatggacttcatgaagccatgtggttgcatgtgctttgggaggaggaggcagctgggggctaaatttgccatcctgaaatcacccgtgacatccctttgaagatacattttgtcaggaagcacaaatcagtgaagttgtgaggaagaaatggagagacatctttcaacataaccttgtttccccttgagcataaaggaattgatttaaaggagaaaataaagactcaacagtttttaaaggcttttatttaataagcacctgattgtttccattaactggcttttaacatttaccattttgcttagcaaagttggagaacattagccaagattcactgatgaaactttataagcgttataagtcagatttgtttcattttaaaagccacatgtttaaaatacagtgcacagagaattttcatgatacgtagttgtggttcaataaaataaagatagccaaaagaaactgtcactcataaaatctatatttcctgctaagtgttagtattaaaatagatactgctagtcaacttgtaagccaagcaatgccatatgtgattttttaacataagctatttgtagtctatactagaaagtgtatcttagactttgcagtgatttgttggttcctttcattaatcatgaatttattatcataaaaatcaacacccatgaccctatcttggagaatcggagtgttctgagcattcccagatgtgtactgcagctccagtatacagttcagagccccactgccagttgccaggatcacaagagaaagatattagtagaccacgtcagggaggtgaatttttaaatgttcttacaccacccaagaatggaagtgactggtggttttcaaggacagccatttggtctgaagcagctgcagccccttgattttaattatcctcctgaccctttgatccctaaccaaaaaggccctaggactgtggacagatgcagccactctcctttaacaactggactcagaccaagtcagcagtcacatttaacctcaccttgaaatgtagaaagtgaacaattacatattgaacattttcatgtaaaacatcttcttgaatttcaatccagccacatcctgctagtgcgataatgtgatccttgaatttttggcaccatctaatttttaagctggaatgtttggaaaatccttacggggagggaggaatcattatgcaacaacaacaatacacacacacacacacatatgtatgtgtacgtatacatatttataaaaaacaatttcaaaatcccagcacagaatagtataaagaaatatgccatcttacagaactataatgttacaatcctttttccttttatgtactataatcctttatgaacaaggaaaattcaatactggagaatattatctcctctccaacaaattgacttcaacttgagtattatatccaaagaaacttaatctgtaagtatgaagctatacccaactttgaaagatttttgaagcagtacaagtttctttcttcttcctcttttttttttttccttttttttgagacagagtctcgctctgtcacccaggctggagtgcagtggcacgatcttgactcactgcaaccttcacctcccgggttcacgccattctcctgcctcagcctcctgagtagctgggactacaggcatgcaccaccatgcccggctaatttttgtatttttagtagagacggggtttcaccatgctggccaggctggtcttgcttgaactcctgaccttgtgatctgcccgcctcggcctcccaaagtgctgggattacaggcttgagccaccatgcctggtgcaatacaggtttctatgtgatggaaaaatctaagctcattaggtaaaatatagtcattgtatttccttatgtctacaattggattttcttctccgttagcccctgctactagtctcatgaactaagaaacctggcttagctgacatctatgcttccagtcgattcctgcattgcggttgaagtgaaaaaagccccttgatgaatgaatgaataattgattgatgaatgaatgaatgaatgagtatgactagatcttctaatccttttacattttatttccaattagtacaaggtaattttcatacgctgtttatggtcttgaaatctgacagccagtcccaactggtttattcttatattagcaacttaattcttttgaaggggcatgtaccatgcccactaattttgcaaggtttggctctccagtttccctcagctccttgtttgtgtggcaattacatagctatttaacagctgcactagaaattaaagaggaagaatcagtaggctttgttaaaacatgtgtctatccatagatacatgttttgatgaaagatgaaagccaaaagcattaaggaaaatgaaattttggagactacgtggtttttattgtttgtgttcttatttttaattgctatagataaatgagagttgctgtatctaaaaatataatgacaactacttcacaaggtacttgtgaaaataaaataaggtcatatttgcatataatatgcattcaataaatattctctttcccttaatttgaatttttataagtccttaagaattgtcattgttcccaaatattgtatgatctttccatcctaattatgagatcataattacatatttttatgattttatggcagaaaataaaaaatgtgattgaagttgaaatttatcagaagttcagaatgggaatgtagataataagattttaattttttgatatgctacccagatactattcactagataaaaggcttccaggtattcaaaatggaatgaataaatgtccgagggggttctcaagtcaaattttacttgagtggattctctcttagccacattccacccacactcctctctcaatcaaaacccctctccactcttagcccatagcaattaaacagggctttcaggatctggaggaaagtgagaatgtatcccctagaaagagatcaaattgaggatggcaaatgtgtttcatttcagccttcaactttagttgctttgtagccttaaacagctgtgctgaggattctcagacattctgtctcactagcaaagaacattctgatgagtgagtgatgtctgccacaggaagaagggggatagtgtccttgcctgtgccatgcatttaccaaacctatacttcatcctattttgtatgtttcactgtttagcttgtcaccctagtatctctttccctaaatgataccagcaacaagaatttaatgtgagagaaatttcaagaggtcaaaatttaaccaacagatctcctcccatttacctctttagagaatagtaaatgttttgagttctttgccaggaagctggtggaattatgacctttgagaaactgaactaaacaaacatgactgtagcacacccatctcgtccaatgtgtggtgccaaacttcaaaactctaagattctgttagtttagacaagaaggtgatgcatctttaatcagctacatgaagagtggatgaggcagatttccttttctcatatatgcactaactagattattttcagtttaattttatgctttttaaatgcacttcagtttgagttggtgaaagtctataagcctctctccatatatattttaaagcacaaactgtggccgatattaaactatttgttcagtcctttcttcatctgtaagcatattcttctttgataagctcaatggcaatgtgccctgtttgaaaatgtaggtttgactgctattcggatgtggtgaggtcaacagattaggagatgactgtcattggaaagatactaaatagtttgttattcatagttcccaagaggagggggcatgccacaccacaggggactgcaggggacgtgccagggtcagtcagaaggccaaggagcaagggggaaatgtggacaggtgcctttgcctaggaacccacaggaaagggataggtgaggcaaggtacgcagggttagaactgcctgttttgagtaattccagtgggttctcaagcacaggggctgtttctggttgtctggtatctggccctgggttgatgtggggagggaagttgtggccctgagtatgagagcccaatagagggggtgcagagtgtgtgggctctggactggttagtttgcatatggagggcatgctcccaggagggtctttaacacctctaggaactggctaaccctgggatgggcagtccctgcagggtcagcaatgtcctagatgcaaaattgaatgcatgcaaaattatgttctttttgtatgtttctctctgtactcaaaaataattaacctcattcatttgataattgatcatttgtccctttctgatatcgtctgtattgtttcctcatgccattatttgatatcaaatgtatttatgccaatttccccaactagaaatcaactacttcttgattgtttaaaaaaaatgcaatttttaacttttaaaattgatccatagagtattgaacatagttgatgctttaaaatatttattatcagccccacattactttagaacatgcatccgatgaaataacaaatagtgaagaaatctgtgctctaatagatttgtaaaatgctacatacatattacatctccctccttgatgtttgcaattcacatttccttatttaaggccctgggaaggcctgcagcaaagaaatttgtttaacgttgtctcaatccagccatttactaaacttatttgaccatgaaattttttctcattgagtacctgctaacaacccgtgaatatgttgcagaatgcttttctgtactgtttcttccatggaatttgtactttaaaaaaataaattaagactgattataaactgagtgatgatgagtttaaggctaaagaaaataatcagtaagtgctataaagtgcttgaaatataccttaatactggcagaaaagttaagacaatgaatgcattttctgcctcagtctaactcatctatttagtcatctgaaatggctcattatgtaataaaactcttcagcaaccgcatatggcaaaatgattggtgcttgtaaaccactaggctgacctgtttttgctttttaaatatgcatgttttttgttctccacctcagtgaataaaattgaaacagcatctcagattgtaatacataggagaaataatgcagagaaaagaataaatttgcccagtaaggtataagtaaaataattagcatgagccatgcatattgctttcagggaaagcaactgacagccagggaaagtcagttattgacgtaagtgcctgtcaagtcaccagttctatgttgttaaaatgtggtaagttagggtgtgacccaagaggaggaggaaaaaaaaaaaaaaaaaaccctgcaaatattttgatggcaggctctccctaaaaacaaaaagggcagcatagtttctggccagtatttagatcagtgtgtgtttgatctatgattggaatcatttgctcaatggaactagcaatggcagagcaaagaggctcaactgtgactttaggaaagtcattgagccttccagttcaggttcctcatctgtatgaagagacaaaatgtcaagggttttttgttaaatggaagagtgtatttttaatgattgtgttaaaaaatatttcacaaaatgatgtagaaaattctttgatgaagggtgcaagtaattaatggcttagcttacttggaatatactaggatacaatcatgtttctgagatcacaggcccacactggacctttaaatgtattgatggatttggcaccttgtctttatcacaaccatggtacttaactttccatgttatactgaaattagctcttgatgggcctttctatcctattggaatgtaagtttttccagggtagaggcctggtcttatattaacttactctctaggttctagcacaatgtttggcatatgaatgtattaagcatgccttttaattttcagtgtctctgctgctttggcatgcgagggaccagaggtacaatatacatttttaaaaaatggttgcttgggaggttgaggcaggagaatggcatgaacccgggaggcggagcttgcagtgagctgagatcgcgccactgcactccagcctgggcgagacagcgagactccatctcaaaaacaaacaaaaaaaatggttgctatgtgaaacaagtgagcaacctggatggaaagccaagactctgtgaggcgggtcattctggtccagaacttatcagaccaacacttcttaaagtgcacatgatcacctaggggatctgaactgattcagtagatttggggtgagggtcaagatactgcacttctaacaagcttccaggtgatgctgatgctgctggcctcaggaccacactttgaggagcaaaaagcaggagtggggaatcattttctataaagatccagatactacataattggggctttgagggccatataatatgttgcaactactacttgactctgactataatgcaaaagcagacatagacaacatgtaaatgaatgagcatggttatgttccccgccccccaccaaaaaaaaaaaaccttatttaaggactccgaaatgtgaactttatgtcacaaaatactcttcttcttttgatttttttcaaacccttaaaagtataaaaaccattcttagctcaaggaccttataaaaacaggcagtaggcttgcaggctataagttcactgagttagaggacaacatactagtcacttaggtagttggcaaatgtttccctgtggagtacatctaaccaaaagaaacgaatccttctctctatggaacctctgttgcatttttttatgcttcattttcccccagtaggtggtttatatcttttttatggaatgtagaaacactctaattcacagacagactcaactagtttcagagtttagcaggcgttattttttctattacctgtagtaggtaatgcagttcctcacacatagaagaagctctgttagtgtatattcagtttattttagtctgttgaagatgcctttagcttggtcttaaggaagaatagttcctagatgggattaatgaacagggtaaggagataattccaaggagaagaaaatgtgggcacagaaaagtaggcaggtaatatttgagggctatgtaaggagcagtaagtccatgcaaatattcgacagaaacagaggattagtataagaaaacgatagggccaagttatatgaaaacccacagtgacagatctgaagtttagagaatgatgtatgtagggaaaaacctcaagggcattaatctgatgacagaatatagaaagaatttatagtctgctggtgatggagagaccaattaaaacactaaagccacagttaatactgatgggtgaggatctggactgtggctttggaaagataacagaaaaaaaagaaagagactggaggatgactctgggctggaaagttcttcaagactttatgacaacaaagaaaaccatacagtgccccagaatcaagaaatactgtcctgctccgttgcccccaaaataatatggtttgcattgcatagaatgctcagttggctgattattgtatgttctttaattccccaggtcttatctcttctttggtgggaatcacatatttactgttgagcatggtttctggggttgatactcagagtattagcaaactcatttgctttattaactttattttcaaattaaattagacaaaaacctgtattattctactctaaatacagaaaaaacatgtcttccgtgtcatatttcacaaaaggatgtgaaatccaagtaattttataggaaactggacttagagaaaatctctaagtgctcattaagagctaaatggacaatattttcccagagaattcaatccttttagttctaagtggcagatttctacatatttctttaaaaataaatcccatttggggtttttttagggcagctttgggctttgttttgttttgtttgtatgtttgtttcttggtaaaatgtaaaggccaccaaatgctactgagaatttgaggtgctgggggaagagaggagagagagtgagagaacctgtgttcaaacagtctggcagcctgaaatttcccacacgaaggacctgattgtttgggaaaggaaaagtgctgacgagcaagaatgaattacagcacaactgctatatctctccacatcttggaggccaaggcggtctgctagaaagttttgtaaatatcagaaatgtggaaggcattaaatctgttactgctcagctgatcagaagtcttaaggtcaacaaaaatattgctgcctgtgattttttaacatgatgataagtttcttttcatatattaaatattttgagcataatgtttatattttctatttttctttagataagactaatagataaaattgtaataaatggaggaggtatttgttataaagcattttataagacactgagtttctgttccttttataactgaaatggtctttctgagtttgatagcatcacttgggttgataaaatgtacaagatgctttacaaagaaaacctgtgggaattgtctagtcattaatttcacagtctaaattgtagagtttccattagtaacactgacattgttttttttttaatcaaacaaacatcattttgcatagcaaccagccttcacttctgctttattgttttaaacatcaccatttcctttctttccctcctatcctttgacctccatttggcctgcagatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtaaggaggggtgcctggtaatgggggataaaggggtgtcaatggtctaatgactccagtatcttgggcatgcaaatgtgcctttccaatgcaaatggcacaatggtgttctaattcaaacttcatttccctgaaaacctttataaattgaactgttccgacatttaggcacccatcaactatctctgatgtcaacatttgttccttttaatgtagaatgtttccactccattaacttgaattatttaaaatgtaaggtatccaaattatttttgtctttctctagtaaatgaagcatagaaacacaattgaaataccatatcaagcaaagttaaacgataaatgactcaggaaatcattcatgagaattttaagtgattgaatactttttaatgttctcatttttactaaattctagaattttgtctcttttgttaagaccccattattccttctaaatgtattataaacttgcaatcactaggtgagaatattcaagaatcaatgttgtattaaagaggggtacgcagagaatgggctatttctgttgttctgttcatttttgacaggattcagtctccagggagttgaaaaacttgatatcaaagtattatattttacatttttattgtgttttgatcaataccaataatttagaatagttggaagtgttttaagcactgtagtgtatatactattcctaaatccataaattgatgagtgctctgttaattggttgctttcaaaataatggttaaaatatagaaagaatattaaaatccttgaggtctgtacttttttaaactatttaatagcaccaatatctccattatgtggaggtgaagaaggcaagatgtgagccaccatttatagctccttcaagaactggcccacaataattagctttaaaagtagggccaggtgaggtagctcatgcctgtaatcccagcactttgggagcccgaggcaggaggatcgctcgaggccaggagtttgagaccagactgggcaacatactgagaccctgtctcaaaaaacaaaacaaaacaaaacaaaaaaacacttttttaaagttagcctggcctggtggcgtgtacttgtactcccagctattcaggaggctgaggaggtaaggagggaggattgcttgagcccatgaggtcaaggttacattgagttatgatgataccactgccctccagcctggaagacaaagcaagaccccatctcttaaaaaaagagaaaaatttaaaaataaaaagtaacgattactgatgactaaaagtatgtacctttactttcagtgaaaggatcctccacattacctttggtagaaaacatcttggagtgcctcaagggaccttgtcctattaataaaaacaaacattctatatgtagtaacaactaatacttacatgacacttacaaaatgcacacacacacacacacacacacaatcatttatactttgccgtagcctacgaggtattattagtgttccttttttataactgaggcctggagaggtagaagaaacttgttcaaagtcacacaataatttgaaccaagacagtcttgctccagggcccatattaaccaccctatcatactgataggtatttcaaaatgctgcatgaatgaaaaatgaatgataaaaagatgtttaaaatttcactaatgagttagcagtattattcaggggtgggttatgtagcaaacttcttaagccatcttagaatacagtgaaggaaacaaacttccataaaaatcctgtctgctaatgatgatcagatgtgtctccaagttcagatagagcacttttaaatgaaattctttatttgcttgcaagattgctagaaatatgataaattttgggttgtgctgctttcatactacaaatattaaatgaaatcatattagatttaagtaaaagcctgtcaacttaatttaaccaacatttattaagatcctactaagtgccacacagtgcaggtataaatgtggttaagagacaattcctgatatcaaggagttctcaatctaacagcagataaacacatttttttaaaaaaagccgggcgcgggccgggcgcggtggctcacgcctgtaatcccagcactttgggaggccgaggcgggtggatcatgaggtcaggagatcgagaccatcctggctgacaaggtgaaaccccgtctctactaaaaatacaaaaaattagccgggcgcggtggcgggcgcctgtagtcccagctactcgggaggctgaggcaggagaattgcgtgaacccgggaagcggagcttgcagtgagccgagattgcgccactgcagtccgcagtctggcctgggcgacagagcgagactccgtctcaaaaaaacaaaaaaaacaaaaaaaacaaaaaaaaacaaaaaaaaaaaaacaaaaaaaacaaaaaagctgggtgcaatggctcacacctgtaatcccagcactttgggaggccaaggaggagatcaagatcagcctggccaacatggtaaaaccccatctctactaaaaatacaaaaattagccaggcatgatggcaggcagctgtagtcccagctacccaggagactgagatcatgccactgcactccagcctgggcaacagagcgaggctcagtctcaaaaaaaagaaaaaaaaaatgtaaaatgataaagtaatattataataagtggtataagagaaatcgaaagcattttaagaacttataaaagttaaatgcatgatatataagatatatataaaatcatatatatactataaaatgagatatttcactgcctcttgaaaccagctgcagaatccaactgggatagacccaaactctcaccatactgatctttaacttttaatgtggttcttctgtgtaaaagcctctgaactgccagtcctcttttgccagtcctttcaaatcatctgcctcaggtactgaatatgagaaaagtatccctctagttctatatggtacgtatctttcatgttcgggacttcaacagagatagtggatttcttccagtgcccagctttccatgtgacactgctgaacttactgagacatccgacacctttgggtacctctgactatagatagatcgtatgtgactttagataaattgaagggagagtaaggaaactggacatagcaagaatgaagaggtgtgaagattcagtctgctaagcctaacataaagtgctttagaaaactggctccttggccttgtgaaatatgaataattttttaaaaaacaaaagattttagtgttttaatccctaagaacagttatgtgaagtgggagagaacctcagataaattcttagcctcaacttatgactcaaagtaagaaatttttatattttacttattctagcactaaattagactcacccatattcctattgaattgcttcctgaagcatgttattactacatcagctgtcgttggcagcctatctatcagagggtagaaaggtttctttttgaaattaaaatctcagcaaagccatctctaaaagtttaacaacctacaaattagaaactttctaaattccactgtcccatgcgtcaagttttagaatgatacaaaagaaattacagcttaagaacagtggctagcattcatttagtgtcacctaggagccaagcactgttcttcatttttacagagatcacctcatttcatcctcacaaatatcacaccatttaaaattttcttatttttttaaattgacaaataataattgtacacattcgtggggtatgtggttatgctttgatacatattacgtatagtgatcagatcagggtaattagcatatccatcatctcaaacatttatcatttgtttgtgttgagaacactcaatatcctccttctagctacttaagaccatataaggtattattgttaactatagtcatcctgtagtggtatggaacattagaacgtattcctcttacacttttagctgtaattttgtatcctttgacagtctcttcccattccccccttctccttcccctttccagcccctattagcccctgttctgcttttttacttctgagattaactttttttttttttgagacggagtctcgctctgtcacccaggctggagtgcagtggcgcgatcttggctcactgcaagctctgccttccgggttcacgccattctcctgcctcagcctcccgagtagctgggactacaggcgcctgccaccacgcccgtctaattttttgtatttttagtagagatggggtttcgccgtgttagccaggatggtcttgatctcctgacctcgtcatccacccgcctcggcctcccaaagtgctgggattacaggcgtgagccacctcgcccggccaagatgaacttttttaacagcaagttaagcaccgcatgttctcactcatatgtgaaaactaaaaatcaccctattttatagttgaagaaactgaagttttaaaaggctaagtaatgaccaagatcacacatatacacacagcacacacacatgcctgggagtcaaggattcaaacctaggcagtgtgactcctgaatctgccctctaccctacagcataaaatccaaataaactcatcatcactggggcagctacagttccttgccttcatcaggcaacaggattttggatctgagcacagcatttttcagggcatataattgagcacttttcggtcattctcaagaatacagtgagtgactactgtaagggaggccgtggttcaccctcgagacacacagcagcgaacaagcaggcctctgccatcactgcacgaacactccagaaggggggcagagtaacccagtaaactcataaggcattccagcagcagcaagtgctgtgaaagaaatgaaggtggctgatgggatgcggtgatcaggaagcctgctccaaagagatgacatttggtctccgataggagcctgagaaggagccagtagggaaggctggggaaagagtgctccggaccaagggaacaaatgccctggtgaggacagccagatgtgcctaagttgcaggaagaagtccagggtaactggaacatcaggtggaagagttagctcagaggcttgggccgcagccggggtatgccggacacagggcctatagtcaccgttagtttggctaaataaaattgaaaatcatggagggtttaaactgattcatattttctaactgactctctggttggtagaagcctattgcagcaggacagaggagagatgcgggtgcctcaggaggatatggcggagatgagggagtgagtcagattcgagttgggttcagaggcaggtccaaaaccctgcagtggttccatgtggaggcgaggggaggaaaggaatcagggatgactctgtggattcagctataccgtttgtgaggacaacggtgccaatctctgaaatgaggaagacggaaaaggaataggattggagacagaaggaattaagtgctgtcttttgaacgtgctgtgtgtgtgtgtgtgtgtgtgtgtgtgtctgtgtgtgtatttggagatggagtctcgctctgtcactcaggctggagtgtaatgccgcgatctcggctcactgcaacctccacctcctgggttcaagtgattcttttgcctcagcctcccaaatagctgggactacagtcacgagccaccatgcccggctaatttttgtatttttagtaaagatggggttttgccatggtggccaggctggtctcaaactcctgacctcaagtgatccgcccaccttggcctcccaaagtgctagaattacaggcatgagccactgcgtccagcctgaacatgctgtgtttgaaatctctatttagctagccatgtggatgtgtcaggccggtagttgcaaatataaacatagatgtctagagcacagggtgagaatgctgtatttggggagcatcaggatatagatggtaactaaagctgtgggactggatacacctccagacagatcagctagggaggaagagggaatggggacgaggaagggatctgaatctgagcctgggatactcctgcctgttgaaagaggagttgccagcaaacaagataagaaagaaaagcccccagggtgtgagagaaaccaggcagaatgctgtaagggaaggcaagagaaagagtttccagaagacagggctgcaagatgtgtctgctgctgctgagagctccaatcagatgcgggccaggagaaaaccactggggtcagcaacagtggatgttgtcagcgattttagcaagaggagcttgaggaatctgaacagggttaaagatcaaatggtactggttgagaaaagtttgtgaaatatggaaagagaagcagcaaataacatacttgttggagaagtttggcttaactgccaactaagagataggagctggtatctggaatggagcatggggtcaaaaagatggtttttacaatgtgtgtgttttcaggcaggatttactagaatataggctgaagaagatagtgcaagagagaaaaatagatcatgcaggagggaggagagtaagatggggaaaggaaatggaatctgtactagatggcgagagggtaccctcaagaactagctggcagagagagcttctcaagaatttcctatgtaaataggaaagatccatgtaaacatgtaaaataaatacagacatctcaagttcccaccactgcctccccctgtgattgtaaaatgaattacacagactgtcaaatgaatagctttatgagctccgaagagggcaagatggtggccctgaaatgtgggatgaaggaagctggattaaaccggaccttgtggataaagaggattggggtcaggaggagaggagggcagggcagcgttaaaaaggtagggaagagaaccagcgtgacacagattggcaggtcctgttagacacaggttctcagtgctacgaataatcagataaaatgtgtgcccctttgaagtgacattgtgaagcgtgctgtgatgtgaaatgtggaattgttcctggtaatcacatagggtaaagcccttggtgctgggaccactgccgtgcctctctaggcagagattccattcactgggttttgaaaacttttggagaaaagctaaaccagtttaactttggccattcttcgtgttatctattttaaaataacctttcatggtattttatgatggctctatgctttggtttcttcatctggagaaaatcagattgttgtaagggttgagtgggttaatccactggggtggtgcctagcacacagtgtaggccattattatttttaaataccatatttttatttttaaaaagctaaaatgtacggataaaaagaagatataaaaatcatgtctaggccaggcatggtggctcatgcctataatcccagcactttgggaggctgaggcagaaaaatcacttagtccagaagttcaagaccagctggagcaacatagtgagacccccatctctataaaaaataaaaaaaatagccaggcatggtggtgcacacctgtagtcccagctacttggaaggctgaggtgggagggtcacttgagcccagcaggtcaaggcagaagtagctgggatggcaccaccgcactccagcttgggtgacagagtgagaccctgtctcaaaaaataaaaataaaaaagcatgtctaatcctagtgccttatgacagtcactcttaatatttttatctttccaattttttcctacatgtgagtacttaaattttgctgtatctactcttttgaacttttttttttaatttaacctattctgtcacagacatctacccatgtcattaaacgttctttaaaaccattctaattcctttgtagttgttcaacatttataaagttatgtgtcactgacattgcttcggttactctgatctgtaaatgattcttgctgtattggtaattatagcaactgatttaaaagagaggaaaagaagtaaataatagaaatgagagaaaggatgtatttattcctcaaatcttgaaaggcaaaatatgtataaaaggataaactccatgactcagttcagtaaagtcagttagagatttaaaacatatctatataatatatattatgtttattttatttttatatgtttatatattttacttatatgtattaattatatatatttaaaaaaaaattttttttttgaaaagtctcgctctgtcgctctgttgcccaggatggagtgtggtggcgtgatctcggctcactgcaagctccacctcctgggttcacaccattctcctgcctcagcctcccaagtagctgggactaccatgcccatctaatttttttttttttgtagttttagtagagatggggtttcaccgtgttagccaggatggtctcgatctcctgaccttgtgatccgcccacctcggcctcccaaagtgctgggattacaggtgtgagccaccgcgcccagccagtaggtttttaaaatgaaaagggagcaccttttaaagtcaaggcaggagactcatttttgtgacatttccactggccaaagcctggagcaggatcgtcggcgtgtgattccttcactctgcgtgggaggcagaataggaaaagttaaggtttaggcaggtaactgttaggtgaacagatgatagtaactacaagggctagaacatgtaactctttcagactggagcctacatccaaaactgaaagtgacggttaataaatatggagaaagacgttaacctgagactccgtagtgttgtttttttttttttctcctgaccagcaggtgcaaagcagatgactgaagtgggaacagagtgggagagggcgggagaatcgccctgaggggaaggcagggaactggctggcacagagagggagatttgatctgcccccgtctccaagagctgctctgacacctgagatgtaaggtgactttcagatttcacaagggttggacaggtgtgcaaaagctagcaaatgtgtgtttattcagggggccccagcctttttggcccctttttcctttgaaaatcagctggaaaaaagtagcaagaatggctttctaaagagaggtcatcagaaggaattttttgttttttaatgattgaaacattttgaatcaggtgaaaagtaactgttttctctccccaatttttcgctaccttgagagtgtgtgtgataacttccatatggtttttgccacccctccccttctcctaaatgcttttatgattccagtaaaatggtctcccgggtcacccccgaccttctgatcgccttcactggcttttcctcagggtttctcagctccctgcatctcctcatcacagagaaaacttctcctggcccataacttgtttttgatggtttgttgtttgccccgtttgtgtccctactccgccagttaatcctgcacactgacttttccagcccccactctcggtgcctacacgaccaggttcaaacaagtcagccccagcgtcccagtcctgcctgtgtttcgagatttgcctcccgttactgcccccagcctgctgctcctctctccttgcacgatctgcgcctcgtccccagacaagctttaccacttcccagttctctttcttcattccagcagaagcctggaaggtgtgtatgaggaaggcatgaagctaggccctctgaggaactcacacgcgcgcacctcatgaaggccacctggaggtcacgtggtgtgggggcaaggtcacagaccacgaggctcaacaacaacagtgctttgcctgtcaccactgctttctagttatgtgaccttcaattacttcacctcttggttccttggtgtccttgtctataaattggacataattcacttcttagtgaggttcattatgatgatgattaaatgaggtaaagtgcccagcagacgccgggcacataggacatatgcaaaaattggtagttccctttctaacccagcgtccatcctcagggaactcatcattttctagcaggcatgatattctaggtgacgtgagtgctgtaaacaagaacgctgggagttcagagaaagagcacagaatagtgcctgggctgaccgtggaagatagcgtatcaagaaaagatggataggagtttcctaaggagtgaaaactatgactaaggtacaggcatggaaaacaagcagggagagagagtccccactttctctgtgtcctaggggaggcttccttgccaccatccttaaaattgcagccccccgggaagtcccatcacagcccgtgcccctcccctgcttgatgactttcctgcttcactcaccaccgtatcatgtacttatttctcttctgtgtcctcacaagatcagaggggtatgtgtgtgtgtgtgtgtggtgtacgtagtggatgtgggtatggtgtgtgggggggtatggtgtgcgtgtgtggtgtgtgtggtgtgtcgtgtgggtgtggcgtgtgtgtggtggtgtggtgaggtgtgtatgtgtggtgtgtgtatgtgcagtgggtgtggcagggtgtgtgtggtgtgtgtgtgggtgtgatgtgtgtggtgtgggtacggtgtgtgcgtggtgtgggtatgtgtagcatgggtatagtgtgtggtgtgtgtgtgtggtgtgggtgtgtgtaggtgcgtgtgtggtggggtgagtatggatgtgtttggggtgtttatggtgggtgtgtgtgtgtgtgtggtggggtgagtatggatgtggtgtgtggggggtgtgtgtgcatggtgtgtggtggggtgtgtgtgtggtggggtgagtatggatgtgtgtggggtgtgtgtgtgtggtgtgtgtggggtgtgtgtgtggtgtgtggtggggtgtgtgtggtggggtgagtatggatgtgtgtggggggtgtgtgtgtggtgtgcggtggggggtatatgtgtgtggtgggtgtgtggtggggtgagtatggatgtgtgtgggtgtgtgtgtgtgtgtggtgtgctgtggggtgtgtgcgtgtggtagggtatggatgtgtggggtgtgtgtgtggtggggtgagtatggacgtgtgtgggggggtgtggtgtgtggtggggtgtgtgtgtttgtgtgtggtggggtatgtatggatatggtgtgtggggagtgtgtggtggggtgtgtgtgtgtgtcctcttcactgcgtatcccccttacttatggagtgcacaccattagatgtgcaggtgaactcagctctctgacttaaggttacatgacttggaagtccaagaagttctggcagatagaggtagaaaatgaagttggaaatcatgagggccattaaatgacaaatttggggttttttattttactgagtagagattctaatcatctcatttttaacagggaaagtgtgctctaggaaaatctagccgacacagggagggcaacgatgaatttgagaaggaggagatgggaagacaagaatggattgtggtagtccaggccccaggcaaagaaagcctacactggatggtagacacagaaataaataggaagggacagcaaacattccagcagagttacctaaacatgactgttttcaatgtcaataaaagactggaaaacatatcacagtagagtcactggaaggaataccaggcagctatccaagagaatgcagtgaacgtatgtattctaaatctactgataggcaaaagtagccaaatgccaagtgaacatgccatgtgaatccatttgtataaatatgtacataaatgtaaatatgttgatatgctgtattaaacttatccaggccatgtgcggtggctcacgcctgtaatcccagcactttgggaggccgaggtgggcagatcacttgaggtcaggagttcgagaccagcctggccaacatggtgaaaccccatctctgctaaaaaaaaaaaaaaatacaaaaattagcagggcgaggtggcacatgcctgtaatcccagccactcagaaggcaggagaatcacttgaacccaggaggcagaggttgcagtgagccaagattgcgccactgcactccagcctgggtgacagagcaagattccgtctcaaaaaaaaaaaaaaaaaaaaaaaaaaaaacacttatctggaacaatacacatcagacttaatgtggtatttgggaatggcatttaggaaggtacccactgatctttactattaggctgcacaattctgtgctatatggttattttcctataagcatgtattattatataaaagaatataagtgacccaagttaaatgtatcttggaaacattaagaatatactttgaaccattgcaattttttaagtctgtcacctaaaatctcttgacatgaaatatgtaaacatcaaaatctgactgcagtttaccttttgactaaaaatctggtaagttgaccctttatttaagaacagtaataatgcaagtgaatttgggaaggcatgatccaaaatcaaaggccctcttattcaagaacagaaccactgtcatactcagttttacccaggagccagaaagcatcagtccttaccctgcaatctctggagaaggttacagtttaaaagcgtgggtattcttcacacaaacacacacacatctttatttcatagtttatagccatttaaaagtacggttgtgatgaccacagtgataaaaatgaaattaataataaatctgtcattaaaagtatattgctttgaagaaagctatttatagtagtactttttaaaaatgagtttctgaagaaacagtacaaataaaaaattgtctgagcctgaatcactctattttattgtgtgtttcggtcaaaaagactttgtatgttattttatttaagggaaatataattctttgcaattattatagataacactgatatcttaactttaccattatctttaatactttcccaggtgccagttcaacagattctgacagtgaaagtttagctttcaaatcaagagctggagctatgccacagtaagtgcctacaattccatcgattatgtggaaacaaagaatggcaacagaatggttggggtatgaaaccatgtttgctgtgctttgaagaaaaaagtcaactgatgttaatcagagatcaaatactgaggttggaacacaatttttttttttttttttttttttgagacagggtctcactctgtcacccaggttgaagtacggtggtgcgacatggctcactgaagccttgacctcccaggctcaagtggtcctcctactttagcctcccaagtagctgggattataggcatacaccaccacacctggctaatctttttttattttttggtagagatggggtctcactgtgttgtccaggctcatctggaactcttggactcaagcgatcctcctgcctcagcttcccaaattgttgggagggattataggcatgagccaacatgtccagcccgaacacaatttttaacttgtaaatttgaactttgaagtctgcatttcatcattgatatgccagaattttaccatatgcaatgttagtttcaaagacagccatctaatttattataaatgtatggaaagagaagtcacattaagagaaaatcaattaaatcattactaaaatgtgaggaccaatttatttatgcaagttggaaaatatctaattaggccagaagtaggttctcctttggatacgatctatatttatttagatcttgtacccgaaattcacaaaacttagttattcctacaaagacataccaattattaaaatgttaatatcttaattatttggcaaaaataaaatctaccagaaattcctattatggaaaagtccataaatattgagtctgttctaataaatttcttttatctgctagtatgtacataaaaattatatccattcagcatcaaataatcagtgatgcttaaaggatcttctaaggttattttaccacccctggtttttataaggagctcaagtttagtgaagttacatggcttgcttcagatttcacagccagctacttgacaaagctgggcctagaaatcaactcttcttaatcttctctaaatatctcactaacttatatgcactaagaaaacacaaaaattccaagataccgacaacaaaattagaaaccagaaaaaagaacagctgttagacttaaaatagacaaccaaaactttgagttaaatataggaccctaaccctaaacatttcaaatctctgcttatcaataaagattggattttttccaaatattttctcttaggattttcaagtttaatacgttagcatcttcaacagcgtctcagttacatctagctacttttcttttactcatgttttgattttgcttaatgtctataaggtacattctataaggtacatgtatatactgaccacagctattctagctgtaggttatgcattcccattgtggaagcaattacagttgaagcggattgcgtatacaaaaagaaacccagcttttctgttgaaacgtttcaaggaattatttctgctaaaaaaaaaaaacaaaaaaacgaaaacaaaaaatattctgactaaacactcaccttcctattttccagagctcaaaagaaaacaacttctgtttccttgacaataggatcatcatctccaaagacaggggtgaccacagctgtgattcaaccactgtctgtccctgtgcaacaggtaagtatgctttgagccagagcccataaggggtcgaactcatcagcaaacttgtggattttaagaatatgactttgattctaactagtatactcccttgaaatattttctaagtggacacaaaattcagagcaaagaaaattgtaggtaatgtttctcctttcagttcactaaaaacaacctttaaccaaaaccacactgccaattagtcaacatttgcatttccattgggaacttctttctctaacagctaataatctgataaactggtgtctgttttagctgtaactatttgattattccctcacatgtgtatgctctttcatatagccaaatttattagctcattacaaattaaaagacaagtctgcataccaacaaaaagctttcccactcctaaaagctaaacaaataagaaaaaacaactcaaattccttgacttcaccatgctttttgatcttgcttttattttattgtaagactgctatagccatgaaagaacaataatataaactactggaaagtagttgtaatgaatttactttgcaaacacaaacaatatgaacttcttttaaaaaaaaaagtagaaaaccattacatctggatgtctctaaatcatggtttaatgaatatgttcaaagacaacactcacagaaaggttttcccccacagtctggaaatgtaaactcattcctaagtaatgagtatgtcttataagtatcaccatgtcctccctcagcctttattacctattgaatgctcaggggtgtttcagccactatagaggccaataggtgctatcgatatgtggaaaatacaaacagtagagagaagacatttgggtccataaacttgaatcaacaagtatcagttactcagagatggcatatatagtacatatttcctttaaaccccttaatcagagtggaatttatagaaatatttgattaaatcagtgggcattttttggtatttgatgtttaaatattgataaatatttattgagtgcttagtacggtgctaggcatttcatgacaggaaaaaatgtcacccaccccattcccaaatggggtgaatgtgacagaatgtatttagatgtaagacagaagcctaggaaatagagagatacacacacatctagatatgtaaataccataataatgtaaagagtgaatttttaaatggattaaattctacaaagacatggaatggaaggtaatttaccccatgtttatagttgggagaatgaagcacccagagaaactccatcgctttattattgcaggcaatgtgacatcaagtaatgctctggaaccagactccctgggtttgaatcccagttctatcacttcctaacggagggaccttaagcaaataaaatgtaacccttcaagccgagtttcttcatctgtaaaatgaagatgataacactatgtatctcataagtttgtcctgaagatccagtgagttaatcttcatatgacacttggaacagtccctggcatagagtaaatattaatactataagagtgttcacatattcttgggacataaaaagacagtgaaaagtgaaacccagacctcttgaatcacaggccagtaaagtcttccagggttaatgaataaactccattagcatcctagcatctctaccgctctgccacaattcttcatgatgtcctgtggcatatttagacacacgataccagatcaccatcatcttgggttaagaagctaacaaccacttacataagtgaataaatccagatcatttaaaaataagtgatagtacacaaagaaatattttccattcactactctgaaatccttatatttctccagagatgaatgtcattgaataggtattttagcacgtttcttttttgcacgtcaataaaaaaaaattcttttctctcctttcccataatccctatatcaaaaaagagtacaagttaaataagataggtagatgtttgataatttaccctccagtgccaatagccaatggcttttatgcattgaatccaaactgtatttaaaaataaaatacattgtctacgagaactttaaaaaagacgcatgtggaagtcccacacacagaaatccatttggtaatagcatttaaaagctcgtggatccccaaggacccagggaacttttaccttgaatatccttttgaacagagaagagtaacagatgtgaaatgaggaagtggaacaatgtctgtactgtaagagcagacgagcaaaatgatgtatggtggtactttcattcactcatttccttcaagtgggtgatccccataatgaaaggtttcttcagcccatcttttaggcaatttatatatttagaatttgatccatatgtctctgcttttgcaggttcacagtccaacttcatatctctgccgacctgatggaaccactactgcctactttcctcctgtttttacaaaggtctgacatctggaagtctcattctctgtgtttgctttggtccttaaatttcatttacatgtggcttcgtgtagcaatctttaaaaattaaaaggaacagattagtaggctgattaccatggttacctttgggactaaatagatatttgttgaacgactgccgtgtgactgtaatcttgtgatgggttctgagagatgtgagcaggaacttgatagagcctaaaatctagtgggaaagccaagacagatagaaaaaaaaaaaaaaaaaaaaaaaaacctgctgtgtaggaaattgcttaggagatctagcaagttttatagaaattcagaaaaactgactaattttccatttgtcctgagtccggaatttgcattgccaggctgaatgacatccatttcattggtcagcctctcaagtcagaaatgcttccatatagcatttcttctctttctttttcctttttccttccttttttttagagaaaattataaaactttattaaaagacattttaaaaggcccaaataaatggagacatatgacatgcttgcagactaatagaccgtataaagccatgactccctgattaatctgtatttaatgtaatctggctaaaattctagcagcttcctgggtttttttgttttggtttggtttgttttttttactttaaattctgggatacacgtgcagaatgtgctggtttgttatgtaggtatacacgtgccatggtggtttgctgcacctatcaacccgtcatctaggttttaagccctgcatgcattaggtatttgtcctaatgctatccctccccttgtcccccacctcccgacaggccccaggtgtgtgatgttcccctcccggtgtccatgtgttctcattgttcaactcccacttataagtaagaacattcagtgtttggttttctgttcctgtgttagtttgctgagaatgatggtttccagcttcatccatgtccctgcaaaggacatgaattcattcttttttatgcctgcatagtattccatagtgtatatgagccacatttaaaaatatggaacgcttcacgaatttgcatgtcatccttgtgcagaggtcatgctaatcttctctgtatcatctcgatcttagtatatatgagctgccaaagcaagcacaggttcctggtttttaattgtttgtttgatatggaatttagcaacctgattcaaaaagttgtgtggaggaaaaaagtggctaagaatagccaggatacacctgaggaaggaaaataaggtagtgttaggaaggagtgggatttgtcctataagatagcaagacgttttaaaggtatagtaattaggacagtatggtactggtacaaggctagagaaattgatgtgtaatcggagtagagcccacaaagtttctgaatacctacagaaacttgcaaattgctggagaaagaatgaattcttcagcagaggtgaaaaagtatccagttggactcctacctcatacttttcacgacaaacaattcctagtaaactaaagacaaatgtgaaagcaaatctataaaacttttgtgaggcagtaaagaaaagcatttttgtaatctccatagaaggagtgattttttttcccttcagctggttgaatccaagctttataaaatatcttttcataagcagttatagtatttccagttgggcacaggcaacaaatgataacaggtggtaacaacttggaaactaccctcctagctagactactaaaaaagaagttatgtaaaaccctgcctaaaaccatgtcaatctgataaccaatgaagtcttcctttgatgtttagaacagaaaatgtttacagaggggtggacactccacatttaggatgtagtttaagagttttgcacaagcagcttcccaaggtcatcaccagaaagggtgtgttgtccaatgtattggtatccaagacacagttgatttgggggtgccagggcccaacacgcctcttggtttaaacaaataaagtccatgctggtggcacaagggaaggaaaagaggaagcaaagatttgctttctttcactaccgggctttcctgcatgggtctggcatgtgtagatattatggaattcctcctgggcaccaagaggaactctcaaatactaagtacaaaatcctgtttcctcccttgcaatccagctcccgcaacatagactttctattagtggtctttcccccttccccaaaagataaccatgaagcattctttgtgctaacagcacagctttaaagagaagtaaaccaaaactctgttctttatataggttgatttttaagaactctcaaactgtcaattcactggaagctcagagccactgaaagctcagagccactagaagctcagagccactggaagctcagagccacttctccagccttccactttctgtgtctggaccatggaacatctctcttctgcagggctgttcccttccttgatgcatctgcttttccctttctcactttaggcagcttctgtctctgatttgcagggtccttcttaggcctggtctctggttttggaggggtaggtttagaaaataatcctgctgatctcctctgtaactcaaactagcctttactttgtcactcatagcaccttcactgggctttctcttaggcatgatgatgacagtgaatggcaggtgggctggctttcatagtccaagggttacctccatctgttttctcatgctactctggaagagattcctaggtctcacagctggtcagaggcagagccagtgctcctgcctgcaggccacctggcagactggtggaccacaggactgtgggtagcatggacgtacatgtgacatttcttcccaaatagacccctccaaagaatcacaatgtcaggtggacttgatggtatggccagaggggtccttgtaaggatcctgaaacccccagggcccccagatcctacacaaagtagatgatccaggttgccaggtgcatcctgtaaaggttgactttcagtctcctttggggctccttgttatgttcccgaaggttctcctaatggcttactatgtttagccatggcttttgccaagataaaaatgttagctccaggaggatccaaatggcaatcctggaataactgtggagctttgactgattaagttacttggcatctacccatttcctacatctttgactttccgacactgaaaaaaaaaaatgcataatcttaggaataaatcaaagtctcttttggtgcctcaaagctgaagcatgaaaaatattttggtgccatttgtagtctatcctgaacagcttcctggacaagcctagagacatttaataggttaatccgtagaagctggaccccataagtgacacttaccctgttttgatctaataaattagctattctatggacccagtcacaaaggaagaaaaatatgatttaaaaccagagattttctccatttaaaaatacggaagaagaaagaacgcaatcagaaatagttgatcatctaaaccttgtcacttaaagacattctagttaactaccaaaatgtctatcaaatgtcttctcagacttcacattagacttttatagttcttctgccaatgtcataggttttagaattccctcagggttttagcacacttactgcaggacattggttacagaattggttttttccaggacatcatttattgtcccatcagataatttaaacacacatgcatacaaacaaacaaaacaattcacacttcctaatgaatgtgaatttgtttgcttttggtgtatatatggataaattatgtttgagttattttgagagtcctacaccttacattcgatccaatattctttttttttttttttttttttttttttttttttgagatggagtcttgctctgtcacccaggctgaagtgcaatggtgtgatcttggctcactgcaacctctgcctcctgagttcaagtgattttcctgttccagcctcctcggtagctgggattacaggtgtctgccaccacgaccggctaatttttgtatttttagtagagacaggatttcgccatgttggtcaggctggtctcgaactgctgaccctaggcgacccacccaccttggcctcccaaagagctggaattacagatgtgagccaccacacctggcctagatccaatattctatagtcagaagtttaaatagtaagaaagtttaaaaggccctattgctagttaattctggagaaggagggtagagagaagatatatgtgagggaaatattaatgtcctgatatttaagaacaagtataaaagctttacttctttgtatctataaaaccaaattaatttctgatctgttggattgtaaagatttattggtctggagttggagtgcggtgagggacaacaaaggcaggagcaaagaaggaggaaatgaaggtcaataaggaagaagtacagcatgtttcattactttactcagaatctcaaaatgagaaaatgtagaaaccccttagcttaataaacttgacataggaaactagtcaggcagaggtggtacatgaaaaggctgaggcatgtgaaaacaaatgcatgtcttttttctcttcttgtctggttttcataagaatctacttttatttagagtgtggtcgtttcaagaaattcacattccacctgcttccttttaaatgtagataaagaaagttaacattggttaccatcaaattccataaatgcagagcagtcagtgcaaatttgcagacaggccagaaagctctacaggacttatggtacactttactcattttatgacttggagagggtgaaaagctgataatcggtgggtccaaaggtgtttatccttacctgagtcagtgctaattatttgatgatgcaagttttgcattttgtgtttgtatctgttttgtctgaggtttggaatttttattctgtgttgtgaaattgcttaaaaatgcaccaaagtctgatggggttttccttgaatttccttgaatttcaggaactgcaaaacacagccgtggcggaaggccaggtggtggttctggagtgccgggtccgtggggcaccccctctgcaggtccagtggtttcggcaagggagtgaaatccaagactctccagatttccgaattctacagaaaagtaaggagaagtgcccatgtccccaaatctgaccattttattctctccagcttcaagaaaaccaagaagggctaagtcattaagatgaattgatctctatgttcaaagagtggcaggatcagataatctacagtgtgttgaaatccagtaaatggaaactatgacccccttgacactctaatgaaagtcatatattctttcgtcttaaaaaatgcatatatacatttgtactcaaatttgcatgaataattttaggaggtttaccaggctcctagagcccatctatgaactgcagttggaaaaatttcttagtgtaagttgatacaggaatttgagtttttatatttatagaaatataaaccgatctatcactttatatcttttgtatgatggagtttgactgtaacatttcttcagacatgtcctagacaaggtaatggaaaggaacaagtaggttttttttaattaaatggaaccccattctaatactttgttctaatttatttttttcatgtggcaaacagaacctagatctacagctgaacctggtaagaatatttttagggtttttttttttggtggtgggggagcagataatgtatcttttgggtctcaatagttctttctttctaccttaaagccgtaagcagaacaatgtttttgtggctccctggaaatgtgaaacccccttaaaaacaatatcttctttatcatggagtctgtacactgcattttacatcaacgtctttattagcaaaacattaagttccattcagacaagaaggtcaagctcagtgacttcatgctttttaaaatacagtcttttaggctcagaaagcaaactaagctgatgatgaaaaaacatcctcctaaaattccagtagagaaggacaatctactgcctatttgtactgatcagaacccactaacaaccccagcttagaaatgtgtctcaaatgagagcagctcaaagaggtaagcaaaatggacccccaggtgtttctcatttgtgtgccctgagccataaacttttactattctgcaagcatgaagaaagtcatcttgcccccagatcactcttaattatcaggtcgtttgaccagatcacagtgctatgtgatccaggagcctcgggcctagctgttccctgcctcagacatattgcgtatttatggttcctcgtggagtgaaatagtgtttgtaaaggaaacaaatttttgtctaggtacttcatcgtatgtcctcctcaagactattttcttttgtatttttcccatcagcagggtcacaatttcacttatttctgaacaaagggtagaaaaacaagtcattttcctgtttctcctgtttgttcctctgcttcagtgtcaagcagatcttgccacatgtgtcttaggagccatgaccttgctctgactcttcttgggggaactggaaagtcctctgtgggccactgcaggtcagattactgcagtcagtccctgaacttctcacatctgtgtactggatctttaaaagcagagtttgaccctattaggatccaacgtttaagggaggctgagtagcatccttagggaacaactggaattgatctgctgccctcctgtcatgaattataagcagagcaagtccccccacttaatgtgtcagtcatcacatcaaatactgtagtcactttccagactgtggaaatatacaactgcatattttgtctgtgaaatgtcattgaataaaattgcataatgctacttttctaatacatggattttctgagattaaatctgctgcatgagctaatatgggaatcctgtagggagttagggcacatcttgtgcatttgctattttaaacaactttagataggtagatataaaagtaggaaccaaatatcttttatctacaagaaatagctttttatgtgaaacaaacctataaagcaatttatgtcttttaatgctttgtgtataaataaggctaaaattttgagccaaaaattgtaaaaatgttactgctagcatgaaataaggcagcttttgacattgcgttttggattcggagtgaactcctgcaactctcttttcatcgtgttgttatacgttgtcatcatgcacataggtgatgatgatttatcaaatgtaggttggaaaatcacaaacagtcatctgcaaagtcaaaacattagttagaaactgcacagcttagttttcagtatgtgtatatttgaaaagggaaaacactcagaatatgctagctaaggaagaataaatttggatgaggagggaggaaggaaacatctcccccgcaccctgcgtcttcatcacttatcctacatacgctccttctgtttcagatctcccccgcgccctgcatcttcatcacttaccctacatacactccttctgtttcacatctaccctgcgccctgcgtcttcatcacttatcctacatacactccttctgtttcagatctcccctgcgccctgcatcttcatcacttaccctacatacactccttctgtttcacatctaccctgcgccctgtgtccttatcacttaccctatatacactccttctgtttcagttagtttgttgctttgcttctaaactatagttttgattgtgaattatttaataaaattagtcctaaacagcttcatggaatcacctgacctctagaacgtacttaaatgccatttgctttaatgtagcaaaatcatgcagaaaagagcaagatatggaaggccttccttttaaatcccttgtcctagcaatgcagaaaaatgtttcctctttgtgttcactgaattttcttatttacatagttagatctgaaagcgtttaagaaaacagattccttcattccaactacaataatagcattttctgaaaaatttctcctggcagagaaatatttctagcaaatctgtcaatacaccaaaaaatattatatagtcaggagctattaaaaactaacacaatgagttttcctgacctacgatgatttctccacaattgtttttaccatgacacgacgagactttcttctttcccttttacagcgttaaaatgctgtgcttcaggaaatcagccgttggcatgcagcattaaataaaatccatgatcatgttttttaaacaaaaaaaacccttaaacacatgaatgaccacgcaagtgactaattatatgagttgttgtgagtaagaacttcagaacaagcaaatgttacagtgtatttgtgcttaaacaatgttttgtcatgcctgtcaaaactaggtatgattcttttactagttgccaagtgttttccttacattgaccttgaagttgctatgtcagaggaaaaaacaaaaaataaatatgactgtttaccttctttaaatgacctgattgactgttatatctaatggacctctgagctattaaactatatagaagtatgtaggaaccggcttccctaaaaactgttttcttagccattgttaagtggaaggaagaaaaacagacgtgactacaatacatctgaggcaagagataaattttataggactaggtcagtgatattttccaaatgctaaaacataaatagcctttgaaattcaggaaaacatttaagcattctgtttttattactgtctcttcctaccctcttcctttcctctgagagagtcactcttgctcgctctctccccctcctctctgtctctttctctcccctcacctccttcattccctgcctctcttcctctttctccatctcactccctcattctttttatttattttttctttactcttctctttactctcttctctttactctcttccttattcatgggcaagatgttttaaagctccagaaataaagttgaaattccctagtacctagatatagccccattaggaattagatatttagataaagaaggaaatagcaggttgtctccaaatggatctgtgcaactgaaacaggtttttcttgtcactgctgcgtcgtatctgtctgatgtgttttacactcccctctctgtctagacagaagtcagcttgcatcacaaatcttttcagactgttttgtgaattaatagctagtcagcttacttaagaccaacatccgtttgtcatagtaccttctctggccttctttgaaattctgactttgtactgatagactccttcaaagactagtctgggggtgggggacacagaagactcatttgacagctgttaatactcagtctcttactcactcagctgtctggaaacagccacaaactgtgttgagttacttctatagcactgtctaatagcgtgcaaaattaaaaacacaaaaacgcgtcttactggttgtggaattatacatataaaagtatattgcctcctgctttcaattttaatttctgctcaccagtgtgacccatgctagatcttgtacggtagagtctaggctttgattctctgattcaaaatataaagtaagttacacttagttaaatgtactaaggtgctgttgtaggagggcaatgatagggatgtttcttgagatcccagtagattgtatgcagtaaaaacttaatgcatgttctaggttaggacggtgggttgaacaaaagtaggccatatgaaacttatagttcaccaagagtgtgacaggatgccctggggtgccacaccacgctgacagggatgctgtaatatatttgaaatttttttatgcaaacacattcaaacttgacatttgacagatatgacacaatgactggcttgaactagttcagaatttcaacattagatcaccctccattcttttctatgacataatctctttgtgaaactgagtttttgatgagtgtgtgataaaaagtaagtacctcatgaaaatccatgtaaaacatgaaatgaggctggctcatccaatctgattccaagagaggtggtacagtgcccagcagatgcacacagccattagtaagaaatagtggttatttaagaataaaataatagtatttttctttcaatttatatgtatttttaaacactaaattgtttaggcataaacacttattaagttctttggaaataactacataacaaacataactattagttatgtcttttggcttaggagcaccatttaaaaagtattgagaaacttagagtcccatgaaccaagaaagtttgttttactctctagaggaggagtgtccaatcttttgaattccctgggccacactggaagaagaattacctggggtcacatataaaatacactaacactaatcatagcttttgagcttaaaaaaaaaatctcataatgttttaggaaagtttatgaatttatgttgggccacattcaaagctgtcctgggccacatgtggctcagaggccacgggttggacaagcttgctctagagggagagggggaagactcaagacacatttgagtacacagcaaaaagaaaattgagtgggttttgaaattcttaatgccaaatgtgcctatttccagtcctcttccaggactcacattccagcctgctggcctatgaactttacctctctcagcagagactgaaggactcttctctgggcaatttaaacatcccgagagaaaaaataaatccaaagataatgatttgggagtttctcttataaagatgccacttagattgtgctatagggaaggccaaagtggataagttcctctcttatactcagagcttaataaactcccatccctgtcagacaagcagagagaaaaggcatctggagaaaacctctagcatgaatgatatagaaaaaaacaagtgaccttcctaaaagggaactttgagaaaatgggtttgcaaagagaggaaaatgtaaaacaaaaacaaacaaacaaaatctctcttaaaggatccaaggaaatcattccacccaagaaataaaaatgaaaagctagaaaaaaaaaagagaggggaggacacttgtaaaacagagttcttgaaatgaaaagttcatagcagaaataaaacgagcagatgtcccacaaagtacagcaaaatgacgaagaagggatgtaagagagaaaaggcaacaaagttagagatgcatagctgaataactgggattccagaaggagagaagaaagaagcggcgagagacaggattatcaatgaaataatttttttaaagttccccaaactgaaagttatcaattgccagatggaaaaatccactgattgcacaacatatggaataaacccagacccaggcacgtcatcatgaaattcagaatttccaggacaaggagatcatgttataagtgtcctgggagaaaacatcaggttatatatacaaactagcaagatgcaaatagcttaggccttctcagcagtcacactagacacaacgagacaatgaagcaagaacttcaaaattgtgaaaaaagttacctacaacttggaattctgcccctaggcaaaacttcacatggaaatctagcaaagatattttcagacttgtaagatcccccaaattttcctctggaacccgacagtgtgctccaccacagcaagagaattaatccagaaaggacaagatgtagaggtggggtacaggaagcaggagatcacatagaagcaagaggcaaagggcatccccaggagggtgacagctgtgcatcaggaatgaagggcaagttcagattgaagcctcgtgtctcgagggacaaatgcaatgaggctttcatcattaggaggttcattgcctctggtccagcccgtcttttatttggatgacagaatggcagggcggtaagcctgacccagaaatctcatgtctacttgggctgtcctgctctcccctccatggactgtcacctggatcagctgggaacactcatcttacccccacagaagcgttctgctttggtcagtcctgacatctagaagtcggccatgttgagtttaattaacccatctatgcctgaggttgcaattttttgaatttttgcaatcagaccttgacgatgaccttgagcagtaggatataagtaactcccaaatgcttagcattccaataatggaacactaggcataaatgggtaaaaagcagaaaataccagcaatctcattgctggatatatacccaaaagaaaggaagtcagtatatcaaatagatatctgcactcccatgtttgttgcagcactattcacaatagttaagatttggaagcaacctaagtatccatcaacagatgcatggctaaaggaaatgtggtacatatactcgatggagtactattcagccataagaaggaatgagatcctatcatttgcaacaacatggatggaactggagctcattatgttaagtgaaataaggcagacacagaaagacaaacatcacatgttcttacttatttgtgtgatctaaaaatcgaaacagtagaaggatggctaccagaggctgggaggggtattgagaggctgtggggggagatgcagatggttaattggtacaaaaatatagttagaaagaaagaataagacctagtatttgatagcacaacagggtgactgtagtcaataagaaattaattgtacattttaaaataactataagagtgtaattggattgtttaattggagtataattggattgaataactaaaagaataaatattataggggacagataccctgttctccatgatgtgattatttcacactgcatgcccttatcaaaacatgtcatgtacccagtaaatatatatacttcctatgtaaccacaattttttttaatttaaagaaacaaaatatggagataccatctccagcaacaactatattcctgctggatgcccacatgaggccccaccagactgctccaccgagtgagccttatatttcccagattcactcaagaccttacccactgagtgccccgtggggcttttggaaactttcaaggacgttgaatctagttgatggcccaagatggttcttgggatctttttcctaacagtgacaaggttactttttctttagtcagccaagatttgtgctcactacttaatttttttaaactaaagaatgcattttttaaggatacatacatatatggtaaacacataaagaaaatcgaaggaattattatctcaaaggagaaggaaaattaaattggggagagcctatgaggtatttctaaagcactgggaatgttttatttcatagacttgaggatagatacacaggggttcatttcactgttattcgttaaatggtacattttaaatatccttctttatatatgatattaaatacaattgacaatttaaaaaaatcctttgcaatttttttcttttctgagacagagtcttgatctgttgcccaggctgcagtgcagtggcatgatcttggttcactgcaacctctgccttccaggttcaagtgattctcctgccttagcctcccaagtagctggaattacaggcatccaccaccacgcccagctaatctttgtatttttagtagagatgggattttgccatgttggccaggctggtctcgagctgctgacctcaggtgatccaccagcctcagcctcccaaagtgctaggattacaggcgtgagttactgcacccagcctcctgtgcaaatattgatacaagcattacatttacccacactggatttcatcttgttgattttagctcagagttcttttttaccaactgtgttagccaaaccatgtggtgtgaaaggtaaaagctggatttcttttttagggacttgggacaaaaaaaaaaaaaacagttgcaaaggaagccatttatgaaaatgtccccttattacccagggaacccagtaatcttatccttgctgcctcatcattttatgagtttccacaaacaaaatggtttttatttgtatttaaccaagtgttaagtaggtccaggaacttgaatgcaattcaaggttgccttctgggagatattgctgtgattttgtaatttttaggtaactataaagaacagaatttatcaccagtaaaaacagtttctgatttagtaatttattaaatgccctcaaatcaaaaccttaggaaatccaaacatgggaaaattagattaaaatgcatcataattaaggttattaataactttaaatttttccatttatactggagacagtttctttagtacagataagtaagtctctaaatccctttatgtgacataagcagtcattttctgatttccattccttaccaaaatttattttacagatgtcttatacgtctttgttcgagtgagatgccaccagatgaaaattcagtattacaacctggctcatctcatttcctcatggctttcttcatttttataatgtcagaaccatacaagctatgatgcttctttctctcaacaaaatgtgagcctcttgtcactgttggatgaacttttctttgagaagaaaagctgaggaacctgtgggacattgtattcaaattttatctagttaaaaaaaaattatctagcaaaaattgctgtgacatttcaatgcatgaggatcactaaaagaacatcctagtgtttattttttatttttctatttttgttctttaattctgtaatttttctaaatgttccacgtgaactatatacaggcatataccttatttatgcatggaagtattcctataaaatcatacacaatgaattctgctcaatcaactttgaaacacacaaaggaagcttgtaggaaaattggtcttactgagaattcctttagaaaatagtctttttacaaagcaagtgtttttttccttcatctaaatttcatgcatgcatttatttaaacataattatagggagcctaccatgtgtgagatgctaagaatatggccatgaacaaaaattgtttctgcactcagaggttatatttcagcgaaccagaaactaacaaactaattacacaataaattatttagcagggtgaggtggcacatagtcccagctacccaggaggctgaggcaggaggattgcttgagcccaggagttcaaggctgcagtgagctatgatcatgccacttcactccagcctgggcaacagtgaaacccctgtttctaaaaaaaagattttaaaaataaaataaaacaaaattgcaccagctttatttgattttgtgattgtcttctactgtctgttaaaatctcccactagaggcctgggcaacagagcaagaccctacctttatgagtcaatagatagatagatattatttaattacagttgtgatgatattatttgtgatagatattatttcattacagttgtgatgtctccaaaaaagtttaccatcctaaaattgctttaaggtggtcaaactgattaagtttaataaaaaaagggattctctgagaaagtaatgtttgtggggaaacataagactgagtaggagagtgccaagtactccaggaggagccagggcttagaaacttaccagagcgtggcttcacaaggagctgccccagagcccatgtgcccagtgctcagaaggcaatgatgtgcgaggcacagaaggagcctgacaagaagcagggacctaattatgcagggcttcagagaccatgttaaaattttttattttatcctcaaagtcatggaaggatgggaggatgataaaatttcgttcttattaagagagccctctgatttagaaggggcaactgtatattcatcctcaggttttctgaaaaatggcatgactaaaagaaccacaaagtcgtagaagcatcagaaggaattctttacaagtcatcaagatcatcgatctaaaaccactttatattatccctactgaataaaattgtatcctgtttttaaatgtaggtttcaaggcacagaattatgtctatgtttatagttgaagcatcctcaggcattgaactggcaaggacatttctctcagtgttcccagaacctctgtctttccaggtgtagatgattcaaggttgagagaagtgcttcccagagagcactaagccctgggaagatagtccagggacgtaagccctggttgtctaggcaggaagtgcccaggtgttactgaaagctgagaagccttcaccactcacagcagcatctgcgaagggagaaggaaagtgacttagcactgcctgaagcccactactccaaacctcgtaagaaggggctgttaagcatgtccacattacaagcttatatcctgttccaatgtgtcttatacctcagaggacatattgccctccccttgtgcagatgaataattctcatgaatcatttggataatgagaataattagttttttcagcatcgggaaactccatttcctgacttaaatctttcattaccttactttatgtaagatttcttgtgtcctgaactaggaaaaatgcagaactagagaggctagaaaaaaagaacatcagctctagaaaaaaagaacatcagctctagaaaaaaagaacatgtgctctagaaaaacagaccatcagctgggtgtagtggctcactcctgtaatcccagcactttgggaggctgaggcgggtggatcacctgaggtcaggagttcgagaccagcctgaccaacatggtgaaaccctgtctctactaaaaatacaaaaaaagttagctgggcatggtggtgtgcacctgtaattccagctacttgggaggctgaggcaggagaatcacttgaatctggaaggcggaggttgcagtgagccaagatagcaccattgcactccagcctgggcgacaagtgaaactccatctcaaaaagaaagaaaaaaagaacatgcgtgtcggagatgggacgccaaccttcagcattttggctctagcattaattagccaggaccctgagagaatcactttgaacacccaggattcattgatattgagcctgaagaaatgagggatttgacctaatcaatctcttacagtactgatcttgtatgtccccttctatggctaaccacacttttaactcattctgtaaccatatgcattcaatttaaaatttcccaatcccttgtaactttccagagacatctcactttccaaatgattaatcttttttttaactttgtttttattttatttatttatttattttatttatttatttatttattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtaatctcattgttcagttcccacctatgagtgagaatatgcggtgtttggttttttgttcttgcgatagtttactgagaatgatgatttccaatttcatccatgtccctacaaaggacatgaactcatcattgtttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatgatatttccagttctagatccctgaggaatcgccacactgacttccgcaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcgaacattttctcccattctgtaggttgcctgttcactctgatggtagtttcttttgccgtgcagaagctctttagtttaattagatcccatgtgtcaattttggcttttgttgccattgcttttggtgttttaagacatgaagtccttgcccatgcaggctacagtaaccaaaacagcatggtattggtaccaaaacagatatatggatcaatggaacagaacagagccctcagaaataacgccacatatctacaactatctgatctttgacaaacctgagaaaaacaggcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcatgacataggcatggacaatttttaattatttaaaagatagagaaccatatacctgtttgtaccttaaaaaatttgtatgttgactggacgcggtggctcacgcctgtaatcccagcactttgggaggctgaggcgggtggatcacgaggtgaggagatccagaccatcctggctaacacagtgaaaccccgtctctactaaaaatacaaaaaaattagccgggcgggcgcctgtagtcccagctactgggcaggctgaggcaggagaatggcatgaacccgggaggcggagcttgcagtgagccgagattgcgccactgcacctccagcctgggcgacagcacgagactctgtctcaaaaaaaaaaaaaaaaaaaaaatgtgtatgttgtatttgtattacctattcaaaaaaataaaaatttttaaatggtagagataaatcttaagaataaagaaaaagaagacaattcaggaaactacatttggttctgtttttacagactcaataggaggggttgcaaagctatcaagacaagtgggagaaaaagaccaaaaagatcctgtctttgtgattataggatcattatagtagatcaaatatttggtcaattttttaaaatactgcataatgaactagaattttaatttcagaagtttgaaataaacttttaatttttaattgcctaaaaattttaattctatattatatttcctacttacatcttatatttcaaaaaatttttgccaaagaaagtttctggcaaacatttttgcttgcaggtgacttaactgcgtttttaagacagcacaattttgaaggaaagagagaaggagggcttaaaaaactataccattgtcatgtgggcattaagagtgtaagcttttggagttggaatagacctgatgattttctcattcaagtttaattcatgtaaaagatgtgtctcaaccccttgataagattacaggaaactcaaaggcaggaaccattaattatctccatatctgcagctataaaatattaagacagtgtactcttaaaaatgcttaacaagtgggtagatgactataaaagcttctaggagctgttcatggatggagattccagactttatctcaaaaaattttctcgacatcttaaaacctttccttaacaagtctttccattcatttaacccaccttctgctctcttgctgcaattaggaaccgtttgttcttattgttcttcaagaaagatgtagaatgtttgagcaacttcttcctgattttaatgtctttgcatttatgatacccatcacagtgttttacttaaattagcatttttggctttctttttttcttttgagacagagtttcacttttgttgcccaggctggagtgcagtggcccgatcttggctcactgcaacctctgcctcccgggttcaagcaattctcctgcctcagcctctcaagtagctgggattacaggcacctgccaccatgcctggctaatttttttgtgtgtgtttttaggagagatggggtttcaccatgttgcccaggttggtcttgaactcctgacctcaagtgatccgcctgcctcggcctcccaaagtgctgggattacaggcatgagccactgcgcctggccttaaattaccataaatggatgaatacttaatatagatttcattgccctttactttttttattatggttaaagaaacatataacatgaaatctaccttcttaaatttttaagtatacactacagtattgttaactgtatgcttaatgttgtgcagcagatgtctagaacgttttcatcttgcatgagtgaaactatgcccactgaacagcaactgccattcctccttgcccccaatgcttggcagccagcattcgaccttctgcttctaagagtatgactagtttagatacctcttaagtggaattttgcagtatttctcctactgtcattgccctttacttttacctcaactaaataatttagattcaatgtagaacacaaaattaataatagaacataaagaataaactaagtttttcacaccccattcaaacatcaaattgaataatatgctgaaagaataaggtgtgtgtttttacaactcttgcaattttaaacctgtattaatatatcttagaaatgagttgaccttgagctacactacaatgctaaactctcagaagcttataatcaccgtagtcctcagatctttcctaaggaacgtaacattttgacacagaagaatccttgcattttagcttttaacaaaatctcaagcagtctgttaaccagattaccatcagcatcatcagaaatggggaaaaggaaaggctttggtgggtggggcagggggttgataaaacctaagaatggagtgagaaatcgagtaaaactcaatgatgcctataggccatattacttggtaatacaaaaaaatagatatatatatttgacccaataacacgacatcaaaaactatatagtttgataatacttggacaaattttgaaatgatagatacatgaatttttttctagaatcaaatacaacaaactctgcatttgcctttgaagagtgagattattaaggggtattaggtatataaagggaattcgattataaagagaaacatttacactttattttatacttagtgtttaatttatttacttttgcacttattaatttgatgtataggtaaaaaattaaaatatttaaagctctcttcaatagacaaaaatgttttttttaaacatatcacttttacctacagttagtacttcttttgtttcagggtttaaaacataaaatgttttgaaacagatttgctgattttcattattgatggtctgaaacgtttgctcttagaaggatgttagtgaaggaggtttatcttatcaaattctatgagttagctactgcaatacagtagagcaccccaaaatttagttgcttaaagcagcaaccataattcggtgggtgaactatttggcttgacctcagctgggtggtttttgtggtctgtgccaggctaggctgaccacagctgggctgtctcagtgcggccatggtcagctgccaggatgacgaggaacgagtcagttagtctaggatggtctcttttggaagggcttatgtctgctccatatggtctcttcctcctacaggttagcacagccttgttcacctaagggttcatcagggttccaagagatggagcagaaacaggccaggcctctcaaggatttggctcagaattggccaacaacatcactttcaccacattctaggctaaagcaactcacagggccagcccaggttcaacggatggggaaatagactctgccactttatgaaggtgttgcagaggcacattaaaaagaggcatgtctacaaaggaaggaataattgcagccattattactaagaaatgtacaatacacggtcttatgctacccccaaaatttgtgaataaccaatagaatcactttgtgggaacccgaaatatatcacttttcttaacgtttgcccacataattatctttatactggtacaatataagcaattattcaactagtaaaactaattaatactctagatatagcttccttttaatgttaacagctaacactggctatgaagcatttgctctgtgccaggcaatgtcctaagcacagtatgtcatatcacaaaagtaggtggtggttagggtttggagtctggaccccagcttgctttgaatccctatgttagtatttattagctgtgtgaccttgggcaagtgaattaaccttattgtgcttccattttctacctataaaatgggctaataataaacttacataactcataagattgacatgatgattagatttaatctatgttaagtgctggtaacaatacctagtgtatagtaagggttatatagctgtcagctcttgttatcgtcatcatcatcatcatcatccccctcacaataaccgtgtggtggttaattttgtgtgtcatgcatgactaatacaaactctgtgaggtagcttctattattgtctccattttacggagaagaacactgaagttcagggagactgaccaaagtcacaaaggcaagatgtggcaggaccctcattcaagccctggcagctgtttcgagtctgggcttttcatgccctacaacactgccatgccacttaacagtaccttccagaatagttgtctacaggtcaaacatatacaggtcatgttcttttttcccccgtggttaacatttcagaagagctttattttccccactgcttggtttgcagctgagcagatataagaggtagctgtatgtacagaaagaactctgacatgcaatcagcttaactcctacatgcaaaatacagagctgcacacttgcagacatctcgttttatcttcacagataacccattgggtatgtattatccccattttatagatgaggacaccgagactgctcttgtccaacatcacaaagaatgggtctacctccaaagctttttctgctaggcagaattgctaaattaaatgtaaagagattctattgtaaacacttttgtaaagtgaatctgtaataatcataacctaatttgtttgttgtggaaaggtggagggtctcacttcttaaaagtgacttcatggttcaactctgatgaatgattctgttctcttcacttccagaggagatttgcaccctagttatcgctgagactttccctgaagatgcagggatctttacatgttcagcaagaaatgattatggatcagcaaccagcactgcccagctggttgtcacctcaggtatgtgaggagtaaaaaaaatgactgggttctgttccccagcaccagtgtggatggccacagcagaaaggcaccgtcctggccaggtgcagtggctcacacctgtaatcccagcactttgggaggccgaggcaggcagatcacttgaggtgaagagttcgagaccagcctggttaacatggtgaaaccctgtctctaccaaaaatacaaaaattagctgagtgtggtggtgcgtgcctgtaatcccagctactctggaggctgaggcaggagaatcacttgaacccagaaggtggatgtggccgtgagccaagatcatcccactgcactccagcctgggtgacagagtcagactccatcaaggaaggaaggaaggaaggaaggaaggaaggaaggaaggaaggaaggaaggaaggaaggaaggaaggaaggaaggaaggaagggagggagggagggagggagggaaggaaggaaggaaggaaggaaggaaggaaggaaggaagggacaaagcgactgtcccaggaagagagctcagctcagccttcaggaatctggccactccaggagtcaccctaacaatctaagttcatcgtgaaacaaaggctttaggggaggggagaagaaggagtgaagtggagatgacaaacaaaaagataatgatcgtgtagcaactgaacacacagggggctttctttaaaatcgtgcagtcttggtcttggaaacgatggagctggtttcctaacatcctcccgctaacctagaatcatattcacattggaaagccacctctgcatcagaggtgcagtcactttctcagcagtgccaacacatgagatctggagatacttgtacaaataagccattgtctgatccactgttgaaacttctgaaaaggtaatacaagataagccttcttgtataaaatgtaatacaagataaaactcagagaagctgtaaaggccttcaaactcaaatttcactgatagtctgtatcaatgatagtatataactaatatgaaaaagaaagcaatgtattgtattattgaagtcaattttcaaaaatatatggatattttctaaactcaaaaacttaccactagggaaggcaatatgaaacagctttttttctttttcttttcttttcttttctttttatttgtctgttttctagttactaatgagcattagcttactttaattgcctcatctctgccattcatcttaaagatatttttaaaatatgtttttgaccaagcctggaacataatgtacatagtagggaatcaataaatgggtcatttgttaaatgatacggacttggagagaacaactgaattgtacttggattccttcagaagagcaagaacttggtgctaggtggcagcagagacacaaccaaaacttatttagggaccttagagtggcaactgtaaatgctttttcatcttcattaagaaaagaaatgggagggtcatcttaagtgggaaatggtttctgtgaatgactactgtaagtgctgaaagaaacctaagtgtcaggatcagagttacagagcaaagaggaccccagcgttttgattccgagttggcttcaacactgtcccatcaaatggccatagcaggagtgcagtgtttaaacaatatggccaaaaccctgggctctataagtctgagtggcaaaaatttgtgtgtaatattttccatttgtttctgcagtaaatctgctataggtcaaacataatcaacaaatattttatttctgagctttttgtttacctcaataagcatttttgagtgcatgccaggagctctgctgggctgtgtgggcaaggtgcagaatctaaaaaagacgtgatctcaagatgctttcagcctattgagggcaacaaataaaaatctctttcgtactgagttatagttggagcaatcacctaatatggaaaaaaatatttttatgagattatgaaattttacttggactccaaggtttaccttccctagctttagatgaatatccacataaaacctttacagcttgagccaatttgagtagtgacagctaggatgttcagtcggacccatggaccaaaacgtgagaggacaaagcattgttggttgatactgtttgtgttgtcactttttttgccaagttctatctttagctcttgtttggaatttttatgattcggtagctgggttccccaaatgtgagctcagtcaggaaatgaaacggtagcactcgttcaaaacaagcttgaaagaaccaggccctccagctggcagtgcttctgcgtcagatgagagcagcacaatcacctcttctttaacaacttcacacaacacagggattctcagaagactctgacagtgtgaaatcacttgttgaactagtggcatcttcttatgtttttcctctctttccccttccttagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgtgagtatttctgcatggttttataataatttccatacccctgttacatttcctgtctggtgagaaaaaaacttttgcctgtattcaactatgtggcaagttggccttgactcatgggaccttgctgccaagtggtgtctttcaacaatataaaagacacctaaaaataaagaagggaaatgaaaagcttggtgaaatctgccctttgctgaaagctataactggttatggctgtgaaaatatctgtgcccagtgtgggcttccaacatacagctaaggatgtagccactccctggaggccatggaaaagggggatctactttcagccctttattaaaagcatttcaaaaagtgagtataagtactttgcatttgttactttaaatattaagtatcagtaagaagatctgatatagacaagcggggaaagactaaaaactgaggctggaaattcagggtgcagatcctggcagggcaatgaaactggagggaagcaggcttgtgggcaagaagagcgcccttcacaacacaggctacttggcttggaattccatggagctgcatatttccatgaataccatcttcacagttgatgtccattattttcttaggatgataaaccttgcatgagctgtttccattggcaccgcacagcagagagttgttatgaatggagccattacaatgtcagagagaggcagaaataaattagctcaaagggttctaccatagcgcaagagaccctgaattactgccctgccagaggttagtggaaatgtaagagtcatagtgaatgtgtatgtattctatgaggtcacattcccatgagaatgtatttgccagaacctaggaaagccccttctatttacccatatctgatgtttttgatttggggcaggaagggcttctttaggggttattctttatttccctagcattgactagcctactcttttctctctgtgatcagttcatttgttagaaatgttagaatttaaaagatatttgaattagaataacaccttacctttgtacatcactttattgtttactgagtgatttcatgaacaacattagactaatcaaataacaaaagcagtcaaaagaataccttaagttaagaaatgggctaacaattatataaaaccagacttctggacaatcttgggttgcagtttcaaaaatcgatatattgctaccctctacttaattttgcattgtgttctggctctcttttaagacagtagggctactcactaagcttgtacacaatagtgtgaaaggtgctggtgaacatttaatacctatgcgccatctccattcagaggctgaacaggtataatgagctaaaaaatggtgtccttaaaagagatttatgctcttgtagcagcaacccataaaattaattgccactgctgacttctttcatctttgcattttgaatatgtatttgcagtgcttttaatgaaacaagggacctgctctccagggagagaaagggcaaatgtgttgaatgactaggacttgactgtggtcttgattaagtaaagtctatctactctaatgggtatcataaattggatgtaaatcacaggagagcaaatacgaggagctgttaagaggcatctacagcccgtcttatctcaggagtttcaacagctctgcagcttttagctctgctttgcagccaggttaatgtatatggcaagggggtaatatctacagaatgtagacaaaacaacttcgcgttcattaagaggatgacagcttaagcacaagtttaaagaacatcaggatttgcttgtgagtgagataaaatatgaatatatataaatatataaatataaatataagataaaatataaaataagatgcagaaaaaatggacttaaatgtatgaggcccaaataaataggttactctcccttcatgaggaaatttaagggaaaaagcagaacacctaaccacaaaacccaacagcttagaaacaacatttacttgtactaggttttcccattgttttttttttttttttttttttttttcaaatcttcgtatgtttaaacatattcttagggaatcacttgatttttgttttttcgtgttgcatatttacctgccatttaactaggtagaaaataatatgtgatgatactttttaaatatatatttttaaattttcttatgatttagaatatgttattggattttgttttattacaaaatcagtggatgcttgatgtgacaattcaaacaacacagaggctattaaagtttatactctctgcttcccttcttccaacccagccctctgaaagttgtggtatggtgtattatcagagccttttctaaaaaaggtttttgcagtgttttcaaagttttctttcagtgtttgttcagttttcaaagtgctctttgcttccccatttccacccctctcaaaggtgtgatattctgtattatcacaaccttttctaaaaaatggtttgttcagtgttctcaaagttgtattattgatagagaaatactattgaatgacatctacaaataatgtagaacagcatctgagttattgataatgaatgactataggtaactgccaagtgaaattcttacacattcatttttttcttttcatacattgtgggaaaatatgagattttatttgcctcgtgtggtcagcaatgaaaaactatggtttgctcaaatcttcttttcatcggtttatgatttgattttctttcacaaaaggaaaggcttatatttggtggcgttatggcagtttgtgcatctccatcatttgtaaacaaactaataggaaacaattcggagggcgcaagtaataggaactaaaatatttactctcacaatgaattaatctgaaaatggtgtctgatgtgtcagatgtctgggggaaagaagatcattttcaaaaaaaaaaagaaaactgcattttttttctctcttgaatagctccaatactgattgcgggaaaagaaaaaaaaaattcaagaatgaaacaaaaacctggaagggccatgagctcttttctctaactaggcccagcccccaccctgtactgtccaacagaagtcgtcacctatagactcacagccatcccagacctccagccgagtctgtggtaccgctcataaagtaggggttcctggtccagtctatgatacctctcataaagtaggggttcctggctcagtctgtggtacctctcataaagtgagggttcctggcccagtctgtggtacctctcataaagtgggggttcctggcttagtatcgtggacgcatccacttcagctcctacatctccctttgtttctaacactctccctcaagtgtaagcagaagatagttaaatgtaggccatttggtgagtcccagatgacctgcacacaggatttgtgcaacgccttaccacccgctgtgggactgcgaagtgtgcttaaacgctgcacaagaaaaaattaatagcattatttctgcaactcagtggctgacactcacaatcttcaatcacatcatgaaagaagcaacacaatgcttaagtcataatcttaacaggaggaaaaaggagggaatgagcgtaaacctaacttatacactattcttttccttggttccttgctgccctctcattacaaatgatatttgaagatcaaaataaaggtagggctcactgtgaaaaatctctgcttctctttattcctaccaaaaaaacggtccttcagccagggcgcggtggctcacccctgtaatcccagtactttggaaggccaaggtgggcggatcacgaggtcaggagatcgagaccatcctggctaacacagtgaaaccccatctcttctaaagatacaaaaaattagccgggcgtggtggcaggtgcctgtagtcccagctactcgggaggctgaggcaggagaatggcgtgaacccggagggcggagcctgcagtgagccgagatagcgccactgccctccaccctgggtgacagagcgacactccatctcaaaaaaaaaaaagtcaaaaccatagacatgcatggaatccccctaggaataagctctgaagggaaacctgtgaatggcaaaatgtggtaggcgatttgccaagcatatagaaaggcatggtcatgtttttccactgagctcacctcctacggcagatccaacaatatataaataacaatatgctgttttcaaatcccctttgttacttccttttttatcttcttcctttgtcttgtgggagaaaggtaggactctaagcctgtagacgagcaaaatgagaactccaaagggaggttactgaagggtgatgcgatgggcaagttcttaccctgggacagatcagcagataaaatgatgcttatttgttactctagtgccaaaaatatgtgcattaccgtgaaagtctgtgtccttttgcctgggaaaataataatgaaatgattgttaagtgtttacatgctaaatcaacagctccccttgctcctactcttactacttgctcttaccccagtctctaaagaagaaacagtattatgattttctatcttaaaagagtaaaacgatttcaggctgaatcaaccttttcaaaattactgcattttacaacctttgcttttctcttcctttctctcactcccaccctttgataccctattgttctgcaaatcctgtctccagagaaagacatagcctataaaatcattcatattgagctgttagggattgttagcatcacctcagtccagttctaggctaacaaagtaaagtacatcttaataagcaataataagcactgcacaaaatcaggaaaatatcatttcatgagatgatgtgtttgagagatagaagagaaggaaatagcagcctttatcattctctttattagtgaggttttccatatttggaaattcctgatgggtttcctccacactcctagacacaaattgaagtacaagttgttcccttgcctggaatgttccactccccagaatgttctgcctcttatggctggctcttacttgtctttcaaatctcagcttaatgtcaccacttccctgaccacccagtctaaagcagccacccagccatgttccaataactcatcctcattaattatcgcataccacataattatttccgacagttacttgctttttgttttttttaattgctccctgcctccaatattataatgtagcttcctgagaatgggaaccctgactgtcttatttcattgctctttcactaggaccctagaacagggcctgacaaatagtagatgctcaacgatgttttttgaatgaatgaagcaaaagcagaacaaaaaagaggaaaagaaagatctcccacctttagagcaacccccatttgatctgcctaacgttctttttttgtttttttgtttttttttgagatgaagttttgctttgtcacctaggctggagagcaatggagcaatgatgtgatcttggctcactgcaacctccacatcctgggtgcaagtcattctcctgcctcagcctcccgagtagctgggattacaggcacgtgccaccacccctggctaatttttgtacttttagtagagaccgggtttcaccatattggccaggctggtctcgaactcctgacctcaggtgatgcacccacctcggcctcccaaagtgctgggatatcaggtgtgagccaccatgcctggctgatctgcctttcacctagatataccataggacttctattttcaaaccccatcaactccagagttttcccacattacagtacttttccaactgacatcatttatcttgtaaaccaaatgagtatgaagaattaaataagaatctcatgggatagaattacattagaaaagtttgtccaagttacttaatttgggaacactttcaactccttcctcatttcttctgtgttctcatttgattagcatcttaatttaaaacattatgaaaaatgagacattcggaaggactaggaggacattttcactctctagtacatacttgcaatgtcagttggccacagtgcaatcacactgctatttcaaggtgtgtgtacttgacatgttaacaccccatcagatgccagacttgtggtgaagggccaagagcttctgtgctactcccttcctgtcctgtttatgttggactgcagcttcaactccaacgtgtggctttggcaatagaacttacaaagttgaacattatcccgtccttcaacctctactagttagggttcaagatctcactatattactgtttgacattagtatacaaatggtttcttaggttctgttcttgtataaaccttacctggttgattgaaaagcaaagcaaaataaaaacaaaaaggacaaagacaaggtaagcaaaaacaagttgggacaaaataactaacaaagggtcaaggaaatgtaatcattgaatgtacataaaagtattttaaaatctagcacacttttttttcttaaccaatatttctaattttttacatgtctgcaacctgtagacttaaatcatccgtaatttccatggaatttcatgtatgttcagttagctagccattactttcatttcttttcaacttaaatttgttttttctaggtaatacaatcacacagttaaaagtataaagaaatatatgcactgaaaagtctgcctctcggactcagtaaccagttgtcactgtcttgtgtatcctgccagagattgtttacatgcctatcaagcaaatatatacgtatatataaaatgtgtattttttcttttatttttagacaagtgcctacccaccacatatactgttctgcaccatgccttttctatttagcagtagattttagagatgtttcatgtgagtaattaaaaagtcttatttttaagtgattgtatatatttattgtagaaatgattgataattcctttctctattgttgccaatctaatttttttttttttttttgagacggagtctcgctctgttgcccaggctggagtgcagtggcatgacctcagttctctgcaacctccgcctcctgggttcaagtaattctcctgcctcagcctcctgagtagctggaattatggacgtgtaccacaacacctggctaatttttgtatttttagtagagacggggtttcaccatgttggtcaggctggtctcaaactcccgacctcgtgacccacccgtcttgtcctcccaaagtgctgggattacaggcgtgagccactgctcccagccaccagtctaagtttcaatgacctaagtaattatcaaaagtaatcttctttttttttttttttttttttttgagaaaaattctcgctctgtcacccaggctggagtgcaatgacacaatctcggctcactgcaacctccgcctcctgggttcaagtgattctcctgcctcagcctcccaagtagctggaattacaggcacccgccaccttgcctggctaatttttttgtacttttagtagagacgaggtttcaccatgttggccaggctggtcttgaactcctcacctcaggtgatctgcccgccttggcctcctcaagtgctaggattacaggtgtgagccaccatgcccagccaaaagtattatttaaaaaagtttttcttacttgtattttaggttcggggatacatgtgtacgttagttatatatttgcctgtcacaggggtttggtgtacagataattttgtcacctgggcaataagcatagtacccaatagataatttttctgatcctctccctcctcccgctctccaccctcaagcaggccttggtgtctgctgttcccctcctagtttccatgtgttcttgttgttaagctgtcacttctgagtaagaatatgtggtatttgtttttctgttcctgtgttagtttgcttaggatcatggcctccaactttgtccatgttgctgggaaagacatgatcttgttcctttatatggctgcatagtattccattgtgtatatgtaccacattttctttatccagtctaccattgatgggcattaggttgattccatgtctgtgctgttctgaatagtagaacaccattcatcccctcactgttagttgaacatctgcaaaatgctgggtaatgtggggtgctgaaaacacaaagatgaaagagacaagagcagtacctttgaataatctataacctggttatctctacgatgattttggcaagaacgtgcagatgcatacacatatacacaaaatgctgcacatctttcagcatcatacaaattttgtagaagaatggccaatccctaaattagattcagtgcaacccaaatgccttctcttcccactttaatgtttgaaagatacatcattcagtttttgattctgaagatttaatatgcaccagcttttgtttctggttaagtgattttcattatcctcgaaggctagtcaaataacaaagcaatttagtaatggcaaaagcataaagtgtggaccagaggggtcttcaaaatattagggaagatagagcagaaaaccatttttttcagtttgttgttataaaattatacacacactctgagtcaccaaacacattggaggttgataaggaacataggagtagtcacgggtcctaattctgcagtacgtggctatgcgggtatgaactcttcataaatacaatgtgatgatgactttgcatttgcatttctcttcctcctttctctcactcccagtcttagatacccgattgttccataaatcttgtcttaagagaaaggcatatcctataaactcattcatgtgaaggtatttgcattagcagtgttggtcttggatcactttgcaaacaacccttccctgaaaatgagaagtccaatcaaggagcttcctgaagtataaaacttttttaactaagtaataacatttaggtgcattcatcctcatgattttttaatgtaaatactggctctgacacagtgccacattcttagatattaggctaattgtgctttgctgtgccagtctcttggtgaatgtaatgtttaattacatttccagaagaaagctgagttctatttttatgattaggagttttatttgatgtctgaaatataattggaaatacttgcagataccctatctgtgtttgaagtggcactcaatcatccataagaaataccatatgtccatttcaaatattaggtgttttacatgaaggaatacatgatgataacaatatttcttcaacatatcttcattttacctaagtgcgtaggagagctcttttagtaattacaaagtaaggtgaaaatagtcatccctactgggtagagaccttttattttaaaagggggagtggctaagctcagagataagatggagccacatatgaacaatatgctcatagataaagctatgaatttgatggaaaatatgaacaatatagtgttaagtgaaaatagacaaaatgatatatgtaacttaatgtcaattttatgaaaaaataaaaaataatacactttaaccaactaaaatgtatattatatattagaagaaaatacaccaaagtgtaaccagtggttctttgagtgctggaaatttgggcagattatatcttctcattaactattcctgattttccaactttttgacataatgcttttataattacaaagtattattttaaaataaataggtacttttgatcctttctcttccatcctccttcctccattaaacttcagttcatttgactgttcatcatggatgcttcttgttaaataatagttgcttgctaagtaagcttaattttgagcacattcagaagtggaatgctctggcactgaatgttctcacctcccgtgtgggatctccttctagaaaccaatgaccttcaggattccatctggatttttagaactcttcctaggaatccttccccagaaaatgtcctatattccaaaataactttactcctccacaaacactgttttccaacaacacctgcccccaccaaacaaaactcttatccctttaattgtacatctcaggtgtttaaatgaatatgatatgaataagctatttatgtatatatgtatgtatgtattttcaagccagggtctcactctgccacccaggctggagtgcagtggtctgtcacagctcattgcaaccttgacctccctgggctcaggtgatcctcctgcctcagcctcccaagtagctgggactacaagtgcacaacaccacacccagctattttttttattttttgtagagatggagttttgccattgttgcccagccaggtctcaagcaatctgcctgccttggcctctcaaagtgttgagattatgagacgtgagccaccacacctggccaattttaaagttaaaagtaaaccaaatactttaaagaccaacatttacagtataatccatacaaggccttccacagaaagtaggatgaaaactttaccctcagagacaatggtgaaggagaaaagatgcaatgaaggcaagactaagattccaattcaaataacaataatgtcaggaaagtatgcgatgaaggcatctgctgaaagaggaaagacagttgtggtaactgtgggtaatattacaaagcacgaaaagggtggagaactaagagagagaaagaataccaaaaaaggaatgtgtatatttcctggcaatcaagagaacccatttgaatttcaagagtgtaaacccacattcaattcagtgagcatggtttcatgactttatttcagcaataatgagcactgtgaaggtagaaacaggacatatgtctttggcagtactggcacagtgggatgttatggtatttaattagatgatccttgagaaacattactgagattatcagccaagccgtgtgtaggttcagaaaaggaaacagattcaacaagattaaggcttgaggggaaaagagaaaggaatcaagaaaatggaagttataccaagaatgaaaatggggagtgtcagatgagaaaatatggagagggagcagtggttgtgatcaaagagaggattctgaaagtttaaaaaacttaaactctttccaagtgataaaagaatgtaagatgcatctgttcgagtggatagtttaagtggaagttaaggtcgcaggagcagaggaagtggtcagggaaccatgaagccaggatgttagaaggaacattaacatggatggtggccaacagtgatggcagaaaaccaaatgctaaatagtaaagtcactgagaaaagtgaggaaatgaccaaggttgttggtgacaagcagggaagacagaatgactgtaggtggagtgcaccaacttcaaaagaggaacagatatttcgtagtgatggcaaaactcttctgagagttgccttgggaaacaaggaccctgcagaaccctccttgctcagaaggatactgaggaggctggagacatcatcagggacagccagacttcagttaagacaaagcatttctaaggaaaaggtttgaggaagcagagtttggttagaaacagccaaggaatcccataggcaatagaagagatctagaaaagggattcaagggagaattggagaaggaagatgaggaggaagaaagctatagtgcagagttttgcactacgaacctctggatgctagagcagatacagaaattctgtgtcagcattcctactgtgttgtgctagagcacactactctgtaccatctgatgctgagaagcaaaagcatcgtcctgaggatcacttgctgctatttcatgaagagtgactaagattacttgcagttggaaggaaatagagccatttccaatataattactacttactttttagcctcctatttattttagttacgtggtagcaccatgatccattttgtggttactaacctctaagtacgactttgagttgggcttttttttttttttttttttctggtggagtctcactctgttgccaggctggagtgcagtggtgtgatgtcagctcactgcaacctctgcctgcgaggttcaagcaattctcctgcctcagcctcccgaatagctgggattacaggcacgtgccaccgtgcccagctaatttttttgtatttctagtagagacagggtttcaccacgttgaccaggatggtcttgatctcttgacctcgtgttgaattgggtttttattgaacaagcccaattcctcatttgtgtattttaaaatgattgttctcaactaatgactctctaattcatatttgcttaatttcattttatgtttacaacttttactactagagaatttatttttgtctactacaggctgaaatacattaggttgacaatttttttaccattgatttattttttctgcaaatgtgtgagtttttcattcatactaatacatcacctaatagtgagaacattagttacagggaggtttattttaattggtttctattacaagtatgaaaccagagagttcattttctcaacaaatctgagagtgattgtttccttacctgactaaagtgatgattacacaaaccttgtggatgacagtggagtcaatgtggtttttaaaaaaccttttccatatgtgacaaggaattagatagtatgtcatttgattttaagaatgatgaacatattaaattgattctgtcaaatgtagatttttctaaaataagttggctggataaatcacgtcaatttgaacacacacatctttgcttcattattcaaagagaaaccataattacgatcagaacctcagattttgctctaggagcataccaggttcatgccttccaacctctgtatgtgaaggtttcctggtaggatgatactggctcctcttgcccaaggctgtcatgaggatgcacactcactgcaagggttttttatggtgctgagaggaaaggccttcataaatatgtacatttacttaatttctgtatctacattcccactgtgttttcctagagctcactactgtacaccatctcgactctgaagccctgggaatgtctgctctatgctctgctccatttcacaatgttctttaggtctgttttgttatttaaatgtaatgatgtatgtatccacaataggtagcatttgagagactccagctgtgagcctctggatgtgaagctagtgaaacaattgaatgactaacagttgaatgcctagccaaatattttcacttcactttatatgtcagcaatggaaaagagtaggtgtagccatcgactcttcttttcgctcagagaagtttataaataggtcaaaaatgggtaattatatgcctcagctacaatttcaaacttctgctttcctagtaattgccattaaatgagtaagttgtaaaagatttctggaaagaccacaaatattttcttttccttgtttctttgttaaaatagttcatataccatctggtttcggggatgtatcattatgctcaatgtttgaaacaaaaaaaccctaaaagacataaaaggtggcttgagtacaatgcagtgaaaaagaacaatatattttattctctttaatttcttttttttttttttttttttttgagatggagtcttgctctgttgcccaggctggagtgcagtggtgcgatctctgctcactgcaagctccgcctcccgggttcacgccattctcctgcctcagcctcccgagtagctgggactacaggcacctgccaccacgcccggctaattttttgtatttttagtacagacggggtttcaccatgttggccaggatggtctcgatttcctgacctcatgatccgcccgcctcggcctcccaaagtgctgggattacaggcgtgagccaccacacccagcctgttctctttaatttctaaaataaagttttagaaaaaactaaaactctaaaaagagtagcttagtcttccaaacagtgctagttacaggggcaaattcttgctccaggtgactgtttttatgtgccttcccttccctcatagccactgctttcttcaaagggcatcctctaactcaaatgtgaaatattcatgtgtatttttattctatcacaaaacaattttacacagataggattactcatgatgaagcattctagaacaacagcaagagtttcacttcatgtttgttgtaattattctatctttgaaaagcagaaatatatgtggttattatcataattaagacttcctgatactgaacagctgccttactggagagaaatgttaggaattttttatttttactaaaaactgtcagaagtttctaaaaggaattagatgaatcctgaaggtcctgtaacttgaaaagttgatttacgctgaggaccccattttcatcaaggtatcaactagagagaaacttgtatttttcttattttgcattacaataatgcatcttgcttttcttttttatgaagtgttcactttatttttattactccaggtacccaggatcattcatgctctcttctttaaggtgttgtacaccttgtgttcagtagacatttttaatttttttcttctctgagacaaggtctcactctgttgtccatgcctggctaatttttttcttttttgtagagacagggtcttgctttgttgcccaggctggtttcaaactcctggcttcaagcgatcctctagccttagccttccaaagtgttgagattataggcatgagccaccacactcagcccagggttcagcagacactttgagaggtcagatagagttcatccttcaggcagatgagatgctgtccctttaaaaaaaaaaaatcaacttctattttagatataggggatacatgtgcaggtttgctacatgggtatattatacccatgtagtgaatgtagtatccaataggtagtttttcaacccacagcctcctccctttcttctccttctggtagttagcagtgtctgtcatttctacgtttatgtccatgtgtgctcaatgtttagctctcacttgtgagaacatgcagtatttggttttccatccctgcattaatttgcttaggattatggcctccagctccatccacattactgcaaagtacatgatttcattcttttatatggctgcatagtattacatgatgtatatgtaccacattgtctttatccagttgaccactgatgggcacctaggttgactctatgtctttgctactatgaatagtgctacagtgaacatactagtgcatgtgtcttcttggtataatgatctattttcctttgggtatatacccagtagtgggattgctgggttgaatggtagctctattttaagttctttgagaaatctccaagctgcttttcacaggggctgaactaatttacattcctaccaacagtatgtaagcattcccttttttccatagcctgaccagcatctgttgttttttgactttttaatagtagctgatgtgacatggtatctcatcatggttttgatttgcatttctctgatgattagtgataagcattttttcatatgtttgttggctgcttgtatgttttctttggagaagtgtctgttcatgtcctttgctcattttttaaatgggattcttttttatctgttgatttaagttccttataggttctggacatgagacctttgtttggtacatagtttgctaatattttctcccattctgtaggttgtctgtttacactgttgatagtttcttttgctgtacagaagttctttagtttaattagatcccacttgtcaatttttggttttgttgcaattgcttttggaaacttcaccaaaaatgatttgccaaagctgaggtcaagaaggttatttcctaggttttcttctaggattgttatagtttgaggtcttatatttaaatctttaatctatcttgagctaatttttgtatatggtgaaaggtaagggtctagttttattcttttgcatagggctagccagctatcccagcaccatttattgaatagggagtccttttccccattgcttgtttttgtcagccttgtcaaagatcaaatggttgtttgtggctttatttctgagctttctattgtgttccattggtttatgtatttgtttttgtaccagtaccatgctgttttggttactgtagcctagcagtatagcttgaagtcaagtaatgtgatacctccaactttgttctttttgtttgggattgctttggctatttgggttcttttttggttccatatgaattttagaatagttttttctaattctgtgaagaatgacattggtactttgacaggaatagcattgaatctgtaagttgctttgggtggtatgggtattttaacaatattgatctttccaatccattagcatggatgttttttcatttattcatgttgtctctgatttctttcagtagggttttatagttcttgtagagacctttcacctccttggttagctgtattcctaggtattttattttctttgtgaatattgtaaattggattgtgttcttgatttgactttcagtgtggacattactggtgtatagaaatgctgctgatttttgtacattgattttgtatcctgaaacctttctaaaattgtttatcaattctagtagccttttggtggagtctttaggaattttctagatatcgaatcatattatcagtgaaaagagataatttgaattccttttttccttttggatgccttttatttcgttttaattgtttttttattttcccataagttattgtggtacaggtggtatctaattacatgagtaagctctttagtggtaattcgtgagatcttggtgcacccatcacctgagcagtatacactacaccatatttgtagtattttatccctcgccctcctcccactcttccccccaaggccccaaggtccactgtatcattcttatgcctttgtggatgccttttatttctttctcttgcctgattgctctggctaggacatctgtgtcttgcctttctaagatgaagttctgttttaactcttggtgatagtagtaaatgacctaaataaattaggtccaactaatttagtaagcgacctaaataaattgtgttccaactaaaatgggaagtgaaatggataaaaagaaggtacacgttttaaattttgtccaatttcttggtctttttagtcagaacaaaggaggaagacaccagctgaattcagttctagggttttgctaggtactacatcatgggcaactactgtgcttttgctttggatctcaacctcaaactcctgggctcaagggatcctccaacctcagcctcctgagtagctgggactataggcatgcaccaccatacctggctaattttttttttttttagagacggggtcttgctatgttgcccaggctggtcttgaactcctgggctcaagcagtcttcctgccttggcatcccaaggtgctaggattacagatgtaagccactgtgcctggcctgggcatcttcttaaacattgtttttctcatgacattttcctgctccaaaagtagtgcctcttaaaggcaggaaaactccctcccggaattccccatcattcattccacccttgactactgctccctaggatcaatgcacagttgttctcctaggacttcccttcaacatcattctcgtgtacttttaccctcttcttctcctggctcccttggttcctaagtgccatatatttcactttttattttatcgtctcatttaccagaagcacattctccagtagcttccaaagaaagggtacagaccacattaagcttctagaccctgcttgtctgaaaagtgtctttattctagcctcacactaaactgactgtttggctaggtttaagagtatgggtttttcctaagaacgttgaaggaattgcttcatattctagttcctagagttactgtagcaaaattcagtgccaatctggtttctaatcctgtatatgactgactttcattgtaaaactatctcttcacccctagtactttgaaatgttgtgatgatatgtaatatttttcagaaattatagaaaatagtgggccctttcaatctgaaaacactcatgtatatacattctgaaaattttcttatttttaaatttcttctccattttccctgttctctctttgtgaaacttgtattattacattaataaaactcctaattgatgttctcacttttttcttttgttgcctatttttattgtactttctttagacctcttcacctttgtcttccagaccttctgctgaatctgttatttctgctattgtatttttaatttccaagagttctttctcattctctatattctttcatggcattctgttctgtctcatggatgcaatcgtgtcctttgcctcatattaatcattggattttggaggagggaatcctattgttattgtcattttgttttgttttgtttttcccctgttccctgcattgtctctatttcttaaaattccttttttttgttgttgtttttctgtgtgtgcatttggactaaatttcatgttcgaggctttccataaacatggaaagcgtgatctttggcaccagcaagttgattggaaactatatgcttagctagaatgtgtcaatgggcaggctttaccctaggattgggcaagacccccaagtgccaatatcttcaggtcttgggttaatcagtttctctagaaagacagatattcagccaccttccttgggatggtgggggtggttgtgggggcaggtaacatgcttggcagacagcatttggagcctgagtaagggaagggggttggcttttatcatttagtagacatatgcatccatctaattccttacccccatttttcaccctcttctcttacctgttcattctgctgtgccagatgtttccgagtttgaaacccttttggctctccatctccataaagtgagctttctgtattctagagtagtagaggaggaatggttgactacctacaagaaatgggggaagggattcagctgccttcctacaaactttcagccagtcttcttgtactaagctccattcctcttccccaccttcagaggaatctagtgatcaaggtttctgctgctcacgttagcatccctcatgtttgattcactctctgtaggcacttgggttttcctctcctgataagtcagtgacaactcatccttttacttttaattccagtgaacttacagtttcacaatccgttgctctcagttttttcacgatgaagcaaggaacaaaaataaacacatccattcaatctgccatctttaagtggatgtcaatttatgagacttcacagcttgtttttgaagatgattctttccagctaaagaaagcagtataggacagacagaatctcccctattcccaagctagatgaccttagataagctactcagtgccccatttcagttccctcttcattaagagggaatcgtgacagtacctacttcacaggagtgtggtcacgtgaaataatgtgctagcacagggcatgccaaagggcagatagtccaattgatattatctgtctttgtttttgttattattaagacaatgttcacaatgaatcctttgttatttgacgcacatatagaaagtttcagaaataagcaatttgcaaaacttgcaaaaaactgtaagtgaattattcctctgctatgctgagttttcttcctccaccttcaagaagtggcaaggaaaaaaagatagaaaaatcactgaccaattagaagtttttgtttcaattcagaccaccctaaagttcctggaaattgcatatatgaactctagtaagctgaataccaaaaatgagagggaagtagctgataccaggctacagattgtgggctacaaaagattgataaacaagtggttcttttgtgcaaatttagatatgaaatcatgcagaaaacacttaacagaccactagacagaggattttatgagacatgttacacatggatggtgaaaggctgaaaattaatacttaacttgtcatgctttctgctttgaaatgctggagccctccaggaattttgttttaacaaccaatggagatatcattagggagatacttctgaattcgctgcatctcattctgtgacaaagtgctgcacaaagtaaaatgtacctaccactttcatccgagtttgtagcgttggacaaatccctattccacaatatcatgtgtacaaagagtttccgaagaacttgtggcatatttcttgtcagttctcttgaagttctcatttccccttttcctctcctacgggcaggtgattgattgacttagagtcagtgctgagtagtaaataacttaaaaaacaaatctagagatgatctggagaaggctcgaagaaatgtgatatgtattatctgggataggcctagaataacctgaatttacaatgaaggagcccagtagccttttctagaaagccgcttgctcttccactcttgtttcctcttaggcaagagaatatcactagaagctcagaaaattcaggattgattggaaatgtttaaaaagtgaaaataaacacaaatatctataaggctaggaacataaccagaaaactcagaaaaacataggggcttaaggatgttccaaaggtaaaaatgacctcaaagtgaatttctttcttttctaatctcgacgtaattcagttcttattcaagctgagactacccaaagacaaaaatgttgcactgatttaaaatatgactcatcagaacattaaaatacttatgatacagatttttatacaatccgatagtctattcctcacaactcattatttgctccctttaaaatatttcacaaagaaagtcttaaccagaacatgatcatgtaactaagagctccacattcagtagtaggataggtcagaagacttacagggatgttcctcatgcttacaaaaagaaatttgatattgtgtgataatacacgtaagctagaaacttgtggttaaaagaaatgtttaggactcatgtaagcataggttcttggtatctttttttaactgatatatcatagttgtcattttggggggtacatgtgatattttaatacatatataatgtgtaactattaagtcagggtaattgagatatctgtcacctcaaacatttatcttatgttgggaacattaaaattctcttcttttagctattttgaataatttattgttaactataatttccttactcttctatcaaatcctagaactttgtatttttgtacccattaaccaacttcttaatttaacctttaaataaaaatattttcattcctaaccctgaaattctacaaatttactgcttagggatgactcctgcatgttttctcttccttttaagtagacaagttctaaatcttagctgactttcattagccatttgactaatcccattttttaaaagtgtttgagatgggttgaaaaatatgaccaatgtgatgagtacaacttgatcataattgtaaaatattagtgtgctttaggtgttagcaattaagaaaatgtgaaatgttttatttcttttctttccttcccttttttttgaggggcgggggtgggtgggtagagacagggttttgctttgttgcccaggctggttttgaacttctggcttcaagcgatcctcccaccttagcctcctgaagggctgggattacagaaatgttttttgttgttgttgttggttttgttttatttttttgagacggagtctcgctcttttgccctggccggactgcagtgggtgctatcttggctcactgcaagctccgcctcccaggttcatgccattctcctgcctcagcctcctgagtagctgggactacaggcgcccgccaccgcacctggctaatttttttgtatttttagtagagacggggtttcaccatgttagccaggatggtctcgatctcctgacctcgtgatctgcccgccttggcctcccaaagtgctgggattacaggcgttgagccaccacgcccggccacagaaatgttttaagtagtaacatgattgttaaaatctcaaatcctgagtatctgagatatcggtttgatacttagaaaatcatgagctctggaatcatttttcaaatgcctatctaggatttgaattggcatcttaattagtaacatcagtgttaactatggcaactcatttgtttcccaaaaaaatttactattttaaggttaaatataaaataacggtataagtcctgggtttgatttttttttttttaagtgtaaaaagttatctgtgttcagtaggtggagaagccagctacatcctgctgacacaaagctaatcagtggcttgacaactctagtcaaacatccacatagaatgtcttggccataatctatgtgtctcctgtattgtttttgttttaaaagatttgagaggaggggatgtggtggaggaatggtgcagctcgaaattgcacgtagttgccaattttcttttttctagtttgaacatatttctgctttgagcttctttcagctcaagtgagccattttcacctattatttcatctgtcttgctctgtcttcaatcttcattagccgttactatggataagctgctgtaaacgtttttaaaaatcaccctcaaggagtacaatattctattaaaaaatgacctttccaggaaactaactaatagcattagaaaattaacactattcctttaagcactaaaactgaaaaggagagaaggaggaggaggagccaggcatggtggcacacgcctgtagtcccagctacttgagaggctgagacaggaagatcacttgagcccaggagttcaaggttgcagtgagctatgatggcaccactgcactctagcatgggccacagagcaagaccccatctcttagagagagagagagagagaggagaaagaggagggagagggtgatgctagtagtagtagtgtagtaaggatggcaatgttctgaaatgtctacttttctatgtaataactgaaatttttcttggaggctgagtcattctcatgaatatcaaagattgagcctgttattcattgaagagctcttgcaatataatatttgattctgtttgccccctaaacaatgtcttactcctatacaatcagcacggccactgagttcaaaagttatgtgctgtccccattggcagacaggcatccgcaccacagactagactgcctgtcccctgccctcactgctctcgccccactggccttttctcgaggtcccggccctcacttcatcagttccattcagtatatcccccaaacagcatttccactcagcctgccaaggagaaggaaagagagtatttagaatacgtccttcactttcctgagagaacagctttaagaaaagaaaacgtcactcctactcatgttaaccacctattgccatataatagaacacattcttatgctctctgagcctgtctcttttcttcgtctcactgtttcttgacggttatgttgcaacctgaggcagagtgtcagaaagagatgagagggatggcaaaaacccattcatactttgagactccttttctctaatttttaaagctttttctctccttccattagatactgttgtttctgcgtgcttctagtatacatagtcaacaatcatgttggtgaaaactccctcagggcctttttttcttttttcttgttctttctcttttcttcctggctgggggcagtatttcagctttgggttttcgtctttgatgattgctgaaagtctgtcttctgaacaagcgaggattagttgtatccgttttgactctgactttctctttccctgttcctctacctcccacatttgcaaattactttcattgccactctgtgaaaagcagaattactcctattaatagctgggcacttgactaacattccacaggttaacccaagctttgccaaaaggaaacagcatagaaagacccagaaactctccagtgatgtggtatcagtggaataagctctgccactggagctcattcagtggctcaatgagtggcagagcttgggcagcaatgcaaagtcttcctgtgaccacatctttaatttgagtctattcgttgccgcaattttgcttttgtttttcctttctcaaaaatggcctcattttgtgaaaacaaagtgtttgcactgataattaataattactacacttttattctggtatgtatacatacttagaaagcatcacacatgcatgtgtgcacacatacacacacacagtgtgtatgtattggtagcttaggcctgggtcagtagctcagaaacatcagaatgcatttgaaggctttagcctttccttcatgattagaagatagctgtagctgctcaaataccaagtgctgtcaccatctccagagcaggaaggatggggcagaagcaatacattttgtgaggctctgcttattttattccgaagtcctttctgggagacttcttaagtgccattgaacacaacggtgtctcgggtcaatttttagttgcaagaaaggctgggaaataatgatccagcaaaggcgaatggaatcctcatggagaccaggtataactcattcctggacttgcagaaggccctaggtgcaaaggatctccatccaccatctgaacatcaggattccgcctgggtggagatggctgtgagggagctaacaagcggaacagcatctcccacaacatgttttaaaacattcacaacactgaccctcaagtttgtgcttccaattgctagtgacctcagtgtcaaaaatgtgctgacaactgtgatgaagagacaaggagagaaaaacagaccctcaggagaaacagtgggagggggaggggagtggttattaacgtgaagtttaaaatattcaaagataggaaacgagaagcttaacgtgattgtctacagtggtgtaaagaagatttatatgtgtgtgttcttcttttcaaaaggcagatttaggtaccttttggagcacaattggaatatgcaaattgctgaccacaattgctataatgtattacattctatgcatgcaaaaaagaataccagggtttgttctctcctcttttaaacacccagatttaatctgacctacaaaacaaatagggctaaaacactgggcacgtttatcaagtcttcaaaagaatggaatagaggctaatgaacaaaatgctcacatcccttaagataactcaaagattcttgctatagcacatttggggcctcttttttttcttttttataagtcaaatgatatgcaagtaacaatatttttgagtgccagatggagaagacatctgtagagtaagaaactaaagaaaacacacttccaagattaaggcacattagaagaaaattgttggctatgtgagtaatgaggagtttggaaagggttttctctatgtacaacatgctcacttactgggtgacacaaatggaagatgccaatttgtttttttggttttttttttgaaaacagttttctttactaaaaaggggctttgcagtcaaacaaaagcacactactttgctttctttcctcatcttttctgcattcctcagtgacattctgattgtttccatgaaggtgtggcagttttgtcaatctcccaatatatgcttagcctttcaaagaacctatctttgttccttgtgtctatggtgaccgtctgttagtgacgaacagatcaaggtcaagtaagaaagagaagaaataattcggcccatacctctaacccttccaaagggcgtagcttagtagtttagtagtttcgcttcaaacactgaggacagggtgattgctgagatgctgtggcagtggtttcgggctgagcaaaacacgcatagcatgctgaccagagacagcagcagctgtgaggctcatctgtttcccaacacattttctagactgtgaagtccccttggaggaggactgtccatgaattccaagcatggaaggaatctgaccattctttttcattttaaaaccacattacctttgtcctagccttcagctttcaaggccatttcacttggcatttttcattgatttgtggccagaaactgatgtgaaaaaggagaacttaaaacctgttattagtcagggtttggaatcaattatgcttcaagagtcattttctataaccaagatttcattcgcagaagacatacacttagaacaatggcttgatcatggattgggtgggggtggaggacaagaatgaaagaggactgagatggctgaaggagcctctatggaagacacagagcatacacgagacttgtatgtagcaagcgttaagaagagtccacaatgttcgataatttttattttgttttaatatgtgttctatctacttttcattttttatttttattcttttgagatgtaatctcactctgtcacccaggctggagtgcagtggtgagatcttgactcactgcaacctccgtctcccaggttcaagcaattctcctgcctccgcctcccaaatagctgggattataggcgtgtactaccatgcccggctaagttttgtatttttagtagagacggggtttcaccatgttggccaggctggcctcgatctcctgacctcaggtgatccgcccgcctcggcctcccaaagtgctggggttacaggcgtgagccaccgcgcccggccagtccttcttaaactcttattcacacccagcccaactacagcaaatcaattcctccagttttcattatcttactctttttttatattaatacctagcatatcaaaaattacagatggcaacattaatgagtactgtataatatttcttgaaaaaaatagttaattataaagctttcttagaaataaaaggaaaagactttcaagcatagagtccaggcaggtatctatcattctgctttcttccttcatggaatcaacatttttagttcccatgtatgagtggaacatgcaatatttgtttttctttgtctggattatttcactttacacaatgatctcccattccattcatgttgctgcagatgacagcctttcgttatttttttattgccaaattgtattccattgtgtatatataccacatttctttatctattggtccattgatgagcatttaggttaattccatatcttggctacagtgctgcagtaaacatggaggcgcaagtatctctttgatatactgattcattttcctttggatcagtacccggtggtaggattgctggatggtatggtagttcggtttttagttttttgagaaatctccatactgttttccatagtggctatactaacttacattcccaccaacaatatataagttcccttttcttagaggctgggaagggtttttggaggaagataaagagagcttggtcaataggtgaaaacatcagttagaaaaaataagttctaatgttcgttagcagaatagggtgaccatagttaacagaaagttgttgtatatttcagaatagctagtagacaggatttgaaatgttcccaacacagaaatgataaatacttgagctgatgaatactctaaatacccagacttgatccttacacattctatgcatgtgacaaaatatcacatatcccccattaatatgtacaaacacttgcatcaactttttaaaagtccagacaagaaaaaagcccatgttgttgataatatagaagttgcagtcctctccatcacacacgtcataaaggcagcaccagaaacaagccattgcccaagataagggtacctatttactgcgtgaatttttgtttcaggtttactttattgctgctctaattagaattcttgtccctttgtttcacactcgtagcatgtatttatgtcatctcttctctgatttgaaagataccattgtttcagcttaaaacagcccctggtttgaaagttgcacgggatgcttatataaacaacaggcagcatgataattcattgcttcctcttaattcccatgttagttgaaactggaaaaaaaatgacacatgccatttttaataggtagttgagcttcctgtataaaaaaaaaacttgtaaattttgtaatgcttcttgggacatatgtcagtaatcatcacatggtttcaagcactgggaaacatcttaaaagatgctttaaaggatgagttacaaaagaagaaaagtagtcacaagattctctataatccctgtttggtcactctacattttccttctgaatgcactttttgagaaagtaaacttacttcttctcttcagtgtcatctgaaattttgatactttaaagagacctttgcagttttgaattttgaatataatattcctcaatgtatgaaaaactacattaaaaatctaactgtggatgcctatacttgaattaacaaggagtttcatctcccaaaatttcctcatgctgtggttttttttctgagctggaattgacagatactaagtttcttagtcaatcttgcaggcgctttcagaataattaagcctgagactaccagaaagaaccattaaaaattagaatcagagttggtggtatggaaagttcttttgaaagatggaaagttcttttgaaagatggaaaacattaatttaaaagagttcaagagtttaagccaaaagagccagtcaggttatggagcaaaaaaactctgcaagattaccacaactgtacttctctttgaatagattttctactgccagttatatgaaatggatataaatcctcccattccaacaactcaggaacttacttaagtgcagggtacgatagcaactgcaaacgagtctaagaaaataggctgaatgtcattaaaatcctttgaaaatgttctgtgacatctgttttccattttgctatgctgtttaattaacttcagtcttgcagaattgcagaaatcttatttgttcaaaatagtatcttgaaggaagagaagtttatttaatagagaagactgttaagtgtaatacgggcttgattaacttcatctcaagttttaaatgtttcccattggcttcatgatctatccctatatatggctcatttccataaaactaaatcaaactctggatggcggatcactcttatccagttggtactgctgtcatgtttcaaggacaccaaaaatggaagaaattacagagaatagtgacaattcagaaactattcttatttgtcttcatcgctataatatgaggtcactggctcctgagctagtgaggaaatccaagttctaaaaaacattccttccttatatttgttttttttgtgtgtgtgtgtgtgtgtgatctttttgataagaatagttgtcaaggctgggcgtggtggctcacgcctataatcccagcacttttgggaggcagaggtaggaggattgcctgaggccaaggagtttgagaccagcctgagcagcatagcaagacgtcaagaccatggctctttaaaaaaaaataaaagtagccggcatggtggctcatgcctgtagtcccagctactcgggacagtgaggtggaggatcacttgagtccaggaattcaaggctgcagtgagctatgattgtgtcactgcgctccagcctagacgacagagtacaatcctatctcaaaaacaaaaaacaaacaaaaaagaatggttggagagagagagagagaaagaggaaaataaaaagagcaattcatcctgcaaagacctagaacatgagtgcctcttctgatgaggctcagtggtcctggaaagctcctattggacaaatcttggagaataaacagaaacattttggagaggtgggagagcgaaggaaccagtcttcattgacagctgactttatttttcgatttgtcagagcacgccaaagcccagtgccctgtgaccaggacaaaaggggaagtggctgcattttgacatgtcccagcttcactagagaaagcccacttgtttctgactttccagtgcgggcaaaagctggcagatccaccacctgtgctcttgctgcccagcatctagggagctttgctattctgagtgtttctgaggaagccatatggatggtgctcaactggatttttctacttagagggctttatggattttaatgtagaggtcgtggcttctctgcatcactggcaagtgttgtccatctctccgtccttcttgagttccatacccagtgcatcatgaacaaatccatcttttttatctgacctatgctgtgtctactctctcagctcctgcttttgcttatccctcaaaggggaggtgttcttagctctctgacctctgggttgatacagaggccaaatttatcccagggaaggaataagtacatttgaaataagtcactgagaggagaagactgtgtgttttaaagccaggtttgtttaaagtgttatgatagtattaagatgttctttcattttcatagaagtacttcatttggctagaaggtcaaatgcctggtgctttgaggacctgaacagtttctgttccatgaacataccggactcaggagttcttttgctccagatactaagttattagaacagtgtttcccaactatggtgaaagaaaatcaataatcagaattttttagtagttttcagtatttcaaaagatctagttcgtttcacagttcaactgaaatgatgggtgtatttgcatctagtggcaatcatattcactatgttaaccctacatatgttaatcataagctctgattgacagttgtatattttctgtttagcactaaataaggaaagaattctagtaatttattgaatgtagttggatttccttcagactacaaagaatgccttgacaatctcactccctccttttgattttcagtgattcaggtcatctggattcctggccttcctcctgctattctcttctgtaatctccatttgcccgaccacctcctaccatcttttagtttaaacgccattctctgccttccaggagctatagactagaatagattgccttctgtgtcctccccagcagtagaaatttctactgcgtgataactctcacgcaattactctctcagggttctctgacaccagagattgtgttatatcttattctttaccttgccccagcccctgccctggtgtttggcacataatctacactcaataaatatttctttgtttaatgggtggattgaattcattgtcacactgagtgacatccatctggatgcttgattacaccacgcggctatcatattctgaaggaacatgatatctatgaagatctcaatcatggtttaatccccagcaactagcacagtgtctaagacagaaacttaatatggttcaattactttcgagattttttttttaatggggacactacagatttggataaaagacattaatgatgatgtttcctgtcctatcactaggcagttctatgaaaaggcactccttttttcaaaattccaacttataatgtaagatttgatgggtttgttcaattcctactaagtgagcagtaccatgattttaggtctgtaagtagcttaaagttaaacttagaactttggttggcgatgctcaccctggtctctgttatggataacagtttgaatgaggttgatgactgggtcttttaacttgatgtccttgtttattttctgcttgctttgtttggtcaggtctggcatggagccgaaaaataagagcttgcttgcagtttgactttcactgtgattcagttttgcaatcttttaaaaacatccttcaggagaccgccatgtatctatctgtggacatctcccagattttccaaaacaagcacaagataaataagggggatttggaaatttccaaattttaacagatgggaatttgcttccactgtctgagaaatctttgctatagatagaggggaatcccagaaaaaaatctaagtctgaaagctccacagagttctctgcctttgccttccctggaaaaggggtcgggggagagcaaacagatgctagaagccagtaaagtcctgtcctcatgaaagctctcagcccagaggacaacactctggggcagtcacttcagtcataggatatttccctctccaaataaccgaggagagagcctaacctctggggtgagtgtggtgtataaagtgtgagaatcgtgcgtgtccaggaagagagtgctgctaacagatgactccttgggggccccctttgttctctgcttctgtttgtattgagtcagcttgcttaggaatatagatcagtgagactaaagtatctctgttgggccagttctttcttctctgtaccatggtcaatctacagggtgcctgcacatcctccacagcctcgaggtcacagacttactctctgtgtctctaggctatagagcagaacaaaacagagccaagacaaggtgtctggaaaaacagaactcatggtcttccaacagggcatcaaagggtttctaaaatttaaagccaaagggaacctcaggggtcacctggtccaacccctctgttattttaggaggacaagaggcattaagtgattcagaagacacagtctagtggtggcaaagaggacaattcagacagttcccaatttacaatgattcaacttatgaagtttcaactttatgatggagtgaaagtgatacgtatttagtagaaactgtatttcaagtataaccattctgtttgtcatgttcagtacaggatttaataaattacatgagatattcaacactttattataaagtatgctttgtgttggatgagtttgtccaactgtaggctaatagaagtgttcagagcacattaaaggtaggctgagctatgatgttcggtaggttaggcgtattaaatgcattctcaacttatgatattttcaacttacgatgagtttattgggccataaccccactctaagtcaaggagcatctgtataggctttggggtcaggcatcagctggaatcctgactctacctctttagttcagctatgaccttgaataagtcacttagactctttaagctttagctttattgataaaacaaaagtaataatagcaccataggactgttaagaggattacattagagaaaattcatgtaaggcacatagcctaatgcatggcactcagtaagtacctaaaaattagtagcaactattcatcttcgtcatcattatcatgatcatcaaagctggagcctaggacccaagcctcctagctcagcattcctcttacaacagccctttgaatcaccttcatatgtcgttaatacttcattgggtaccccaatctatattagtttaagtacagactgtggtgacatcattagttagagtctgtgagatgggaggggggggcaaataatgattcattctcttaaaaaggggatgtaacacttttttttttccttcttcaactggaatagttagggatgtaacactttaaaagagcatgttgtacatcaaggtaatataggtaacttaaatttattttggattttgtttatgtatggttgcaatcccattagagtttaatggtattttcattttacaacacattctagtgtgttaggaagtatgtgttaagagttctcttctatttattattttcattactttcccattccagtatagacatagtaaactcctaaaattaagtatattcttcttaaagaattctaagtgaccattttggtggaaaaactacctgcgctagtttgcatgtgatctaaatgatccaaactaatgggtgagctttgggtgcttgaggactatatgcaggagaaaagaggagggatggataaaacttttccaattttaaaataaaaattattttctgaatgtgctttaaatgcatctgctacatgtactcaagaatgttgagtctgacccctcaaatttattcattaagttttgctacatcagactacacaaaggtcgggaaatcatgtgtccaaaataaaatcagatttgagctccaccttattctggcctatacaatgtccctgttcttaccaccttttctcgtctttcacaaccttgaatcagaatctctagttcaacatcatttccttttttccctcccccacttaaacataaaatatagatatgtgaattctataaagcctgcttggataatcagcttaccctaattcagctcttttcctcatcaagaggagggacttgacagctactcaggaggctgaggcaggagaatggcgtgaacccgggaggcggagctggcactgagctgagattgcgccactgcactccagcctgggcgacagagcgagaacccgtctcaaaaaaaaaaaaaaaaaaaaaaaaaaaaaagaggagggacttcaaaccttagtgctggtagtaacacctgagacagaaaacccgtgtgacacagaatatgagtccttaagcaaaaggactgtcgtattcatccctgtgtctctggagctagcacagtccttagtgcattgtacatttgaacaaatgtttgagtgaataacaagcccgttctccattctggttaacttacgagtactgtaccaattttcttccctgggcggaaaaaattatgaaccatggttcttgtgaaagttattatttttaaatgcctagacattcattcccagaactagaaacataagaaacaagttgatacatcaagggaccaagagatataaatgataataacttggaaatatttaaagttgtaaagatcctgcttagaagagggaagttatcaaaaggggttgagacaatagttgaatgactgagaagacattaatgaaaatcacataggagtatgatctaagaaaaggtacttgacatttttccaagtgagaaaactgcatgatcagataaccatgcataggttggagatgtgtccagagaaatttattcctgaaagacagcgataaagtaccagagctaaaatagtccatctgatagagacattggagctgagatctgaaatgatgcctgtttcttattaagttggattctatttactacacattttttagtgtatagatagaaaagggtacacaataggtacctaaaagcagatagctgtaattactactatttatcttttgtgctctgaggtttctcatactgtgttggtgccacactctaatcagctgcataaaagggtagatcacttgccaccacagaggcatgtgggagaagacagcatgtctaggacattacgctgaggctgaggcagtaggcaaggaagtccaacctgcaggctaagagtcagttttcactcctgtgggaaaagcatgcccagctctcagcaaaagcatagaaatcaagagagaacagtaaaggcaaacaggatatgtagcctagttccagttgaaggtattattcctaacaatgaaaaatgtcaatataactatttccagagttaaaacttcagacacatgctatgacaatgagacagtatgtttgaaactacagatgtccaaggaaattcaggctatatgctcaccatatgtagagaaggcagggaaatttaattgtttgtagagaaagagacccaagacttcgtaaagccatgggatatggagttgggggacctgccagtcaccttgtcagttcacttcattttataaagaaaatttctagtctcagggaagccaagcaactttcccaaccaaaacgttagctttgcgttaagagaattttagagatagattattaacatcttgcggctgagatactgtaaatatcttcaagaattccaacattttgagcaattgtaactcccagaataattatttttgctataaatattttgcccattttatggtagtattccagggtctttactcccaagtcaaactcaaatattgggaaaagtcggatcctttttcttatcaattcccacttcacattccccgttgtgatcagctttctgaatttatttgtaattatttcttcagaagagagaaatatggataatggacggaggaacaggagaaaatgttagcatattgacacaaaggtttcagtattctaaataatcaaatatttgaaaaatatatattttgtccttttgccctagagatataaattgacacaaaaatatttacaaaacacattagtagacatcaatgggtctaaaactgtggtcctccaaaccagcaacatcagcatcagctaggaatttgtggaaaatgcaaattttcagtctcaccccaaatcagttgaaccagaaactctggggtgggacctggcaatctgtatgtatttaaacaagtccaccaggtgtttctaaccactggtacagacaaatcagacaagcataaccagattattggatgtcagttctaagtaatatagggggtgaatatatcaaatcctttgggagaataaaagcttagttgacttctatggtgtattcgtttcctattctgtataacagattaccatgaatttagtggcttaaaacaccccacatttaataagcttcgtaagttcctgtggatcaggaatccaagcataggttagctgggtcctctgctttgagtctcacaaggctgcaatcaaggtgtcactcaggctgtattttcatctggaggctcaactggggaagaatgggcttccaagctcctttaggttattagcagagtgcatttccttgtggttatatgaccgggccttggtctcttattggccatttaatggaggctgccctcagttcctagaggccactccagttatctgccatgtggccctctccagaggcagttcacagtgtggcaatttgctgcttcttcaaggctttcaaggccagcaggagtctctctctagtctgctaagatggtgtcatatatgtcatataacataatcatgggagtgaccttccatcacctttaccctgtgacagagtttagatatatgtccctgccaaatctcatgttgaaatgtaatccccagtgttggaggtggggcctggtgagaggtgcttggggcaggagggcagatcccttatggcttagtgctgtcctggcaatagtcagtgagttctcgttaaaagtgtgtggcacttccctgccactctctctctcttgctcctgctctcaccatgtgacctgcctgctcctgcttcaccttccaccttgagtaaaagcttcctgaggtctcctcagaagctgagcagatgctggtgccatgcctgtacatcctgcagaaacatgagatgaataaacctgttttctttataaattacccagtctcaggtagtcctttatagaaacacaagaacggcctaacacactacataatgtaactaattgagtgagtgacttcctatcacctttaaaaaaaaaaaaaaaattggtcaagagcagtggctcacgcctgtaatctcaacactttgggaggccgaggcagttggatcacctaaggccagaagttcgagactagcctggccaacatggcaaaaccccatctctactaaaactgcaaaaattagctgggcatcatgggcacctgtaatcccagatactcagaaggctaaggcaggagaatcacttgaacccgagaggcagaggttgcagtgagccgagatcatgccatttcactccagcctgggcaacaagactgaaactccatctcaataacagtaataatgataatttcaacctttattttaggttcaggaggtacacgtgcagatttgttacatgggggtattgtatgatgctgaggtttggggtacaaatgattctgtcacccaggtagtaagcatagtaccccaataggtagtttttcagcccctccctccctcccctctcctctcatagaccccagcatctgttgttgtcatttttatgtccatgtgtacccagtgcttagtttccacttttttttttttcaagttggagtctcgctctgtcacccaggctggagtgcagtggcaatatctctgctcactgcaacttccaccttcgaggttcaagcaattctccctgcctcaacctcctgagtagctgggattacaggcacctgccaccacacccagctaatttctgtatttttgtagagacggcgtttcaccatgttggccaggctggtctcaaactcctgacctcaagtgattcacccacctcaccctcccaaagtgctgggattacaggcgtgaaccaatgcgcctggccagtttccacttataagcgagaacatgtggtacttagttttctgtgcctgtattaatttgcttaggataatggcctccagccacatccatgttgctgcaaaggataaaattttgttcttttttatggctgcatagtatctcatggtgtgtatgtaccacattttcctatcacctttatattctgctggttaaaaacaagtcacaggttctgtctacactgaaggccaggggattctacaaaggtttgacttgtggtttaggatatgttcaccatgttgcagaaattatatatatattttttaacaaaattggccactatttagtatgcttttttctttgtacatgaagcacttttgaaaaaaagtcactgactacagtcttagttaccaagttgaaatcaaagatagatttttcttccaactgcaagaaaaattcagtgagtttagaagaaaaaagttattctactcagctgggtttgacagaaacactatttctgtggcctcctgtccccatcccctagttatgccttaaggcccttctcaaatatcttctccagaaagactttcctaatacttctaactggaattgttctccattttagtgcccatttattattgtacttccggtttactttaccattatttggatagatgatttgtctctctgtctggttggtaactgaaggtaacagaaactcagcaaacagatgttacattcatgagatcacatattttatatatgtgtgtgtgtgtgtgtgtgtctgcgtgtgtatttttttttttttgagatggagttttgctattgttgcccaggctggagtgtaatggcacaatcttggctcaccgtaacctccacttcccaggttcaagcgattctcctgcctcagcctcccgagtagctgggattataggcatgtgccaccatgcctggctaattttgtatttttagtagagacagggtttctccatgttggtcaggctggtctcaaacgcccaacctcaggtgatctgcccacctcagcctcccaaagtgctgggattacaggtgtaagccaccgtgcccagtccacatattatatttttgaagcctctccggcagtataatatatgctaacataaggtttgatgaattataaaagcaattaattttaggtattgggacacactaaaatctatccagtgtagatttccacactgggagagcaatagcctgtcatagcagctttgcaatcagatagccctgagatccatgcctgacatctccaattaatggctgtgtgacctggagcaagaaacttaatgtcgctaaatctcactttccttaatagagtcattactgaataaatatcaagctattcttaatatcaacttggaagtattaacatttcttaacacagttcacaccagggcacggactccacagtttaacctcatctccaggaggttagcatgcacacgtatcatgttcattcggtaggacagtaacctgctagcaaatgtagactaaataaacactggatcattcctgtagttatttataaatagtctccatctttggttgtgattttagtggttagaatactagaaaaagagtgggtagagggacaggacataaggaattccatgttaatcagtagcatgggaaggctggtcattttcacaaaaccaagggagatgaaataagattgtcctaaacactgttctgagaattacacagaacatgaaaggctgcttggagtgagtcagagctgggatgttataacagatccgggctctgtcgaacactcagtcccccttgccaaatgtaggaattcacaagatcaggctcaaacttaaaagtcaatttcttgtaggctgggtgctcacggctgtaatcccagcacttcgggaggccgaggcgggtggattgcttgagcacaggaattcaagaccagcctgagcaacatggtgcaactctgtctctacaaaaaagtccaaaaattagctgggcttggcggcatgcgcctgtagtcccagctactcaggaggctgaggtgggaggatcacttgagcccaggaggctgaggttgcagtgagcagagatcacgccactgcagtccagcctgagggagaccccgcctaaaaaacaaaacaaaccaaaaagtctatttcttaaataccatgctagagttatgttcattccttgcagtcatctaatcagttcccataactttcttgataaaaggcagatgttgcttttccatagaatagagatggttatcttggccaaggtgtttatgcaggagtgcgggtactaagatgattctagatttgtacctttttaaaagtctgttgtacagttctgtgttctgagattaggtggcattgtgtttcctttttacgttttttattctgtttccacagagaacatttacacactttcaaatgatcctgataactattccatacatatgatatcattggcatctatatactttgaaaatatggtagtaatttttttttgccatttatatctactggtgacccccataacttgaagctactttttagtgaccacaaaacttacttaaattcccaatgtatattattattatttccagtacctaaaatcttttaaaacttatagtataaataattacaaaataactttgaggagaaatttagagagtgaaaagagtaagagagaagagaaacaagaggaggagaagaaagaggaggcagcctagacttgtgaccaaagcttttacatggggtgaaaaaaagctaaactatattaagagtacatttatgagacaatggcaaagcgaacaagcaagagaaaggattttgacatatctcagttgacattatgaaaactctcattgcttatccttggaggaaatatagcaaccacctgactactcacaagcagcaaatgctagagaagactctcccctcttaatatcaataaactaatccccaccttacatgccatttaagtacaaggagaaagtagggaggtatataggcttttagttcttttaacatttgagaacccattttggccccaagtttagatacctcaacatttctgtcactaaccttcttccctccctccttcccctgcttcctgaccccccaaacccacccctttgtctctctctctcccccgaccctctcctcctcttcccttgcttctgagttgggagggatttgagaagaatgaacccataccaactccgccctagccagcattcaagatggccccatgaatcttgtctcctggtattcatgctttttctgtagtctcctcccatatggactcagagttggtctgtgtaactcacagggtgtagtgggggtgacagtgtgtcacttccaaggctgggttaaaaaaatgcacagtggcttcctacgtgcaccctctctgtcaacttccattttgataggatgctcactcatcacgtgtagaggcccatgcagataggaactggggcctcccagtgacgaccagcaccaacttgccagccgtgtgaccgaaccaccttggcaatggatccttcagccatagtcaggcctttagctgactgcggccttggtcaacatcctgactgcaaactcacgagagacacagagccagaccccccagctagaccactgccaaattcttgcctcagagaaaccataagagacagttaatgcttattgttgttctaagccaataaattttgaggtaataggttatgcaacaagtacatactatgtaataggtatgcaatagtatacaataatacaaatactttaaaagaaaagtcagaaatctaaggataacaaattcagagctttttaaaataagaatgttatctcccttgagtatttagagcctctagtaattgtccttgtagaatttgaagaaggttgcaaactttccttctttgttatttagagaaaatgtgtaacaaaacctataagaaatcactgctaatctatacctcaggagcctcatctcctgataactttttttggcaaaatatcagtgctcttccattgtgtgtgttcaaagttttagtcatccttacttagttaagatgattatatatgagtataccttttagttaacttccttttgatacatggtttatttcatgcctagggtaatgattgatgtttattcaaatgagctgatgtggatgcaagttcctcagtgctatacagtaaaattgctgttgacatcttccagaacaaaactgagataagatcctaattgtggattcccaaatattacttttcaaatactgttacattatgctgactattattttccattctggtgcttcttaagctcattacatggtgatgatttgtatatgggaacagtctgaagaaaaacaattgtgtgattttagataaaaacaggattcaaccgagatatggagtatctcaaagtaaaatgtgctattcccatctttctattctgtgtttggctccaagtccttaaacattcattcaatacacactatacagatgttcaaagaatgcctagtgtgcattgcttagtgctcaactgtgctaagcattattccacacatggggatggaacaatgaacaagacaaacaaaggttctgccctcatgaagtttacattttagtctgggagacagttaataggaaaacaagtataaaacaatataatgtgggatattgttaagtactaaaaagaaaagggtggccgggcgcagtggctcacgtctgtaatcccagcacttcgggaggctgaggtgggcggatcatgaggtcaggagatcgagaccatcctggctaacacggtgaaaccccgtctctactaaaaatacaaaaaaattagccaggcgtggtggcgggcgcctgtagtctcagctacttgggaggctgaggcaggagaatggcatgagcctgggaggcggagcttgcggtgagccgagattgcaccactgcactccagcctgggcgagagagcaagactccgtctcaaaaaaaaaaaaaaaaaaagggcagggtagagggatagacaatggctgcaaagttgagggatctaatttagatggaggatcaggggagtaaaatatgggcagggacttgaattatatagaaagagcaaaccatgcagaaatctgggggaagaacatttctaacggggaaagatcacgtttttaagccgtgagtgaacagaagcttggcatgtgggagcttaagagtaagagatgagagaggctgtcagagtacatagggcatgatggggaagggggatacagtagaagatgagattggagaaataaacaggaaacttgcaagcccgggtaaggacttcggtgtctattcaatgcatgatgagaagccacaagaaaattccaagcaaggaagttatgtgatctaatttaattttttaaatagcacactttgcagctgcatgaagaatagtctggaggtagcgagaaagccagcaagaccccttgaagggttactgtagttcaggccagaaaccatggtggcttgtggggtggaagtagttagtggaggcaataagaagtgatgggagctgcatctgctgcaagaatgaaggctgttctcagtaatcagactgtccacattccagaaaatgtcgacatcactctgaaggggcacagttcttgtgaaaggccctagaggaccctgcagagggacttcagtcacgtcagtatagaactcgggctccttggaaagaaaaagcagaggctccagattgacaaatgctgagaagatgggaattggctgccatgcgtgctatctgtagtcatgcacagaagatgatcaagggcgttatactgggcttctgtgacaagatgaggtctctgtgttctcacttccccatcaatgtcattatgcaggagaatagctctattgtagaagtcagaactttcttgagcgaaaaatatatctgcagggttcgggtgagcccaggtgttgcttgttcaatatcccaagcccagaaagatgagttcatccttaaaggaaatgacattgaacttgtttcaaattcagctgctttgactcagcaaaccacaacagctaaaaaccaggatatcagaacattttggatggtatctatgtctctgaaaaagggacagttcagcaggctgatgagtaaaatctaagagttgtacagctacagaaacaagatgtcagataattcctaagacctatttgtgatattttaataatgcaataaaagacagctattgaaaaataaagtagtgatgaggtttcaagacatgaatgatgggatttgctgatggctagcactcaggatgtaagggaaagagaaggattgaggctaactattgagttttggtctaagaactgcatgaaaggtggtatttatggacgtggtgaagagtaagggagagcaatttgggaggtggaagagaaccgagagatctgtggccaggttaagtttgaggtgtgtttatacatttccatatgggaatgtcaagtaggcagctcgaaatacaaatcgcaaagatgttggactcaagctataaacttgagagtcaccacaggagaaattgtgtttaaggccatgagactatttgctgtctcttaaggcagtgaatgtaaatagagagaagttctaagaaccggccttgaagcactctagcattagaggccgaaggtgaaaaggggtacccagtaagatggaaagcccagaagagtttccagatgaggacgatgtttcaggaagaaaagaaatgagtgatccattttatccatgctacagagtgtccaaaacaaatgaggaccgagaataatcttttgaattggacaagacgaggtcctggttgacattccaggaaggggcggagacagagcctgagtgaagtgtgttgaaagaatgaaaggtaggaaagtagacaccatgaaatacaaacagatgtttcaaggaattagctgtgaggacaaacagaaaactgatacagtacccagctggaaatgttgatttcctcagatttcttatctacaaggtgaaaaattttagataacttctaaatcccaatgtattacattgccaagtcaaaaaaacatcctagggtgagtgcctgaaaggctaaattgtgaaaaagagtcattactcgggttgttgatgtcctaaatatgatggtgtcattactgactagggagggtgctagcatcatttgtatccaatgcccatgtaatgatttgagatgacaatggaaacgttaagaaataatttaaatctattatgagaacaactctcatttattagtttacttgtagccatttctgtgattcaaatgagcattatgattattttctgacagaaagaacgaaatctcaggacagttccatgtccatctgtaattagacctcatggccagagggccacaacagtgaggtatgtgacacatcacctctgggctgctgtagctgggcggcatgatgactaagtgaaaatgacaacggcaatagtaacaggtgtcactataccactttagaatttacaaagccttttcataaaaattaacatatttaggctgggtggggtggctcacgcctataatcccagcactttgggaggccgaggtgggaggatcacccgaggtcaggagttcgagaccagcctgaccaacatggcgaaacctgtctctgctaaaaatacaaaaattagctgggtgtggtggcgcatgcctgtgatcccagctatctgggaggctgaggcaggagagtcgcctgaacctgggagctggaggttgcagcaagctgagatcacgcaactacactccagcctgggcgacagagcgagactccatctcaaaaaataataataacatatttaatcatagggaccatttaaaatgctctttcatttgtattaaattagttctccaactctgacagtttgagcatggttggcccagctatcctgatggctccttcctgctattttttttttaatgtttaaaactcatcttttcaagctcaagagctgttgctttgaagaggatttgaataagcatctgaaactgttggctcagacattgatccaactcaaatttccaaagctgctaccagaatgcttttcccatacagatccaaaatgaatgtgaaatgctgcctgtcctctttctcctgtcttcctttcagtgactccactttctccacagtggccctccacgtcaggcagcccttctaaagaatccactgcttgggtgtgtgtgttccccacgttgcattcagaaggcacatccatgcatctcaggcgtgtaggttcttcagcatgaatcatgcaaacttggtgaaccataaacctctccctgtggatatgagtttgttggtattttagtctgcttggaaacagtctgagaaacattaaacccagcttttttgaggttagtccaaattatttttttagactagagaaaaaaaaatattatgtctcctaaggaaacttgtaaccacgaacagtaaattttaaatgttttagaatggttttctttttccccctcccacatcccccacttgtgcatagttgaaatccctagtttctctcaccaagaaatactacatgctagactcacagatccatgggctgggcctgtgcaaatggatttcttagattaaaagtataaaaacaaggctgggcatggtggctcatgcctgtaatcccagcactttgggaggccaaggcggatggatcacctgaggtcaggagttcaagaccagcctggccaacatggtgaaaccccgtctctactaaaaatacaaaaaaaaattagccaggcgtgatagcaggtacctgtaatcccagctactcaggaggctgaggcaggaggatcacttgaacccgggaggcggaggttgcagtgagccgagatcgtgccattgcactccagcctgggtgacaagagtgagactccatctcaaaaaaaaaaaaaaaaaaaaaaaatatatatatatatatatatatatatatatatatatatatatagaaacaatatatgctccattatactgaccccaccaatcttaccctttctccacttttccagttcaatcatcccctaagtattcgtgtatagtaggattttaaaatgcacagtaccattcatgtgcagaaaagcacctttatttataaaatatgaattcaacttgctctacttggcaggaaggtacctagacctcactcacctattcaaggaaactgagtcacttcctgtttcaaaccacagtttttccaggttaactcaatctctgtagcatttaccatatccagcctcaaaggaccccacccatccatcctttctttgttcctttggggaaagaggaacctgtgagaagaagaaaaccacagggaaataagactttgagtttggagaagaataagagagcattataaagtgataaaacctaaacatggttcattaggaaaaagtgactgaaattctaatcctgtgcaggtccaggattatgagggaagcaaaaagaatgccactgacactagaatagagtatttcctgctgggcatggtggctaatgcctgtaatcccagcactttgggaggtggaggcagtggatcgcttgaacccaggagttcgagatcagcctggccaacatggtgaaaccccatctttactaaaaatacaaaaattagccaggggtggtggctcacgcctgtaatcccagctgctggggaggctgaagcatgagaattgctggaacccagggggcagaggttgcagtgagctgagatggcaccactgcactccagcctgggcgacagagactgtctcaaaaaaaaaaaaaaaatttatgtgctgtcacaactgcaaggcatgaggcctctctccctccctggcgtttccacatggcacttccccttgtgtttgacgtgtcagcctctgtcctcattgcaaatctcctctgccttccagcctcagtctctgtacagactctgccctcctcatcttggctgcagggttgtcaggttctttggccttctcatctcacagccacaggagcgtttgtgaacttgtgatcctccctagttcccggctctggcagtgggtgcggggaggcctcaacacagccagccccttggttactctactgtgactacctccttttggctccgggctcggtgacctacttccaaataccaaattgcagcatgggacttttctgattttcatttgccccctcaaatctatgaggtttctatgatctctttcatctcttctctttctcgtgagttacaagggagtaggggcgtaccgggtgcctcagaaggaacccaagtagcaatttcaccatagtctcatccctccaaatttctcctaaaaaatattccctcaatccaggatttttactacttccctctgtggagagaaaccccatgtctaacatctgtctcacccaagagcatgctggaaaattctttggcttcaaagtccaaagattgattctggatattgaatgtccagctaagggaaaccaagaaaagacttttctgttttctccttcaggtacctggtccttgaaattgaaacctagacacttatgcctattgtttttcttgtaactttcaaaatctattttgatgtcaaaatggaacaatggtttttttgttatccatcgagttctgcccttctcaagaagtatggatggctcaacctcagcagatggaaagctacagggaaataggaagtaccatctcaaggaaaagaaatgtgcctcattagaaatgtccgatgcattttttgttctcagtcgttcttgcaacccaaggactgagttgcaagtcaaagtgtttatcaatgttaagtttgaaccaaagacaaaaatctctgttgttctttccttcttagtagttcttaaactacttatatattagaacgctgctgtggaggaagaaatatttttagtttttcatacggaaaagttttaagacacacatttccatggagtatatttttcccacagtgttttccaaagcctctgtctttggctcagcatttctccaactggaagtttcaccaatgagtcccctgtgttcctgtggtccgctgtagggctactctggagtctctggcttattagcatgtaaaactcggagattctttccctccagttaaagtcatatccacaggatttacatgaaatatattatatatggcacctttctttgtaaggtagctagaaagtggctttgggaattttttttctgagacgagtctctctccgtcacccaggctggagtgccatggtgcagtctcagctcactacaacctccgcctcccgggctcaagcgattctcctgcctcagcctcctgagtagtggggactacacgcacacaccaccacgcccagctatttttgttgttgttgtttgtttttttttttttttttttttttttttttttgtagttttttgttttggtagagacggggtttcaccatgtttccgcggctgatctcaaactcctgggctcaagtgatccactgcctccgcctcccaaagtgctgggattacaggcgtgagccaccgtgcccggcaggaaatattctattctagtgtcagtggcattctttttgcttccctcataatcctggacctgcacaggattagaatttcagtcattctttcctaatgaaccatgtttaagttttatcactttgtaatgctctcttattcttctccaaactcagtcttatttccctgtggttttcatttataagggaagaaaagaaaggacgacaagtctatttttagggatccattaaaaattcattttttaatagtccataaacattgcgaagtaacttgggactcatacatacaattctgattattttaaattgcttcatgtgataattgcaagcatttattgagcatttacacattactgaacttaaaacacataaaaatgccattctcggctgggcgcagtggctcacacttgtaatctcagcactttgggagccaatccaggcaaatggcttgagtccaggagtttgagaccagcctggccatcataatggaaccccatctctattaaaaatacaaaaatgagccaggtatggtggcatgtgcctgtcatcccagctcctggggaggctgaggtaggaggattgcctgagcctgggaggttgaggttacagtgagccaagattgtgcctgtgcacttcagcctgggcgactggagtgagaccctatcccaaaaaaaaagaaaaagccattctctggcgatcattaaaaagtcaggaaacaacagatgctggagaggatgtggagaaataggaatgcttttacactgttggtgggattgtaaattagttcaaccattgtggaagacagtgtggtgatccctcaaggatctagaaccagaaataccatttgacccagcgatcccattactgggtatatgctcattggattataaatcattttactataaagacacacgcacacgtatgtttattgcagcactgttcacaatagcaaagacttggaaccaacccaaatgcccatcaatgatagactacataaagaaaatgtggcacatatacatgatggaatactatgcagccataagaaaggatgaattcatgtcctttgcagggatatggatgaagctggaaaccattattctcagcaaactaacacaggaacagaaaaccaaacaccacatgttctcactcataagtgggagttgaacaatgagaacacatggacacagggaggggaacatcacacactggggcctgttggggtagggggcaaagggagggaagcattaggagaaatacctaatgtagataacaggttgatgggtgcagcaaaccaccatggcacatgtatacctatgtaacaaacgtggacattctgcacgtgtatcccagaaggtaaagtataactttaaaaatgccattctctacagaatttgataaatttttaatctcagagcttgaaatcagttacaacactgttttaatctatgaaattatttcagtgtctttctatgaaatttagacccaatcttcagataccatagagtacctactatgtgccgggtgctctaattagaatcttccatttcattgtcatttaattctcacaagaaccctgctaagcaggtggcattatctcctttccacctgtgaggaaacaggttcacagccgttccacagccccaagcctcacatggagtaagaggttgagtaagatctgaagacacatggcacttttaggccacacagtgtccaaggtatttaaatgaagtagatgactgagtgttttttaagccacacacttacagaaaagacactaggagatgagcagaaggtgtttccctggagatgctgccctggtaccacagcagcaggaggtgggacaagctgacttctactctgagtgagttaagaacctcagggctgctctgggatagagacagcatgaacaccagtgcatggagccattgtaccctggccatggtttttgttttagatcagcatcaggttcagaaatccagaaccaaaaagaaatgaatgcaactcccattccatcaggtcaggagtgaccaggcctcccacagacctttgcctgtttcctccccaagcgagcctcagagccttagaagccctctcccacatggtcttgtattaaatcatgttcttctaggtcaaataacaagggtccgttattcatgcctctgtttatttattcatatgtgtattcattttattcacctataaatatttactgcagtaatattaaccagcgtccttgtggatatcagagtgccacggatataaatatgggaagaaaaagaaaccactttaaagaaaaaaattcttttagagagtatacttactatatgtcttcttatagatatgggactttgtcaatggtgagtgctcagtaaatattcagagacgaataaaatgaataaacgtatgaatgaacagaggagtgaataatggacccttgttacttgacctgagagaacataatttaatacaggaccaatttctatcattttcctataagtaatgtatttctatattacatatgatattttgatataaattatattttataagtaaatcacctctaggctggaaaactcaccctatgttggcccctaggaacatttaaaaaaatttttttagaaacaggatctttctatgttgtccaggctggagcacaatagctattcacaggtgcagtcatagcacactacggcctcaaattcctgggctcaagagattctcttacctcaacctccagagtagctccgactacagatgtgtgccactgtgcccaacttttagagattttttttttctggctcagaaaaaatccctctcagtatgtttattccaaaccctttctaacaggtgtccatgcgttaggcaaaaagccttacagcttctcagattcttctcagattcaaagattcatctgtattcatcatttgagattcatctcaaagacttgcttagagatgaccgtaccatctctaagcaagttttcctttctctctaacctgctcctttggttcccgcacctctcttggctccaggtgtcaataaacaacacctttgtcagctctttccattgcctcctcctggtcagagcatgctgagtgagcttcacttaaagcctcacttttgcatcggataactttttctcatttgaatcgagggtttatacactgcccaatataccatatccaatataaacaggaaagaacatgatttctttgtagtaggtagcctcccttctaggtcttcttttacagtgtgatggttatcaggcttaggaatcagaaaaagttagtctgaatctaatctctagtccttagctttaacctgggcaagttattgccatcatctgaaaaatgaagataaaaagaatgatgaacaaatgagatcacatatgcaaaacatacagcacaatatttgaaaatagagaaggtttagtaaatggaagcgatgatgctgaaggagggagaaggaaaaacagagtagaagaagaagaggagaaaattgctaaataatgagtagccatcttgagagacagagagcgtggcccagaggacatgagagattaggaactgctgcgttttatagggaaagggaacacaagggtaggaatgtactggaaattccatccaaagaggactcaaggtaatgcaagtcagaatgggtacttgggagcatgggatgacctcagagccaaggtgatattacatcccactgtcacccacttcacactgtggtcttaatttagctacacgttcatggacaagaagttcagagccagctcacactgcagaactgggttccggttttataagctaacttactgtttgccacagattgtaacctctttcccaaagaacagacataccaggagccagaaagtagcttttaattaatgaatttgtcatctgctgctcagtggtaatgagggaaatcctgtgccatacattcttttaagtgtagattcaggatctggatatgtactagtgaggtcagcaattcagccctttacctctgattgtgggccaaataaatggctgaattactcatgggggtgtggattttgttaagtgtggtgggtaggggttgggaggaagagaagagggtgtgtctttcttggcataggccaaaatgaatgaaaatgctttgaatgttattataatctattctgtgaccatgtccaggtggctttctgccatggctctgggcacacccatatggacttagtccctttctgtagggatttcacagtttctggttggcagagtaaggacccaagcaggaagattttcttccccacccaacacacccctgaatcctgccaaatgtgaggtgtgggagtgataatatcaacgcaataataccaatagtaaccacaataggttcttaagaaactggaaaagggtactgagaagttttttccaccttttttgtatgcctagtttgctacattgctcctaagttcctagacttctgggcagctctgcctatggaatagccattcttttactcctttactttcttaataaacttgctttcacttaaaaaataataagttcctagacttctctttagtgaatactagagctctacctgaaagaacccacattttcaggtcaattcccaaaactcaaatggtagtgtcatggacttgaaagcagtcttagggactgtccattccaacattctgcccatcacagacattccctgggagcacccaaggcaggcggttgtccagcctgtgaatggacacatgcagagacggagagcctgtttcctgagaaggccaagccatgatgggcatctgtagtggctgcaagacagcataatgcgggggaaagagtataggattgggaggcatgggaattggttcagtgcttgttcttccactgaccagctgaacgaccttcgggagaagtcactgcgccttagaatgagtcacttatcaactatgaagctgttggatatgatctcagtcattctagcaataacatggtcatttaaagttgtttttctacgtctagccaaaactggcctcctgtaactgccagctattggtgttagttctaattttgagaaatgtagaggatgggtcttatctcattggtgtggcagctcatcaagtatttaaagatggctgcaatgaccctgtaagttatctcttctttagtataaacatctcaagatactgtaaatcttccttttatgacttggctttcagaaatcttcctcctcctgacagtcctcttccagacagactcaactctttaaattatggtccctagaattggatgcaacatttcacaaccggccaaataagagcccaggaagtactgggactgtaacaacccaaccctccacaactatctctgcctttcatctagaccctgtgctgcttttcacttaagtttgcctttgcgttagttatttcagcctccatcgtcatctcatgccacagactgtgcctgtggttgggtacagccaccaggcccttacacatgacctgctctccagccacttctcccctgttctggacaaacacatagaatgatttcccccttttcactatacaattaatatatatgcatagtaatgtagaaagctgaacaatagctgcccaaattgcagtatccagagataacattgttaacttaggctaataccagtaaattatttttaataacaatgtcagcattcatggttttccttacatactgaggtttatttactccctgtctctgattttttttttttttttttttccgagacagagtttcgctcttgttgcccaggctggcctgcagtggcgcgatctcagctcaccacaacctccgcctcccgggttcaagcgattctcctgcctcagcctcccaagtagctgggattacggggatgtaccaccacacctggctaattttgtatttttagtagagatggggtttctctatgttggttaggctggtctcaaactcccaacctcaggtaatccacctgcctcggccgcccaaagtgctgggattacaggcatgagccaccgtgcccagcctctgatcttatatcattcctcttaccctcagtggaagacctcagtccaagcctggctttcacccctacaccagcccatctttccagccttgtctccaccattgcccagctgttatccatacccaccatggttcagacttccatactccctgtaagctcctagaatcttccctcatctccctcatttgaccttttggaaaacctcctgttcatccttcaagacgtagttcaaatgttacctcttccgtgaagtttacccgacttcctctcccatccgcattccactggaatccccggttcttttatctatatttctgttgatctttgatactactcttttataacacatgagattgtaattaattggatgcacctgaccacaatcaagtcctaccctgggagccacaatatcattgggcaaactttagtctattgtccaaactgtagcatataaaagccgtgtcaaaaaaggaaaagctaaaacatccgctctacctgtgagtgctcttctttgaatgttcacattaattaccctgaacctggaacactttgttttaagacatggatgatcagacggtggaataaaggtcaagatgaaggatagagggaagaaacaaagatatgttctatttagtaggttcagggcaattcgtttcagaaaagtttcttacatttatatactacatgcatgactatatgcatatgatctatttattaaaattgtttttattcagcatgtgtcacatagacccaatttatttttggagagcatagactaacataaaaaataaataaatctggccatggcagctaatttgaatggtatgttttttcttttgtttttttgagatggagtcttgctctgtcaccaggctggagtgcagtgatgccatctcggctcactgcaacctccgcctcctgggttcaagcaattcccatgccacagcctcctgagtagctggggctacaggcacacaccaccatgcccagctaattttttgcattttagtagagatgggatttcaccatttggctggcagtgatgccatctcagctcactgcaacctccgcctcctgggttcaagcaattcgcatgccacagcctcctgagtagctggggctacaggcacacaccaccatgcccagctaattttttgtattttagtagagacgggatttcaccatttggctgggatggtctccatctgacctcgtgatccgcccccgtcggcctcccaaagtactgggattacaggcatgagccaccacccagccggtatgtgttttatttgagtgtgtatagatgacttttccagtgaagaacattcattgtatcccagtcaaatattaaaaataagctgttctcctggcttctataaatcagatttccacgcacacaatcctggaagagtatatctgtgcacatgcctgccctggagctatccgttagaactgtcctcacagtgacgtggaaaactttgcctcatctgtataaggtctcgtctttagagagaggagaaaggattgggaatttcaggcttgaatctctgaaggtgcaaagcttgaaaggttgagatggagagcagagtctgggaactctgtgtctctgccttggtctgtgacagatggggccgggctggtctcaaagccgttgcctagaactcaaccgtgggctggcgttacccttttgaactccccctgcctgctacaattcttctctgctctatcatgggtcccaggacagtttctgctccagactgtctgaggagcttagggaactctgaaaggaaaccttttaagtctgcttttcttgagaatgctaaccctgcaaaacttggccagacatcacattgggtctccctctgtggtgactcagaaatctcaaggagagcaggaaaatctagaggaacactcataatgttgaaagggccagagggcaggagggatgaaatttgtgtttccattgagtgggtgatatttttcatttcaaagcctgatgtaaaatcttgctggtttttagttatctacagattgagaatataaacactgctattaaaatatttcatctctcccaaatgaggccatgcacaaatttccttctatgtgcagagccttcagcaacatccataccaagcacaggcagacatccaaatctactctttttacttgaagggaaacagtgctatctctgtaggagacagaggctgagggaaaggaagagaggggtcttggaaggtcaaggctgagttgggggagagggcaacattcataggtcaggaaaggcaaaccaattataatgatttctttctatcactagcaacatctactctggaaacggttgtctaaggttatgccctttctggtaatattcagacttggagtacttaagcttagttaaaagaatttgctagcactttaaatgttggattgctggcgagaatagaaaagcctgtctcccttcaggcaaggtcctgccctgtgcttttgtgtgtacccctctgccctgagaatagctgggctattggaggttcacacagtcaataaccactgaactgcacccgtgggtagctctccagtgctgcctgctcatttaacaggtccttatggagatgggcctgatacacaagtgctggcgatcttcaggacaaacccaataaaatgagagaacctaagcttggcttctaaccttcctgggaaaaggaagtgtctgtggttttcatagagcattcagatcttttttgtacttctgtctttttccattgaagatggaattgttctaccctctccaaagtcagccctgaaccaaggggttttccatgactttctgtgaccatcaacattcaactgatgcctgtttcctatacacttcagagagagccagagcttcacaagccaattaacacattcctaagaatcaaaacttagtttctgggctgggcgccatggctcacccctgtaatcccagcactttgggaggctgaggcgggtggatcacttaaggccaggagttcaagaccagcctggccaacatggcaaaaccccgtttctactaaaaatacaagaacttagctgggcatgggagcgggcacttgtagtcccaactacttgagaggctgaggctggtgaatcacttgaagccaggaggcagaggttgcagtggccaagattgcaccactgcattccaacctgggtgggcaacagagcaagactccatctcaaaaaaaaaaaaacaaaaaaaaaaccttagtttctgaaacccataatgcaaatacatgttcctccaaaggtctcaatgttcttatctcaaaatacacattttattgcttttgaaatacatgattatcatatccctttggcatgaatttgtatgaatccttagatttaagtatgtaaaatataataaaaacaaaagtgtgtgaataccccctactgcagagttatgcaagcctaatattcaaagcatgacatattaaatattataccttaaagacagaattagaacatgaacacatgtataatgtctttgcctcaacttcaaaaatgcacagttgttgagagcctggaagagacattcaggaacgggctgcaacaagccttgctctggtgtggtcctgcttatccaattgttgctcaataatgtcccttcccggaggcatagaaggcaggcacccatacattcacacccacaaaaatgtcacctcattccccagagattgccagtctgggcattgaccttcacttaagcagggcatcagtgtgatgtggtccccctgctggaagtggaattgtttctaactctgggtgcccacaccatagagggcttgtctacacttggtctcagccatcaccccccaaacacacccagctctttaccacctgattccctcaaggcgactctccttccctctgccagcaccccttggttgtagctttggggaccctggatgtttgaaagtttcatttgtccacaatccaggtataagtcccccttccctggattctagggagggcagcagcggcatgtcgttgtcactcagcttgctaatcaagagagaaccccagaaagagtatttaggagataagaggggtagtatatatttttgtaaatagaaacttgttttctattaataattaaccatttttctgatagcaaaaacatcagcacaggtatactctatccatttatggttggttaacacacagaaccttttctactgagtagggttaataatacttagtatgtgcctagcattcaacactcacaacagccttgcgaaataggactatttttattcccattttacaggtaaggaaacagagaccagaggtgcaataactttcttaaaacgactagagggagcaagtgacagctaggacttgaacacaggctgttggccttcaggatctaggctcctaacacaatgcaccaaagccaagtcagtgccaaagttattccatacaaacggcacttgttctttcaccctttcaatgttcatgttatctctgctcttattttcatcttcattgtacacctccccttacatgtatttgcaagtctctcactttgcaaaatggaactgataagtactaaacctcctcaaaaaaagcacaaacagccccagagtgatgatgcccaaaacttaaatgaccacagcaaccagtgccatgccagtgagttttggagctgagctttggtcttgtccatagaagcttttaagttgaaagcttataaatagagggtttctatattctgtgaatgatagaggtacacagttccaattgtattctgtattacgtgtatgtgccctctttgcataaatgtgcctgacactgtagtggaggccagcttcttgaaagcaaaaaaacacgcatcccattcatctctgtatttccagggctcagcactagtgggtgctcaataaatatactgaatgaatgaataaaagtattactgcaaagatcagtaagtcccatgccaaaaaaagaaaggaagaaaaaagaaagggaaggaaggagtgagcgaggaatgaaaagagaaagagggaaagagggaaggatggtgagcctcttcagaaagacggctgctcatgcttgctctcttgggcatggagtgggtcactggctggacgtttaatgggtttacattattccttaacagtcattgtttcaaaatgaggcatctctgatggctccatgctggcttgtctctttccgcctatgacattctctcaagagtttagagtaggagaggattttagaacatgatagtaacaagtaaaattagtattttttggactccaggtacctgtttgaaattatattgtttagaatataacaataacagtgaaattaaattgttgtcttaaagtgaataactgtaaagccatgtgtgatctgaacccccgagcctgcccttatctatcaaaatcctggtgtctgaagaagtccaaaatggaaacacactctgaacagatttccggcaggagcttccaccaggttttcttcgtggcaagccctagaaatagtctggactacaagcaggtctttttaaaaccatgctcctttatttaatcatgaagatttaaagtttataagtttagaaattcagggataaaaataacccactgagtgtcaggcctgattgctaagtgctgttcaggtgtgatctcacagctctctcagcattttcatcactgccaccacttcacaggtgagaaaagtgaggcagacaacagacaagttactggtctaagtggtagaataaaaatataaccccagctccagagcctctgcactcagccatcatcgtgtactgccccgctgtgaatttcatctaggatatgccaagacctgctgatttttcgtcacttgccttttcttattaatgtctgttccttggcgacaatggcatctgctgagccccacccggcctccccacccacctcgccgcctgttctctccctcaaatccgaaaggtcacgggtacacacccaacttcagatagcatttagttagcttcccctccaacactgaggaaatgttcattaaatgctccagccatttaacaagtctatttaacttcattttcaatttaaccatgtattatttcagtttccttttcctccgtattgtatagccctgggaataagagttggaaatgtgcctatcataagctgagtcacattttatgtgtcccctcctctcaagccactgttttctctctctttttttttttttgcgattaaaaaaaatatatatatcctgtgtaaaataaaacagattcagaaaactgcgtaaaacaattcattatataatttgtatatataatgaatgaaagaaatagaactttctccttgtacttgcctcagaagccatgtgacccaagccagtcacagcccctgccaccttcaaagtcagcattgtattaacttatagtacttacatccttgtggatttttttcattgcagataatttttaacatttttgaggtataattgctatatataagaaagagcacatatttaacgtatgcaatgtaataagttttgacatatgtacatgcccttggaagcattatcacaattaagatagcaaatactggctgagtgcggtggctcatgcgtgtaatcccagcactttgggaggccaaggcaggcggatcactggaggtcaggagtttgagaccagcctggccaacatggtgaaaccctgtctctaccgaaaatacaaaaattagccgagtgtggcggtgcacacctgtagtcccagctacttgaggcactaaggcatgagaattgcgtgaacctgggaggtggaggttgcagtgagccgagatcatgccactgcactccagcctgggaaacagagcaagactgcatctcaaaaaaaaaaaaaaaaaaagatagcaaatacatccatcatcctcaaaaatttcttcctaccccattataatcccttcctcctgccacctgctccctcctggtaaccgctgatctgttttctgtcactatatatttgtcttcattttctaaggttttatataaatggaatctttccgtatatactctttttgtttgatttcttccactcagcagaattactttaaaattcatccatgtcttgttatatgtataatacctcattcctttttattgctaaagagtattttttgtacataaatatgatatctatgcttatagagcatatatatcacaatttattcattcattcagttgttgatatttacatcattttcaattttttactattgggcttttttccaaaatggttatatcgttttacctttccaccatgattgtatgagagttccagtttctccacatcctagtctgcacatggtatcattagtttttcttaattttagccactttaacaggtgtgtagtagaatttcatcgtggttttaatttgcacttccctaatgactgatgatttgagcatcttttcatgtgtttatttgccatctgtatatctaccttggtgaagtgtttgcttaaatctgttgcccattgtttaattggattgcttgttttcttattatcaagtttcttattatagtatttatatattctagatacaagttctttatcagacatgtgctttgcaaatattttctcctactctgtggattttttaaaaatttccttcatagtgatggagcagtttttaattttgatgaagtcaaatttatcaacttctatgtatcatgctttgatatcttattaaagaaattcttgcctaatccaagctcacaaagattttctgctatgttttcttccaggcacacatattatagtttatgttatatgtttagacctatgatctattttaagtcaattttttatatgatatgaggtatgaattgaagctcttttttatttgtttgcatatgcatttgattgttccagcaccatttgttgaaaagactgtcttttcctccactagattgcctttgtaactttgtcaaaattggttgtccatgtatgtgtgagtctgtttctggactctattctgttcaattagtctgtttgtctttatgccagcactgtactgttttgagtactgtagctttacagtacatcttaaaatcagatgatgttagcctctcacctttgttcaatctaaatagaaagttgttttggctactcttggtcctttgcatttctctatagatttttgaatcagcttgtcaatttttaccaaaaagcttgctgggaatttgaatcaaggttattttgaacttatagatcaatttgaggaacgttgacatctcaaaaacattgcatctcatgtctcatgaacaaagtatatctctccatttacttaggtcttcttgaatttctcccagctatgagttttcagtgtaacaggtcttgtacatcttttgttagatttattcctattttatgttcttatgctcttgtgagttcttaaatttcatttctgattatttattcctagtatgtagaaatacagttgacttctatattattgattctataatctgcaaccttaccaaacttattctagtagcatttttatagattccattggatttctacataatagtgttgtttgcaaatacagacagctttgcttcctcctttccaaactagatgcctgctatttatttttcttgccatattgcaatggccaaagccttcagtaaaatgttgaatcaagtggtgagagcagatccttgccttgttccttatattagggagaaagcatgcacccttttactattaagtatgatgttagctgtggttcttcagagatgccctttattagattaaggcagtttccttctattcctagttcacttagaattttttatcaggatgttggatttttgttaaatgcttttctgcctctattgagatgatcatacagttttccaaaattatatctgttgattttcaaatgttaaaccacctctacagtcttgagataagccccatttcatcatgatgtaattacctttattgttgtatttgatttactgaaatcatatttagtttttttatgtgttaaatattcccagtacacttgataatttgggatcccaatctggcttgttatatttagtctctgcactaagctctagctacggtagctacagtttacttaatgaccaaataacaaccttttcttccattttaaattttgtatgactttggctgagggtcattgaaaaatcaaggatgggaatacacacacacagaggcacacacatatacacacacacacacacgccccacagtcttacatggtgaggtcctgactgaagtttattaggaaaactaggagagacaggccacaggacttttcaaccttcctgagtagagctaacaggagactaagcctactcagtgagtctcagtgaaaactgggaaagagggatacggaggagaagcagtaagcactgctgcagttatggcttggaagaatgctgttaatactgctttatcccatcattgctccattgtccagtcttgacacaggacttcctgccgccttagactgaaatagaatcactgccccaagataaatgtgatgggggagacggggtttaggaagtgattatcagacacctgcatgataagagaaaatggaaagcaaaaacaaggagataagaaggaaacaagcccagcatgttcccatgggttttacacatagactcagaatatcagtagcagcagggactgtggcaacccaaggccacaatacccaactaacagataagaacaccaaggctagactagagaggctgttcatctgagagcatactggtttgttttgttttgtttttccctcttcctgatatatccagaaaatacttcctcctcccagccccgtttagcagtaacttacttccttggagaacaatgcctcaacccatattcaggccttaggttggtacagacaatggcactttacatgcgtgggactctccccacccccttcattcaatgctgcctaatgagcactcacttcttgggtctcatcaccagtcctgcactgtaattcagggagccagctgcctctgccaacagtgtaagtaatctcaggctattttataatcagtcctgaagaacccagagggggcaccagactcacctcaacctcagattatgttttggatccacttttcttcgtcttggatgaactttgtgaactttgtgtttgtgggagagcacagtgaaggatgaacaaggaaaaggaaaaaaggggtaggagaaccaaaggcaggacagcttttccttcctcttttctttcctgaatttttttttctagagaagtcttcaaatattccagcctcaacttttgaaaaagaaaaagcagaatgtttttagtaggatctttttgtttctagcttactgggagacagtgggaggatggacacttttgagcagatatgcatcacccaatcaatcatctccagaagaacatctgaatctctaaggaattgatccaaattgttaataatacttgtggtttaagacagatagatgaaacaccttgtataatcactatattcaatgtatttgactcatgtatgggacttagaatataaattttaataaagtagaggcttaagcttgcatctttgcttgtgtgtcgtactatggcgcgtaactgtgatttccttgctgaatccctttagggcaaagctggctttggtcatgatcagatttagggtgtctagcacatagtagatacttaataaatatttacataacaaacctttacatggtactgattatgtaccaagcaccgtgctaaatacctcaaaaatttaagctcatttatgccttacttgcgtaaggaaactgtcattactatctatattttacaaagaaaactgaatccagagagactgagcaccttgtccaaggtcacacaactagtaaagggaagagccagcatttgaacccaagcagtcttgctctttttatttgtttatttaatttttgtacaggcagagtctcactatgtcacccaggctggtctcaaactcctggcctcaagcagtcctcttgctgtagccttccagtgcttcgggattataggcatgagccaccgtcctccgccaaagaggtcctgctctaaacacttgctaagaatacattgacattgaatttttcagtcattaatgttatgatgcttatgaaatcgtgacatgattctgcatgaaaaatggggattatatgatgatttcattgatctaagacagttaactagacatcagaatatatcttcacttcctaagttacccactggttattgattctatgttggttgatctataaggaggcatacatttgttaatgtactccttactcaacattactaattacatttttactttaaaaagcatcagtgcttcttctcttactatatggaaattaaagattctttttgcaattttgtttcttattctttctacattctgtaatgtattagaaacatgaaattactcctttgttcttcaggaactgttcatttgaaactctccaacataaggatgctggggagaaaacattcctatgttttattttgataatgaaatattgtgtagttttaaagcttagacatataaacttcatgtgaacatcatatatatataaaaaatcatatatatataaaatatcatatatatacacacacacatgtgcacacccttgcatctaatttataaattctaagatagtcatgaacatacatttttagattctgtgacttatttggcttttaatgcaccacaaggtaaaactctttatactctgtcatatttttgtattttctacccacttaggggagactacaattatataaaagttgctataacatttttaattaattacttgactccaaataattccctgtaacattctaaatttaatcatttgactctgagtagattcgttcctcatttaatatctttgtcactttcccttcaaattctttctactgttctttactttgggcttacttttgctgtgcctctttttcttcatttctaatctactatacattctttttttttttttctttttgagagaaggtctcactctgttgcactgcagtggcgtgatctcagctcactgcaacctccaccaccggggttcaagcgattctcctgcctcagcctcccgagtagctgggattacaggtgtgtgccaccatgcccgactaattttggtatttttggtagagatggggtttcaccatgttagccaggctggtctcgaactcctgacctcaagtgattcgcccaccttggcctcccaaagtgctgggattataggcgtgggccaccgcacctggtctcactacgttacattcttaatatggttttgttagcactctctgtgccaaaatcctattttcccctcttttcccttaggcagggcatgcacagagcagatctatttcctaccaaccttttttcccatggcacacacagctgccccttggcaataagatgcagtccctgactaatgcagcattgctctctgaagattttaatccagctttcttagtctcacctagctttatgaaaaatgagaggctagatattttgctgtttcttactaagatttgcattgctcatactataggtgccctgtgtaattgctctaacattttctcttcacacaagattatccagtattctctcttatcctgcctcatccttttccttttctgtagccagttgttatgaaaggggtggccatggcagacactgttgcagtgtaatgtcaaatattatatatttaatgtgcatgtgcccgcatgtgtagttttggtttttttgttgttgttgtttgtttttggagacagagtctcactctgtcacccaggctggagtgcagtggcacaatctcggctcactgcagcctctgcctcccaggttctagcgattctcctgcctcagcctcccgagtagctgggactgcaggcacctgccaccacacctggctaatttttgtaattttagtagagacggggtttcgctatgttggccaggctggtcttgaactcttgaccttaggtgatctgcccacttcagcctcccaaagtgctggaattacaggcatgagccactgcacccggccatgtgtagttttcaaaagagccatagataggagtcgacatttgaaaccattcaaaatgaacatttttttaaatgccaacagaatacttccctgaaaaaaagagccacagatacttgttggctttctttctttcaatttttgtgatgacaaagctgttggatttgacttttgagtagtaagtttatcctcagggcctttaataacaccagcatggaatcaaaattaggagaattactggactttggctatgtatacaccaggtttgtgactgttgaacaggatgatgtttgagaagatttactgaggttttgggggtatcttccttccctgcattttggccagtttcaagtcagaagtgggcagagcctagttaattgcaatggaaaagggcaaaccaggagccagcagctggagaaccaccttgagcactggcacatagagcacagttgctcagcatggctggtgtggtggaggggataactatgacatggtgtatggccaggggcagaggccgggaagcctgtcgcagcacagcatgttgcagtgacatgatgacaggaagcctcggagcaaatgctgtttggagatttgagggaggtgaacaggctgtcagcattgaggaaaactgtcagcagaccacagtgatgcaggcgctgggctgtaggtcagaactcttaaggattattaagatcataccactttagtagggctggttacaaggtaggataccaggagaggaatatagaaatgagggacaagacaggcaattcagaacacagctcacagaagcccggaacaagactggaccaaacaagttcaagtacaagctaaaagtcatgccatcattatattgaaaagatgtgatgaaaaagtaatgtacccactgactgattttgccttattgcttgggcatagtgagaaggccctctcttcctatcattgttttgataaaagaaaaaaaaaacaaactaccctggcacccatcagagctaaatgctgtctctacctgccttccccaaccagattcatgcctggtttgcttagggattatctgatgttactagccatgtctcttcttgcctccactggcatggaaaatctgggtaaccacaagcaaacttgaccagactgctaccaatgcctgaaactgaatattatagtacaaccgtgtgacacattcaaagatgctgactgctgtggaacactgaggcgcaacagaacttcacgaaaagaaacttttcagtgcaccctctgttagccaactctttttgagtgtgcttgcaactgtgctgttgatgtagagcgaattatatgtttaattttgatcccaaaccataggtagatgcttaatttttaaaataggcagatagtgtctagaaaattagtagagaaaagtaagtttaagctaaatataaaaacaatgaacagaatgtttcctatttacatgttttgtttactttttgtctaaaccagagatgagcaaatttttctaaaaacaaaaaaccaaataaatattttaggcttagaaggccatatggactctataataggtattttacatagtccttgttgtgtgaagcagcaatagacaatgcatacaagaatggtcatggctttgtgccaataaaactttatttacaggccggtcacggtggctcatgactgtaatcccagcacttgggaggccaaggcaggtggatcacttgaggtcaggagttcgagaccagcgtagccaacatggtgaaatcctgtctttactaaaaaaaaaaataaaaaaattagcttggcatgatgatgtatgcctgtaatcctagtgctttgggaggctgaggcatgagaatcgcttgaacctgggaggtggaggttgcagtgagccgagatcgcaccactgcactccagcctgggcgacagagtgagactctgccttaaaataaaaaacaacaaaaaaaaactttttttacaaaagcaagcagtgggccagatttggactatggaccatagtttgccaacccctagtctaaagaaaacagcatttctactcacaaattttatatatatatgtgtgtgtgtgtgtgtgtgtgtgtgtgtgtgtgtgtgtatagtactgtttctgttgaacagataaaaccatatattcatggtagctgcagaaagcaaaagatacctttaagtgacttcctcctttttaatggataatggcaatatttattattttgatttagttaaatatttattgctgagtaccagttatgttcttattactcagtattaaaggaagattttaaaactcctggcagcctctgatctccaggagctcatagtataagagagctaagcaataatattgcaaagcagtaaaataagcataatacagagagacccatgtgcactgggacagtttggtcttcaggaggaggggtggatctagatgagtcctgagggccagcgcatatttctaaagacgggagagacaggagagcatctaggggagaggtgatgagaccaggaggagcatgaacaaagattatacaatcagagaaaacgaatagttaaaagaaagcaggtaactaggctagccagggcaagatgatcatgctggctgtgcctcttcaccttcatccataagatacggagagtaacagtagcttcctcgtagggctgtcatgaaaatttagaaagttaatatttgtaaaattcctggagttgttcctgacaaagaatatataagtatttgtcaaacaaataaatgctggaggtagaggtggggattggttgataagatatggtaagatggagtcaggttgaggacaagaataattttccaaaaacactttgatgatgtagctgtatagtgagggacctgtagtgtccactaccttcaggacaatagccaaactcccaactaggctttcataattgtcccctgatcccaaatgagtgatcagtaagtgaggaatgtaaaaggtaactcctgaggccaggcactgtggttcacgtctataatcctagcactctgagaggccaaggcaggaggataacttgaggccaggagttcgagaccagcctggccaacaataatgagaccccatctctacagaatattaaaaaaaattttggtctgagagctaggagcaagagcttagggaaaggaggaataagaggaggtagttggctaccaacagacatctgaattcttaaccaatgaagagaaaaaatgtaaaagtggtcccagccgcttgggagaatgaggcaggaggattgcttgagcccaggaattcaaggctgcagtaagctgtgattgtgccactgcacttcagcctgggaaacagagcaagaccctgaaaaaaaaaagagagagagagagaaagaaaagaaaagaaaagagaaaggtaactccagttccagcacacagtgccactgcaggagtgaggaagccacgtgggagaattattttgtgggaaaagctgaggaatgcttttgcacatgttgtattggaggtactggtgcccaagtggagacagcctgaaggcagagggcggcttgagttggggctagagatggacacttgggaaccatgagcacagaagagaccacaaacatgttgagacaagggaagcgggcgggagaaagagcagggcattgagtcttgaacattgctcacaccttcattgatttggaagagacaaactgctgctgtcaacccaagtttggggtaggcggaaaagtggatacagagattctctacctcctcttacttgggaatgtaagtcaaatgtgagtttcatagcaggaagagcgtgaagttgttaagtgcacagtagtccatgagaacagattttcccatcttgagcagactctgcagagccacaaacaatgccgccttatgagctctggtcagtctggtcatgggatacctgtggggatttctttcctgtcggagcagtggcttccgtgagacttggcaaagaggctggtctgaggaatgcttctggttgtgggtacattccagcccagggtggtgtcccagacattttccttttaatgaagccccagcttttttctcccttttgctttttttttttttttttttttttttttttgtaatgaaagggttgttacaagggaaatacaatggggccctggctgtgtttcattaacttttaatttaagctgttagtatggaattagttagcagacttgtgaatcaattagctagccagtgggattccattttaacaaggggagcactgtgcgctctcggatgctagctatgtgtgtgaatgcggagtttaaggagcttcgctgtttgttcgacatccgaaagtgaatcacagtccttgttcctgcctcctctactggttccaagttcactcggctagaacatgctgtgcatcacccaacccttatcttctctacaaatacaaatttggattactgaataaatccagtggaaattcatttttcatgctgatgaactcaaagactttcagagttaaaccaaaacaatgcactcggaactatagtgaaacatttgaacatttaccctttgatccagagtttccccatattctgggaagcagtaactcctgggcaattctgcagtcttctgaaagttctatataagcttaattgtccttcctcatttgcaaaccccaccttgggtttgggaagatctgacagctgctgtctgggtttggcgtacttaccccgttactggttgagaggagacccagttaacaatttcagcctcaaatttaaagtccagtcatctcaaaggaagacagtgacataacagggaggcctagctggctttaaaataaagggagaggggacagagtcagttctaataaactgtagagatatatatatatatatatatatatatatatagcattttaagcccaacttgaagaaagttgctgaattagcatcagaaagccacagaaaaatgcatagagggagagagataggcttgtgattcacattaatattttgggcaatggaatacagtgtgaccaataaaaatgattcaaatagtatgatagaagtatactactgtcggccgggcgcagtggctcatgcctgtaatcccaacactttgagaggccgaggagggcggatcatgtggtcaagagattgagaccagcctggccaacatggtgaaaccccgtctctactaaaaatacaaaaattagctgggcgtggtggtgtgtgcctgtagtcccaggtatttgggaggctaaggcaggagaatcgcttgaacccgggaggtagaagttgcagtgagccgagatcgcaccactgcactccagcctggcaacagagtgagactccgtctcaaagaaaaaaaagaagtatactattttcatagaagtatacttattggcatagaaatatgtttacctgtcaggtatggtagcccatacctgtaatcctagcactttgagaggcctaggccagaagatcgcttgagcccaggagtttgagaccagcctggacaacacaggaaaaccctgtctctacaaaataactttttaaaaaaattatccaggcatggtggttcacacctgtggtcaggaggctgaggtgggaggatagtttgagtgcaggaggtcgaggctgcagtgagccatgattgagccactgcattctagcttgggcaacagagcgagaccctgtctcaaaaaatacatatatgtttatgaatattggaacatttaaaaagcagtaaatatactatgaagtacaattgaattttaatttcagaatattatatgcacacacatatactgtcagcaacaaagaaaaaaactggatagaaaattataacactgttattaattaaaattgttatacaaaatttgagaacaacttgggggttataagaacatgaaaagctgtggtttgcaaccttcatagggtcccaaagcaagatggaaacatcccaatgggaggttaacacttgacaatcttataacaaggtctatatatcaaacttattatctatccatctagctagctagctagctaacttaccttctatccatctgtccagctattatgtatattcatgaaactcatttttaaaacatgggagataatggctctaaatttcaaagaaatgtttacaccttgccaggaaggttttcttttcccaagtcagggagtgaaagatgtctgctaattcattcgtgaacttatttacctattttttccacaagtatttattaagaacctgcccatcagccaggtaatcaggaatcctaagattaaattattagagtatttttcattgttcaagttttctcttttcagtcatattatgtgtgtgcctcctctgagcacaagagatcaagggaaactacttacaatcttgatttataataagtgcggtttatctggaagtagtattgaagttttcttacaattgagcattttttctagaagggtgatggtactgcattggtaagactatctaaacctgtgctgtcagcacagtagccactaaccacatgtggctatttaaatttaagtaaaaattcagtttctctataactgtagccacacttcaattgctgaatacccagatgtggccagtggctgtcatactgaacagtagagatataggacatttatgtcatcacagaaagttctcttggacaatgctggtctaaacctaattgctgagaacacttgtgtataaaaaggcacttttcacattttttctcttcattgcttaagaattcagaagtttgctgatagtcaactactttcttttattcctcctttccctaagctcttgctcctagctctcgaagcaataagcttttcagaatttcattatttgtcagcaccggctcgagagagcaggcatcaaagggccaacattacacacttatgtatgtttatataaatttggttaaatattaatttgaaatggttgtaaatgagatttcaggtttgcaacagcaggaaaaaagtctgtataacttcgctgtaaacatggtcattggcgttaagttgttaaactgtaactaatctggcatctttgttacgtagtcaagttccactgggttttgctgtgtagcatgcgattccaaaaatctcagtgatttttaacaagaaatattgctcactcccatagatagaaggtgaaatgatctcattcctaatttgcatttgagtagcaacctaagtactaaatcacaacccaggaattttccaaagttccttacaagtactttgaactggatctttccttagaaaaatgtgtagaaaaggaaaatacataatgactggttattattctactttctttgtgtttagaggcagcattaattttcaagtagaaattatatatatatttttaatgtgaagccaatctggaaaagctgcatgctgtataattctaaccatatgacattctggaaaaggcaaaactatagagtcagtaaaaggatcagtggttgccaggagttgaggggagcaggagatgaatagggagagcacagaggatttttagggcagtgaaatcgttctgtgtggtactgtgatgggggatccctgtcacgatccattcgtcaatatccatacaatgtacaacaccaagagtgaacgctggtgtaaactgtggactttgggtgataatcatgtgtcatgagggtcatcagttctagccagcgtaccactctggtgagagatgttggtaatgggggatgctgggcatgggtagggacggggaatacatggggaatctctgtacctttagctcatattgctgtgaacctaaaactcttcttaaaactaaaattttaaaattaatgacaataaatgaatttaaaaataaatgaattaaaaaatctattttaaaattaatggcaataaatgaatgagtaaagcatgattaatacatatactaccacccagatcaaaagaatagaaccttgccaccccaacttcatatacttcttcctttttgcaactctccgcaccttgagaggtaaaccagaatcctgactttcgtgataaaatttcttttctttataattgtatgatctatgtgtacatttctaaagcaatataatttagttttcctggtttggaactttatataagaggaatcatgacatacatactctttcgtatcttgattcttttgttaaaatttcatttttgacactctcattcatgtcttttagtgttggtgagcatttctgtaaattttggctctaactagaacattataccatctttaagaggagagctcagatcaatgcatgctactgtgcaatgggaagagttggggcaggaggaaaaatatgaagaaaatgttaaccagtgtatttgatttgttttaaaatacatttattacttctgtaatttttgcaagtgtataattttcctaggttctaatgcagtatatagaaaagacatttagggccgggtgcagtggctcacgcctgtaatcccagcactttgggaggccgaggcaggcggatcacaaggtcaagagattgagaccatcctggccaagatggtgaaaccccatctttactaaaaatacaaaaattagctgggcgtggtggcatgtgcctgtagtcccagctacttgggaggctgaggcaggagaatcgcttgaaccaggaggcagaggttgcagtgagccgagatcgtgccactgcattccagcctggcaacagagcgagactccgtctcaaaaaaaaaaaaaaaaaagtaggaagtaatgctgataacttgaacacaaacactttcgtattttcatttcaggtttaaagtattcatatatcataatttaactcactagcagagtgtacttaccctgcagtcagacaatttcctctctctttaaggaaaaagtataatctaatctggtaggggatttttcttttatttttaacttaacaccgtgaaaaatcaaaacactgtccttgagaaggcataatttttgaaatatgcaaatttaaacggtatcttccttttaagttgtgtaaaaacaagacttttgcctaagtgtaagaccagaattttgcaaaattctggacctgcctctctggcctgcctctctccggttttgtgtagggcagcaggaggcctggcaacgtgaatgtctccaaatcctacttctgctctaaactgagattttgtggtttcttttttttttttttttttcttgaggcagagtcttgctctgtcacccaggctggaatgcaatggcgtaatctcagctcactgcaaccaccacctcccgggttcaagccattctcctgcctcagcctccccagtacctgggactacaggcatgtgccaccatgcctggctaatttttgtacctttagtagagatgggatttcaccatattgtccaggctggtttcaaactcctgacctcatgatctgcccacctcagtctcccaaagtgctgggattacaggcctgagccaccatgcctggcatctttttttttttaatgttagaatttaaaccatctggaatttatattgtcatctaacatgaggtacagattgaaatttatttttccctgcagttcattgaccaatctatgctttctcactgatttgaaatggcacctttatcattctcgaaattattcatgcttatggctctttctgatgttctgttctatgctgttgtcctctatgtcttcactttagccagtgtcatgctgttttaattattgtacctttaaaatctgtcagcatctgctagcagagatactagcatgcatacacacacactgagtattcctctcttttattactgtttattatcagataaacttttgcatatatatgttaatttcagaaaagtattccattgtgattttgagattgatttaaaattaaaatttgattttgtggagatttgacatctttagatcactgactcttaccacccatgaaaatgactctctctccattaattctaaccccttcaataaagttttgccatagtcttcatatagactttgtatattcttattccatatccctatgttataacaggcatcagacctatcatttgacaccaacagctggcatccaagaccacaggaatgatgcccaaagcagtctacacccactccccactagggcccaggaggaagtgtgtttgcagccctgacctaaatccacttgtacctttctctcctctgcacagtgacctctgcctggccaaagccccatggaatgccctaatcacatgtccctctgcagaatagtcctttctccaaaatgatccctcttttattccaccaccaccataagtcaatctctagtttcccctctgggaccctgtattactctgttttcacactgctataaagaactgcccaggactgggtaatttataaaggaaagaggtttaattgactcagtactgcatggctggggaggcctcaggaaacttacaatcatggtggaaggcaaaggggaagcaagtaccttcttcacaaggcagcaggagggagaaaaaagcgcaggaggaactaccacacacttataaagccatcagatctggtgagaactcactatcacaagaacagcatgggggaaacgggccccatgattcaattacctccacctggtctctcccttgacacgtaaggattatggggattacaattcaagatgcgattttgggtggcgacacagccaaaccatatcagatcctgatagattttaagcttggtgttgattatctgattgaaataattctgaagattgttttaagctcctagacaacaaactatgaacaaagctgccttctagagaacaggatcaggaggttgggggaaggatactttagatatttccttactgttttgtgtcactttatgtctccaaataagtacttcttttataacataaaatcttctaaaaaaaagcaaacaaacaaaaaaaactgctttccccctcccaagataagttgttttaaaggaggaactattcaaatgaatacttagtactgaacagtcattcctatcttttgggaccaaggaactcttcaaaaatttgatgaaaatggtagacactttcctctgaagaatgcacatatgtacatagctacaattttgtgtaggatttcagaaaataaaaggctgctgccctcagcagagattcgtacctctgtataattggtttctggtgaggtacacatcactggatcaagattcctgtgggggcttctggagtccccagcttccttgtcacacctcatgtcgcatcacggagcagaggctgactcccaaaagttactcagcccctttttagaataagaatagcctcagaacagggttcctttaaaaaaaaataggagagtaattttacatgacacctaatgagttgaggaaaacagaactaacctagggaatattgccaagtaaaagaagtttgtctttactccgcagcctcccgtgtcccccactctgagtctctctatgactcttctacttcctctcgcctacccaaaatcttggcatccttaaggtgcacctgagtcctctccactccaagaagctttccttcgttcctcaactcaagcctcccactcgtcaaactttcccacaaaagtaacccaaacagaagagagaggtgagcctgtatagcctgggaactctagggacaaagttcaaagtagtcttcgcaatcaaggaattccactccaaaacacatctgtgtgggaggatgctgggtgtgtgaatccagcagataaattctatttaatcttattctttttttttctttttttgttttttttttgagatggagtctcactctgtcacccaggctagagtgcagtggtgcgatcttggctcagggcaacctctgcctcccgggttcaagcgattcttctacctcagcctcccaagtagctgagattacaggcgcaggccaccacgcctggctaatttttgtatttttagtagagacagggtctcaccatgttggccaagctggtctcaaactcctgacctcaaatgatccacacacctcggcctcccaaagtgctgggattacaggagtggggcgtatttttaaatgtgcgtaatacatgtatgtaatttacaagtaaatatacctacatattttatatatgtgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatatgtgtgcatatatatacatatatgtgtgcatatatatcacatatatatacacacacatacatatcacagtaaaaatatagaatggagaccagtgctttacctgaatactagttaaattacttaactctgctttcctgctccctcccacctcaccccaaatcacattgcctcagaaagaagggtagagagtatttaagtgagaccaactgagtttgaatcctggctctgcgactcactagcatgagatgacttaacccttctttaagcatcggtttccccatctgtaaaaagtgggtgacaaagtggggttgctggaaggatgtaatgggtaaagtgatcaatcaacattggacatgtcgaacatcataaagatacgcacaggaagagcacagcccatctttccctcccacagtcgttatctcctaccctgtggttctttctctgcactgggtgaaatcccaagagacctcatagctttctagtagctttcagatagaagtcttcccatcagaaacagatcattctcagtatagtaattaaaatcttgtctggttcagtcatctaaacttgggtctaggcctaggtgaaacctctccccaccctcacactattccaggaaggccacgttctgcctagggtatccaccggggaggcacagggttggcctcctctctggctgtccccagctttctaggggctgtttctcctctaggtgcagtggcacggctcctcccgtcctcagcctcgacggaaccccttttccaggggttctccaggcccgctcctccagctgccctctcagttaggttccctccccctgcaggatggtcctgtggatggagttcctgtgatagtgacccggtaggctccttccaggcccacctggcctgaggcgaaactcctgcatgccctatggcctgtcctcgggcagtgagagtgtcaccctctcccacctgcctgaaattccaagggacttactcaggccctctaaggggtcctcttgaggccctcccacttcactgaaggtgaggggaaagcaatcctctcctcccccagggtggaagacacaacacacatgcgcacacgcatgcgcgcgcacacacatagacatacgcgcagcgcacagacgtacgtgcacacgcacacacacatgcacgcacacacacacgcacacacacacacacacacacacacacacacacccctctggctgcctcaacccctctttcactagctagaggggttatcagtggccaggctagcagaactgatttctggctctgtggacataacctacacgtccgtcttttagcctctcggtatggtggcttagccctttccttcagtgggtagagtgttcagcatctgtcttactgctcacagcctgtggggaatcagccaaaagtgaggctgaaagaattgccatgtaatatctttaaccctgtgcttagtaaatagtaaatgctcaatgaatattagcgatcattagtagtagtggtagtcatagtagtgtgttttcttatggtcttactctgtttgggctgctgaaaccagccattatagactgggtggcttataagtaatagaaatgtatttctgctagttctggaggctgggaagtcccagatctaagcaccagcagattcagtgtttggtgagggttggcttcctgcttcatagaaggctggcctctcactgtgtgctcatgcggtggaagggaccgggagctctggggctaaaactctcatccatgagagttccacccttgtgacctaatcacctcccaaaggtcccacctcctaaaaccatcacgccagcaattaggatttcaacataagaattatagggacacacaaacattcagtctttagcaagatctcacaatgtctgcactatatatagctttaccaccatttgaaaagtacaattcctgtcagtgtttttggtaacccactgttgtgaaatcaatttaaaggttcttgagtggcaatttgaaaatgaaatcgaagagtagaaaaaagaatagaaaaatcaagaatgcataataggtgttgtttggaaaatttgtgatttaagataattaagtatatatatgttgccattttaaatgtatgtattatattggttgctgtcaacaaaatatgaacgctacagcatctgaggttttccagttgtccaccacaatgattaacatgtgagaatcttcctgaaaaagttcaatgattaacatgtgaaaatcttcctgagaaaagttcctatgtggatgagctctaaggaatgaatatagaatgttctattccccacaggtctctgcagtgaatacagttaattgggagctaatcatgaactgctttatatttttccctaattgtctttttttttttttttgagacagggccttgctttatcacccaggctggggtgcagttgtgtgattatagctcactgccacctcacatttctgtgctcaacagaattctcccccctcaaactcccccgtagctgtgaccacaggcaagcaccaccacatctggctattttttgtacttatttttttttatgtttaatgtttgtgggtacatagtaggtgtatatatttatagggtatatgagatgttttgatacaggcatgcaatgtgaaataatcacaatgtgaaatcatggagaatggggtacccgtcccctgaatcatttatcctttgtgttacaaacaatccaattacatgcttttagttatttttaaatgtacaattaagttcctattgactatagtcacccttttgtgcagtcaaatactgggtcttattcattcttctatttttttgtacccatcaaccaccctcacctcccaccttgccccccactgtccttcccagctctaactaatttttttagtatttatggagacagggtctgccatcttgcccaggctggcctaattgtttcttgagaataattgttgtatcccccaaacataaggaggagagaagtcgttttacatttctgatgatgctttctcagagcccagtgcaaaggagaacaccagtcactgctggcgggtgtctgacattcagtttggctgtttcacttgtcctgtgatagctaactgatcttgctgtctcatcatgcattatttgcacgattggcagttattaaggtacaccaggctagaagggagtccatctggctctccgctgggccctgtactcttggcccaggatctgaaccatagcctatgcttaataaatatttgtggaatgagtaagaggttccatctatgagatgaaaaccactggtggctgataagtattcaaatggcatatcttctgtaaatgttacagaacgtcaatgccattaggtgcttgaagagaagtttaaaaatattcatatgcaggaaatgagatcatagaatttctcataaaaatgcagtttgatcaaattgaggggatggatacccacttaccttttcatagtaatagtaaatttgttatagaaaacacattttaccttccttgtctcctaattcgaggtcatgtgaagcttagctagaaggagcaaagtacattttgttctgcctgaactgtctctagtgaatacagttaccctgggctttattatgaatacctggcctgttccacaaaagcaatgaatagtgcttcaaggaagaaattttacttgttttatttcccaagaaactcaccaaattgagttgtctctactttcctttcaaaactataactaagtacagtagtaatgtcaggtcacttatgattttgacctgtgccaatctttgaatatttgaacatttttatctcctgaaaaattacttggcttgagggagacacagttggatgagcaaagaaaaaaagaaacaatcaaatgattttctgatgctttcgaatgttcataggcttgctttgaaatccctctgtctatatcaccccatcctgtttttgacttctaatctcctttaccaaatactatgtagcaatattttgtgagtcatccaaaagttgagtatatttagaccaccgtgacaatcaaacagtataaacagaactactcatctgtctgttcatcatcatcccacgcagggagttaattcctaataaaggagtttatcagatcaccctcaattacatcactttgggataatttcatacccaaggaaatttgaggcatttttgccttggaaaagagcaggtgccttacgaaaaagaaactagatttgtgagaactgggcttatgtttcaaatttatattctcaactttactctgaagagatggcttggaagaagtgacggtaacacagaattgccagtttgcttggcaaggtcaaactattccatatgttaccttgcaagaaaaatatgttaatttaaaaaatatcagagaccaaatgagaagttgaacacacagctgatttagctcagatttttgtttgttgttataccgattgccatattagctccctcttctaccacctcaaccccacccccaccaccatacagctgctcgcttgctcgttacaaagcatatttccccctgtatattaatgtcatattcagcaaatcaggaaattttgcaacttcccttctgatcctaatctggctatttttcttgagttcagtgtcatcaaatcagaaccagacacttttgttaagggtatcacattcaaaattgcacacaaacaagccccaccttatttttatgaaaagtctgcccagttacccgctttgtcccgacactaatagagccaaggctcagggtttgcaatgtaaggaaatgtggagtacattccagcatgctttctatgatgagtagatgtttgatagtacacctcacttatctgtgcctccccagttggggagcctttttcttatctaaaaggccttgccatatcaaaggtaaggatactgtttggtaaattcctctaaataagaatgccactaggagaaatttaaattatatgtaaaggaataaaagttgaaaaataaagggttttttgtttgtttgttttgaaaagttggtttcaaacttaaaaatttgcaagtgtcattttctgaattgtggaaatagagtaaaatttatcatttcttataaagttttaacattagaaaaaaagcttcttatgactaaaactaaggcatttggtaaaattttcttaccgcttctactataatatctatttctctttagatagataaagatacagatttgcagtaacattggaaagtaagtgaaaaacacagaggaaattaaaactttactataacctacctgtgtagaaataatcactgttaattttaatgcataaatataaatttttaaaaagtggaaccgtattgtaaactgatttttatcctactaaaacaaacattaagtatctgctgaaatgttttaaattttttcaaaatatatgtattttctgactcatttgctataatacttaactcattgctgcccatgtaaacttgaactgtctcatttgttaaagcgtgagagaattcatagttaattctttgtacagctaaattgttcagtaggaaatgcagaaagaagtgttaaaagaaaatcttcagccaaatttaatttaatttaaaagagtttaattgagcaatgaacgaatcatgaatcgggcagcccgcagaatcacagcagattcagagagactccgggggtgccttgtggtcagaacaaatttatagacaaaaaataataataataaagtgacgtacaggaatcagaagtgaagtacagaaacagctggattggttacaggtcagtgtttgccttatttgtacacagtttgaatacttggcagtgtgtgagtggttgaggtatggctgctgggattggccaagactcaaccactgttacagatgcaaacttttaggctgtcaatcttgtttacctattaagttaggttgcaattcatccacaaggactcaaatacagaagtatagagtccttctcaggccatatttagtttgttttaacagacgtagaagagaaaacccttgttctttgctttgtccagggtagtcagctgattggaaaggtaaccgaagtctctcaacatcaaaacatttctaatgcaaattctttaagtcgtactgttcctactcaccttgaacttatgagcaaatcccttatcaattgtgctaccttttattcagataatgaatttgggaatagggtttggaattcaagtcccatagcttagaaaagattgagtacctggcaattcagtatagttgtggattgcaataattcctgtgcttgttaagtaaccaagatttttgtgtgtgtgcgaaaagcatgtgtaaaataattgacaatcagcacttctgttggatagatgggttcctgaaagagcatatgtgaataaattttggtgtatctgatgctactttcctgttaagctactatggaaattatcttaaacattatattcttttccctgaggcagaaaatgtaaataatacattcccacaggtaacaactataactatttcctatgtatgttttcaaaaatggttcatgcacttacgagcatttgtgtactgtatgtattcatgcacttatatagggtaccctaagagatgatttttacatgagggcctatcacacttacatattcttacttcttaagggaattcaaaggtagatactttgttgtccctaaaaaaggtacatgaagatctatttccctcttatcagaggcaggcttcatatctgtagtaaaggagaaaaatatagaacatttgctttaaaagttcctctttttataaataatacttgctaacttttatgcttctgttttataaggaatttcttccttgtgctatatacaaaagttgcttccaggtggattaaacaaggcataaaaagataataaaggaaaaatttgataagtagttcaaataaaaaaattctgatcattaaaaggcaccctaaggagtattaaaagacaagtcatagggtggaaagtatttgcaacttatgtagacaacactggaccagaatatgtgggttacaaatggaataaataaagaactcgtacaaatcaatttttaaaagctaccaggcaataaaaaataaataagtgaaaagtagaacagccacttcaccaaagagagaattcaaatggctaataaacatgaaaagatgttcaatctcattaagtaataagaaaaatatgaattaaaacaacagagataccattacacacccatttaattggcaaaaatttaagcctgataataccaagttctggcaaggatgtgaagtaacaggatatttcatatactgccagtgggagtataaattgttaaaaaccacgttggaaaagagtttggcataatttgataaactcaaagttatgcaaactctatgacctagcaaacttcactcttgagtatatttctcaaagaaatgcttacatacgtgcacccagagacacgtaacccaaatgtacatagcagccctgctcataataaccccaaactggaaatattccagaagtccatcaacagtagaacaagtaaggaaattgtggtagagtaattcaattaaatattattcagcaattaaaataaatgaactatagctagacgaaacaacatgataaatcttacacacataatatagaacaaaagcatacagacaaaaagaatacagtcagattccactgatataaagctgaaaaaggagggagaaaccaagtaccttgctcagagatgcataactgaatagtaaagttagaaagaaaatcaaggaaatgataactctgcaagtcaggattgcggttaccctgggaaaacccaggggtatgagggggaggcacacacaggaatcttctgttctatttttttacctgagcagtggttacaatctgggtgtttgctctataactctttgttaaagtgtaaaatttttttgtttgtttgtttgtctgagatggagtctcactctcttgcccaggctggagtgcagtggcacgatcttggctcactgcaacctctgcctcccgggttcaagcgattttcctgcctcagcctcctgagtagctgggattataggcgcatgccaccacacccagctaattttttgtatttttagtagagacagggtttcaccacgttagccaggatgggctcgatctcctgacctcgtgatctgcccgcctcggcctcccaaagtgctgggatcacaagcgtgagccaccacgcccagcctgtaaatatttttttaaaagacgtgcagatagaaattatcttaaataattgcttacaagacaaagagaacgacctgcccccaagtcccccagataaagtaggatatcactaagaatccacacccaagtaaagtaattaaaggggttaagatgtctctccttttgtgattaacaccccgtcgtgcttgcagaggcaccgctgggtgtcagggaacctgcctgctgctcacctgaacaccccataaataacaccagctctaggacatggtccatgtgaacaaatgaagaatctctccttcagccagagggtgagagtggcataggtaacaactagataatgcttggctctgcctttttcttattgatttgtaagagttctaattgcaagataggctgagaaaagtagtctagccatgttccatgaagaagagaacatggaattaggttagtagctagcagcctcagccacaataactttattttgtttgtgcactcatcatttaagaagtatgtgagagcctacaaaattggggagttacttctcgggaatgctccattgagaaaaactgctgcctcttttatctgtgtagtcaatatcatggcctaaattctagaatcttctcacatagccagagtttagtgatcaagcaccacaaaccaagagatattacataacaataggatcgctcaaacaaatctacgtgaactaggaaactgctttttggctcactcagaggtacaaactttacacccactgaaaattgtcccaggattggataaagaaaatgtggtacctatacaccatggaatactatgcagccataaaaaagaaatcacatcctttacagcaacatggatggaactggaggtcataatcctaagtgaattaacacaagaatggaaaatcaaatgttgcatgttctcactttcaagtggaagctaaacattgagcacacatggacataaacatgggaaaaatagacactgcagacgactagagttggtgcggggaggacatgggttgaaaaaatatttttcaaatgtaactactgtttgataaaaaggaactatgctaaatgaccacttctcccagctaaaggcagaccatctacattacatttttttttttttaagacggagtttcactcttgttgcccaggctggagtgcaatggcaccatgtcggctcaccgcaatctctgcctcctgggttcaagcgattctcctgcctcagcctcctgagtagctgagattacaggcatgtgccaccatacccggctaattttatagtagagtagtagagacggggtttctccatgttgctgaggctggtctcgaacccccgacctcaggtgattcacccaccttggcctcccaaagtgctgggattacaggtgtaagccactgtgcccgggctacattacatttttactcagttaagagcaaacaataataggtgaatagcagcctgattctgtatgttaaaaatgattggtgattgaatctcaaatgtattagtccgttctcacactgctataaagaactacctgagactgggtaatttatgaagaagagaggtttaattgactcacagttccacaggctgtacaggaagcatggctgcgtggctgggaggcctcgggaatcatacagtcgtggtggaagtgtgaaggggaagcaagcacatcttaccatggtggagttggagagagagagagcaaagggggaagtgccacacactcttaaacaaccagatcttgtgagaagtcactcactatcatgagaacagcaaggaggatacgtacttgcatatatactccctgaatctaaaataaaagttgaaaaaaattttaaaaagaaaattgttgggaggctgaggtgagaggattgcttgagcccaggaactcgagaccagcctgggcaacatagaaagaccctgtctctaccaataatcaaaaaaattagctgggctttatggcgcacgcctgcagtctcagctacttgggaggctgacatgggaagatggactgagcctgggattctgaggctgcagtgagctacgatggcgtactgcactccagcctgggtgatagagtgagaccctgtctcaaaaaaaaaaaaaagaaaaaaggaaaattgtccaaggaatttaaaaattttcattttggctctctcatgcgcagtaaccgtgagggtttaaaggacagtgccagggccccatgttgttagagagcactctgttgtctttggcatgggagaggacttcagtgcaaaacggtgtatgaagtgtgttgtcagcagaagctaatttacaccctgtgctggacggagggttgcttgtttggagttgtttttcctgtggctaaaggattcctgggaatgctgttcaggcatgtctctgctggtggtatgctgtcatccttttcttttccatttacagtgtagagctgttacagttgtaaacaggcctggctttttacattgttactcactggtgtgggaacaatgtatgttaatgacataagtactgcccttgagagtactgcccaaaacagccccaggttgaaaatgtatcctcacagatttaatttttcttataaaagaaagaggtatgttccttctgtgtagagcgaactagaaatatattaaccctgcaactaacatgcagcacttcacaactcattagtgaggcccctgggatatggctccatatatttgcccacaagttggtataggccagaaaccagctgctttttcacctacgtggtgagagccagaggccagtcaaggaacaaggaactataggagaggaactacaaggagaatcttcagattttcaagcctattattgttcaatacatagtagtttaaaaaactttgacagttgtacttaaagtcccttctcatcctatgagtctctgcctctgccagtatgtgatgtttctggctcatggtgatgacaaattcggatgcaaaagtaaacaaataggcccccatcagcccatcggggcagcagccctaggcagtgacagttaaacagttgcaaagacctattttcagaggcatgtacccacacctgacctactattaagtaagcatggaaattagtatttctgttggctttaattaagtaaatattatagtttgatccacaacaccaaatctttgtcaatgtcctaaaagaaattgttcttttcaccacaagagttatgtattcagagtaaaaatgggtagatgtatattttctctgtgaaggaaaagaactggaaggtgcttattttattccaagagttcccaaagcgaggccgggtgtggtggctcacacctgtaatcccaacagtttgggaggccaaggcgggcagatcacgaggtcaggagttcaagaccagcctggccaacatggtgaaaccccatctctactaaaaatacaaaaattagctgggcttggtgtcaggtgcctataatccagctactcaggaggccgagacaggagaatcgtttaaacccgggagacggaggttgcagtgagccgagattgcgccattacatctcagcctgggtggcagggtgaaactctaaagaaaaaaaaaaagagttcccaaagtgagaccattactcaaaaatttgagatgggaggctaaattgcccctgctgtgtatttagagggttagtattgaataggtcaacaagcatttcctaagtctctaggctgaatttctaatacggtttcttagtaaccattctcttaaagaatgtgagatttgaggtaagctttgctttaagggagggacagatgtgaaccctaatactggttagaaggacataagagaagagagaaagtaaaactatttaaggaatttttttctctcatttaaggcccaaagcagcctttccttttctcggtccaatccgatgcttaaacttgcctgaatttcctctggggttaagttcaaactaattttcactgttctaagcatgcagggctcttgcacaacttcatgcctctgtgcgtgtgtttccaccagttggaatgccctttctcccacccacccctaaactcgtacatgcttatccttgcagagacctcctttgtaaaccaagaagcccccgactcccctgttacagaggtaattgctttggccttacctgttttacctcctggtaagttacagcacttagcaccttgcaattagaggtcatagatttccctgcttctctagaatgtgagattcttaaaggcagggattttatctcatttattagatttgtatcccatgtacctgacctagtatctagcacaacttagtagatatcaattaatgttcattgtatagtcctttgatgatgcggtttggccctgtgtccctacccaaatctcatatcaaattgtaatcctgatgggaggtaattgaatcatgggggcggacgttccctttgctattctcatgatagtgagtgagttctcacaagatctagttgtgtattttattatttatttattttttgagttggagtttcactctgtcacccaggctggaatgcaatggtgcaatctcagctcactgcaacctctgcctcctggttcaagtgattttcctgcctcatcagcctctcaagtagctgggattacaggcttgtgccaccacgcctggctaattttgtatttttagtagagacagggtttcaccacattggtcaggctggtctcaaactcctgacttcagatgatctgcccacctccgtctcccaaagtgctgggattactggtgtgagccagtgagcccagccaagatctcgttgtttaaaagtgtgtggcacttccccctttgctctctttctctctccaactccaccaaggtaagacgtgcttgcttccccttcacccttccaccatgactgtaagtttcccaaggcctcccagccatgcagccgtgcttcctgtacagcctgtggaactctgagtcaattaaacctctcttcttcatacattacccagtctcagatagttctttatagcagtgtgagaacagactaatacatttgagattcaatcacctatcatttttaacatacagaatcaggctgctattcacttattattgtttgctcttaactgagtaaaaatgtaacgtagatggtctgccttcagctgggagaagcggtcgtttagcatagatcctttttatcaagcagtagttacatttgcagagtactttttaaaagcaaaatatttgttcttattttcctggagtttacaacctatttgggctgacaagatgtatagagatgtgtgtgtatatatatatacacatatatgtgtataaacatgtatatgcacacacatttacacacatacatatatgtagtttcacttattctttcaacaaatgcatatggagtgctaaacacgtgcccggagctgtgctgggtgctggcacccgagatgcggactccacggtgcctaaccacaacacttcaatacccagggcgatgagagccagaaacaaaataagtaagataacttcttggtaagcaggaggaaggggaaaagattagaggagggtaaagaaagcaacctaagtaaaagttagaaggtacaaatgggcatggaatttgcaggagtggtgaggagattcatgagactaaaggctttagggagaaatttgggggccaataaaaagctatgagtacacacacacacgcacacacacacacacacacacacagtgaatgatactcagtttaacctaattcaacaagcacttcctgattcctgactgtatagaaagtactgtgcaacatattgagactcattcagagatgtttttctttctttcttttttatgtttttgagacggagtttcactcttgttgcccagactggagtgcaatggcgcgatctgggctcactgcgacctccgcctcgtgggttcgtgcgattctactgcctcggcctcctgaatagctgagattacaggcaagcgccaccatgcctggctaattttgtatttttaatagagacatggtttctccatgttggtcaggctggtctcaaactcctgacctcaggtgatccgcccaccttggcctcccaaagtgctgtgattacaggcgtgagccaccaagcctggcctcgttttttcctttgagatagagtttcactctcgttgcccaggctggagtacaatggtgcaatctcagctcactgcaacttctgcctggcaggttcaagtgattctcctgcctcagcctccagagtaactgggattacaggcatgcgccaccatgcccagctaatttttgtatttttagtagagacagggtttcaccatgttggtcaagctggtctcgaacttctgacctcaggtgatccatcagcatcagcttcccaatgtgctgggattacaggtgtgagccactgtgcctggcccagagattttgttttaagagaagatttagagtgtcaagtgctagcagttcagcgggaaaaacaaaacatatctcatatgtgtaatataagtactacatatcccagtaagcccatgaaaatataagaggaaaatataataatatatatgagaatataagggaaaatatattaatatatataagaatataaggggggccaggcacagtggctcatgcctgtaatcccagcaatttgggaggctgaggtgggcggatcacaaggtcaggagatcgagaccatcctggctaacatggtgaaaccctgtctctactaaaaatacaaaaaattagccaggcatggtgacgtgtacctgtagtcccagctactcaagaggctgaggcaggagaattgcttgaacccgggaggcagaggttgcagtgagccgagattgcaccactgcattccagcctgggcaacagagcgagactccatctcaaaaaaacaaaacaaaacaaaaaaacatatttgtgttgaaaattgagtagatacataagaggaagcacatccagagaagcttaacataaagcattgtattagtctgttttcacattgctgataaagacatacctgaagactgggcaatttacaaaagagatttattggacttacagttccacatgtctggagaggcctcacaatcatggcagaaggtgaaaggcacatctcacatggctgcactgttagagagcatgagagccgatggaaacgagtttcccctcatcaaaccatcagatctcatgagacttattcactactacaataacagtatggaggaaactgcccccatgattcaattatctcccaccggatccctcccacaacatgtgggaattatgggagtacagttcaagatgagatttgggtggggacacagccaaaccatatcaagtatataagcaggccagggattttaagcatttgcagtgggtggactaccatcttttgaaccaggagatgaaaaaatatcctcttatttatttaaacacagtgtcatttttatataccctatgtctaatacatccaatattggaagcatttgtgggtgagtttcttttgctgctgtttctcattcactttacagggaatggtctatgactagcctcttcacctcaggccagccttgggttttgtcttctgtctcttgttttcatgaggccatgaaaactgaagctcattctctagcttctgagaaattccctcagggtaaaacagctttaagtgctctgctttccactctgtgttcccacttttatttaaattttcccttataaatccttcttcttcttcttcttcttctttttttttttggagagacagggtctcaccctgttgcccaggctggagggcaatggttggaaagatatttctggaactcagaagagaggttaagactaaagacatgttttagttatccacctagagagaaacataaggccataagaaagaagaaatgctccagggaaagtcttagactgagaagagaggagggctaaagacagactctggaaaatgtctgtattcaagaaccagacgtggggctgggcactgtggctcatgcctgtaatcccaacactttggaaggccaaggtgggtggatcacttgaggtccagaagttctagaccagcctggtcaacatggtgaagccccatctctactaaaaatacaaaaattatccagacgtggtagcaggtgcctgtaatcctagcttcttgggagactgaggcatgagaactgcttgaacccaggaggtagaagttgcagtgagctgagattgtgccactgcactccagcctgggtgacagagagagactctgtctcaaaaaaaaaaagaaaaaaaaatcagacatggggcaaaatggagctgatgaacacagctaagaaggagtagtcagggaagtgttaatagaaggagggtggagagaacaatgtgggggcaaggagtggaggtcagcctctgaggaagacagggctcattctaaagattaacattctgaagatcttaagggggagcactaggaagaggaattagatttggtgtctcggtggctgctgaggactttctcaggcattttggtataatttgagaggaagaagcaagatcgtaagaggttgagaggaggacgggaaaagagagaagaacaggaaaagagcaagaatgggaaaagagcatatatagaccatgtttttaaaacatttggtgatgaatggaaagagaaagaatgattcttgatcaccaagccaggtcattgaaagatgttcttagcataagagaaatttgtaaggagcccattgacaagaggagatttgaggattgaaaattcaagataggctgagcatggtggctcatgcctgtaatcccagcactttgggaggccaaggctggtggatcacctgaggtcaggagttcgagaccagcctggccaacatggtgaaaccccgtctctactaaaactacaaaaaattagccaagcatggtggcaggcacctgtaatcccagctactcaggaggctgaagcaggagaaggtggtggtggttgcagtgagccgagatcgcaccattgcactccagcctgggcaacaagagcaaaactctgtctcaaaaaaaaaaaaaagaaggccgggcgtggtggctcacgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaagaaaaaaaaagaagaagaagaagaaaattcaggatagccaaagtatgatagttagatgtggaccctggaggagtctggaaggagtgggaccatgaccacaagttggggcttgggtagtatttcaagggaatggaaatacttcccctccaaagtcagaggttaaggacaaaaaaattgagtgctcacaggtaagctgacggagatctcctagatagaacagatgttgaaagacatgagatttggtgacttaaggagaatgggagagaacagcagcatttattacagtgaatcttccaaggaatcaactttgcacccaaaaaactaataagattgtggacaaccgaaagagttagaattgcctggattcgtggttcagccaacatgtaaagtgacatcccaaacatattcttcaggatccactctcagagcgtcttggtgtttttccagtactgccgtcatacctgtgttccctttccttttgttctctactagcacctggctgttttagagtggaattgtgtgtgtgtctgcttggaaggaaagattaatatcttgattctcttttgtcatgagtagataaggaagtgtatttttaatcagtaggtattcaaaaaatgtttactgctggccaggcatgatggcacatgcctgtaatgccagcactttgggaagccaagctgggaggatctcttgagtccaggagtatgagaccaacctggaaaatatagtgagacctcatctacaaaaattgtttaaaaaattagccgggcatagtggcatgtgcctgtagtccccgctactcaagagactgagacaggaggatcacttgagctcagcaagtagaggttgcagtgagccataatcgcaatcataccactgcataacagcctgagtgacagagcaagaccctgtctctctttctctctctctttctctctctctctctctctcacacacacacacacacacacacacacacacacatttattgaattgagagaaacaggaaattttggatattatggtggcttctgttcagcgttggatattaggggtgtcaaatggaagtataaaaaccatatcaaaatattgggtgaaggtgacagtcctaccctcgcctgtttcctgaaggtctgttgagtgagataagaaaggtggttgctatggagctgctttgggacttttgtttgacaatatagaaaaggccaaaagtataaagcaggacatcaaggaaaaaacgtatttccataaaagaagagaacatgaggtgagagtggttatgatgactgatgagaaacatattaataaatggctttataaaactctccttattctcttagattggcaagacaaagactagacttttgtgttagggaaactaaccacaaattgtggcctggagccaattaggattgttcccaacccccttgtccaagcttggcctccttagaaatacggcagtacagacgattagtaaggggtatctaagaatctctgctttctgtttattgcttcatgaaggtggttagcttaatttggtttgtcggggcactgtatacacagaaacatctcccttgggcctcttatgggtaattacagaatctgtcaaatagggctgatctgcctggagagacaaggagcacagcatctatggaacagggagttgggcagaaagtttagcaaagaagcctccaggatggcaatctgagtcatggccagatgtcaggcgagaatgcgtttccagcacatcgctgtgatgatttaagttacacactctctcctgcttgctagtttgcaaagattttccatctcaggagatatttctgcagctcttcctaagagtgaagacattctgagcatgttacattcacaatcaggcctccttgataagtattgagattcagagtcaaagttgggaaagcagccttcaattgtactcattcatgtgaagttttataatgaagagtgtatgtgtgtctctttttgcacttaaacaaaggtagggaagttgatggcaactattttccttctttccccatcaaaacctggagtataaatgtgggcgtggaaattagagggaagcctaaaatttgtactggtccccagcccccgtgtagattcatcagcgagatcccaggctgtttgaaagaatgctgggcctggagctgagggacctccccagaggcaaattgatggttggaatgctgctgcagaagggctcagtgtccctgtggttctttaagtctggaatttttctttcttttgaaaaacgtacttttggggggggcggaaatgaatttgaatctattttctaccacatgtttaatgaccgaggtgatgtattttttcctcaaattattataactcccagtaaaaattcaagcctgtagaaggtaaggaggagattatatgatgaaagtattattgattttagtggaatcatggaatttaacatatcttctttacttccaagttagtgcttttcactctacatcatgcccaacactttcctaggtaaacaagggctataaaagaagggcttttaatgtatctcttcccctgctttggagcaaggcagttacagaacaacaacaacaacaacaaaaataacattatctgattgattggttgattggttggttgattttagagataaggtcttgctctgtcacccaggctggagtgcagtggtgtgatcgtggctcactgcagcctcaaactcctggactcaagcaatccccccacctcagcctcctcagtagctaggactgccggcacatgccaccacacccagctaatttttaaaaaatgttttagagttgggggtctcactgtgttgcccagactggtcttaaactcctggcctcaagtgaccctcctgcctcagcctcaccagtagctgggattacagatgtgagctgctgtatgattctgtctcgcataattggatatattttaaatggtaaacttgatctgtataatatttggacctccctcaaaaaacaaatcattcatgaagctttggaaaggctattataaccaaataatgtgtgcataaggaaccttctccccacatctctgagccccttttcattatggaacctcacagcatccctcaggatatccctgagcccaggggaagatgagagtgggaggaatttcagtgatgggaaatagaatcaagttaaagtaaactctgaattcgatagagacagtgtgggatgaagcaacaacaaaaaaatgtattaagacgctatcaataatacattttgccagcatttttgagacgttccaaaccagtctcagaaagtttgagactgatcccaagaaaacaatgagaaaggttgagtctaagcctaaaattttggctgaatttggaaattatcagtgtgaaggctacacaccaaaaatataagaaccaactgtcctgaaagtttgggagttaagatttggggaaattatttgaaatcatttcaatctaccaattcctgatttttttgcactaagaattgaaattctgaatcccttaatttatgtatcaaatatatctaccagcagtgcagggacaatgagggtggaaatgcattaactaatagattatatggactgccttaagcaactgtataatttctgttaggatgaaaccgaaccatgttgggaattctgatttaaaatgaggtctgtactttatagatgtggaaaataaggttcataggacgaaattacttcctcaaaagcgacataactgcgttgcagcaaaaacggcaggagagtgcaggtctctaagccaagtcttggactaggttcttgattccaacagttctccagtgatgcttctgaagacactgggctgaaagtgaacagtgaccctctttcccgaatgtctataattttctcaatttaaaatttttctcctaaaagacaatggctattttaatcttttctgtttgtttgtttgttttgagacacagtctcgctctgtcacccaggctgtagtgcagtgacgcgacctcggctcactgcaacctccacctcctgggttcaagcaattctcctgcctcagcctcccaagtagctgggattacagttgtgtaccaccatgccttgctaatttttgtatttttagtagagacggggtttcaccatgttggccaggctggtcttgaactcctgacctcaaatgatccacctgcctcggcctcccaaagcgctgggattataggcatgagccattgtgcccggcgaatattttaatcttttagtgacctctgccatttttcttttcaagaacaagatgaatgagcaaatgtaaacattttaaaattaacttggaagggctttgacagatttcatttctcatggacatatgcttgtgactgtttcaatattgcaggcatacactagcatcattttcttttagcagaattgcttggtgctcctgtaatagaatgaagtgtaatagtgtgcaaacattcacaacttccatgtgctctaaaacctaaacaagtttgaacccacaagtcactttgtaaggcacatccaggctcgttgagattctaactggtggaaatagttgaaagtatatttgtcacttacaccttgcctatatccaagaaggatttgagtcttcctccaacaagaatgcatccaagccagtctaaaactgtcctccataaaatagggaaatacactttgggaatttcataagctaaacactatttccacattggtcaccatggtgaacacaaatatgcaaaatcgactgaatggtaacaaggcagggagagaacgtgcttcctataggatttgatctgctgcttattctgatcaaagtggaaactataaaggttggttggagcggatagcccaatgcctgcccagtaacagggctgcaggaattaacacggtggacgagggaaggtacagaccattttcggtggctaaatgagaaataatactaagcgataggatatcctgtatgtttagattacttgcctctgaaaacgagctccaattctttttcagaacaagtattgggaacaaactgtggatatttaatcacttaagggtactttcttctgggaaaatcgctcactcttaatttttcagttgagttagacaagggctaattgcaagaggattaaaaccttgaaaactgctttgttcagcttattgtttcaggtttccctttggagtgtggatgatgtgtttatttgacataatgaataccaccatccgctttgttccgggaaccaaaaggctatgtgcttgcccaaggaatttctcagttgtttatatgtaaggaaacactgctctgtgttattggatgggaccattacagctctttcttaaatagggaatgcagagagccgtgctttcctcactcacatctgagcagagaaaccagaaaatagccttcagcactccaaatgcctgcttgttttcaacacaagagagcaaagggaacatttattgaaaatgtgtgttcttcgcttaggaacccagagctttactttgtgttattggcacatctacttagacctatgttatatgtgtatgtgtgtatatatatatatatatatatatattttttttaagtattagattggagtgcttggcatgaatcatagattagagaacattgacaactaaccagatagtgaactctgcctctatcagccaaatctaactgccaaaacactgaggaataaagtaaccactaattaagcagcctggagttttgtttttgggttttttttggtggtggttgtttttaatacataccctgccataggatgagggcaattgtgtgaaatacatgctttgcggtgacttccagtgatgcaacatagcagtctttttaaacagctgaaaactctctggtcctttatggtttccaaaaggtactccttaaatgggcataactgatgggggattggctagtgagctacagagaaggctgagtcagagtgacctgttggagctagccccgtgtgtgtgtgtgtgtgtgtgtgtgtgtgtgtgtgtgtgtgtgtgtgtgtgtgtgtagaaaagggggagccgtgggcaaggggcgggggtgaagggaggctgcaagcttggcagaatgtttgaacaagacaaagagcagttccagcgaccaaataaggaagtgagtgctgaagtatttcagaatagaagtgtgtcagggactcaaggcaattgcggagagtaaaaataggcaaagaagaaagggcaaaggatttttgttttacttgttccacaaaataaacagggaaagaagtatctctggtctttcagctggagtgagaaaaacagatcgtatctatccctttctgttggctttttatagacatgtgtctgaagagatgtttagaagctctttcagtggcaatggcaataataagcatgcttttgttaaagacagaaaaacgcaagttgtgcattagacgcaccatcacattccctttatgtgtaatgcatgaaacttttagcccaagatgatggaagtttccaagaaccaacagaaatatctggaaacccattttcagacatgtcctgaacactgaattataactgtatcctttgagaaaaatcttacctcttaacaagccagttaaatgtccattagatacagtgtctaacttaaatatgttgatagttactgaaaaagatgtcaaaagaggcaaattacgcaaagaaactgtcagtacttgttttaatcttctcaataccatctccccaactctccagagtggccaataatatgtcactgatcctatggataaatgctgctcttattttgatactttttttgcagtacgggtggaagagaacaaagatttggaaggagaatttcagatactcctaaacataatttgaaacaacctttttttgtcctacaaaaccaacattgagaaattatttctattaaccaagaaatcaatttacttatgtctgcaactaggaataaatagaagacattcatcctgggtaagacttttgaaagccctcaataactaaattgttggcaactctaggattggcaattgaacaaatctatccttctgttctcatgcaaaatacaaaattggacagcccacacttgaatcagaaactaccagaacctgcccagaagagtttgggtagagagctaaactggagtgcaaaatagggaacacacaaagattgaccacggcatgtagatgatcttacaatgtagtgtattctggctccaaaaataacctgccccccacttaaactgaaatataaactctattgaataagctaccttgatcatgcttcaagaaaatgttaggcttatgacaaaatgtttattatcacaaacaaagaaaaaattaaaatgagacacagtgttatgcccacgaatagtcattttaatgaccaagctccatcctaccaatgcttcactagttgacttttttttttttaagcaatttaacaatagatgtcaagagcagggaaaaaaggctgggtgtgctggctcacgcctgtaatcccagcactttgggaggctgaggcaggaggatcacttgagcccaggagttggagaccaggctgggcaatataatgggactccatctctacaaaaaaatatttcgaaaaagccagacgtggcggtgcacacctgtagtcttatctgcttgagaggatggcttgggcccaggaggtcaagactgtgtgagccatgattataccatgtactccagcctggacaacagagtgagaccctgtctcaaataaataaataaatagtggtaaaaagagtatttgacttcaaaatcatacttctcagtatttgccctgaggaagtaactcaaaatgggaaaagaaatgtataagcctgaagatgtttagtatagcatattttttataatttcaaaacaaaaaatttagaagtcaaatacacagaatattctcttatctcaacaatgcaatattatgcagcaattaaaactggtaatgattaagcctatgaaggcaaaaaatgtttatgataaatgatacaataatgacgaaaagttaccttgtaaaattacacactatctgtatagctatgttttgaggactagaaaagaacatggtgaaatagtgctagtgtgttatacatacatagaggtagattttttgtcatctttattttgtgtttttcaataataaatgcctttcaaaaaaagatgatgatgaacaagcttacaggcaagaggcaggattccagagtcagaaagaactgaggcttcagagtttacctatccagcaaatataagtcacaaagttttgtgtagctagttagtgatgttgtaatagactttgccatttacagaactgttttacttactgatttgacttgtcaattatttaaaaatagcaaagctagcaaaaatagcaaaatgtcaattatttaaaaatagcaagtgtaattcttttgtgagaaaaacaatcacccacaaaaatgtaactgcagaggctccgagaccatttgtgtgtgtgtgtgtgtgtgtgtgtgtgtgtgtgtgattcctccggtatagctgtgaataatgtgaggtaaccagagactggcagagtcagcccaggattaaacaccgtcatcagcagcaccccagtttaaagagaagattcagagcacctgcatcaggatctccttctaaagccctgaatggcaattgggagccaatcctgacattgagatcacataataaactgttctcacaaagagcagttcatttaatctttccatgcttttgttttggtgaccccgctactgctgggagtaattataaagaactccaaatgattagaaagcattttgcataaatcagcttgtttgaattattgcatttccagggaaaattaattgcgacttagaacaatgcagaaattatttacacacccaggtgtcaaaaagcagaggagaagcaaagaagtaaatatatatttatagaatttcctgtgatggcttataataactattgagtaatcatagaatgttaaatgtaatctcatccaaccctctatagtggagatttgaaaatggagacacaggactcgaagtgaatcgtgcagggtctcataaagagttaatgccagagccaactcctttgttgaaaatagtagttaaatccttaatggctgttctctagagctctacttgctgcctttgccttcttgcccctctcctgtggcgaacttaaacagtacttccatcagtcttacttcgaaagacttaagagtttgaaggagctctagacaatttatagtcttgtcttaggcaaggtgattctgcttcatctagttacttatttagaatgttaactccttagtggcagaagtcatgtttctcagtaataactaaacttattggcagcaatgccatgtgcgccgtgccaaatgctttccaaagtctcgttgaatccttgcagcaattaatcaggtgtgcagtgctattattctcattttactagaggaggaaactgaggcacagagaggttaaataacttccccaaagccttacacctagcaatggaatattacgcagcaattaaaactagtaacaattaagcctatgaaggcaagaatgtttatgataaatgataaaataatagttaccttgtgaaactgcaagctatttgtatagctatgctttgaggactagaaaagaacatggagaaatagtgccagttatgcgtatggatacatatgcatcacaagtgcgtatgttgagatttagacaaagtatcagccttgggatttacacccaaagcatgagctcttaagcatgaacttgcattacttcagtaggtgttcagtgaaagtttttgaaaatacacctaaagtatcccaagcagatgacaattctcttgactatgaccaaaggtatgaggaagaacttctactttgagtaaataaaatgatgggcttccagaagccaggtatccaggtgataatttttctatttgaatatgagaatgatagttacacagataactccaaaaattacctgcatcagtgaaaatttggaggacagacatatataaattttgcaatgttgtatgtcataccagtgaaggaatctaatgatactattatttattaagtgaggatcgcaataagagttattgagtaatcaatgtctctgtatttctttgggttatgattcctgtcacatcagtatggaaaaagatttagcaagtcgcatgctttgcttgtccacaacatccaagctccaaatgtcgcagacataaagatatgcccagagtaatctactctgtaactcacagtgagggtatttagttgaatctccatataaaggaatgatttgaaggaattatctttacctaatccatcctcctccccaaagtagtggaaaatagactcaattatttcacctgaagttaaatttgcatgtgtgaaagtgtatgtttatgaaacaaatagtgctaagcatgacattagaaatggaaatcctaagtcctctgcaaaacattatctgatgagttgattacgtatttgttctctacttatttcatcttaccttaaaaccatgggatactaaggtattttttttttcatcattcatcccctttggtaaaatatcaagtatatgtatgtgtgtgtatgcagatatgggtatatatatgtatgtacaaatatatacatgtttaatgtattattacacatacagatatacacaaagagagaaaaatttgaagaattagatgaatatacgtataaagagaagttttaggccaggtgcagtagctcacggctgtaatcctagcactttgggaggccaaggctggtggatcacctgaggtcaggagttcgagaccagcctggccaaaatggtgaaacctcgtctctactaaaaaaaaatacaaaaactagccgggcatggtggcgcgtgcctgtattcccagctactcagaaggctgaggcaggagaatcacttgaactcgagaggtggaggttgcagtgagccgacatcgtgccatcacactccagcctgggcaacagagcaaaacgctgtctcaaaaaaaaaaaaaaaaaaaaaagttttagtattttttttctcatctctcaatagactgttgttgaagcccactgctctgtataataccccaacacccatttgaagagttgctgaaagttctgtgccaggccatggtgggctggcctgaggcctgatcccagaaccctccagctgaaaggaatgttagagctcagccatccagcccctccgcagaacacatggggaaactaagagagtatgagaattttgtctcaagacctcatttccaagaggactcaggacctgatgaggtctttgttatatttaaagtctaaatagctgtgtgataataatgaacctagcttaggaattgttttacatactagagcttttgtttggttttagatttttttctttttggggagggggtggggtggggaggggaggcaggtagcaaagtactcttcaccacaaagaagttgaaattgaaaaggaaatctgtaggcacttaaatgaaaagcagggcattttgctgatgaggtcaaatgatactgatcaatgggaagctctgggagaggtggctgtgtaaaggagagactgggtgacccagggaagtgtccggagctgaatgagaagttggaatcacatattcctatgttgcagccttcaacctgatactaactcattcttcagacacggagtccaacttccaagtgcttcagggatttttgttaagccttttaagggtatccaaatgaattaactattgtgtttcaccaacgctctagtaattcactttcagtgggcggttttattttcccagatgtgcagattgttcaccatggagctatgagtaattaactcataaaagaaatgtccagatgaatgaacaactgcaaagcacctgttgtcaacagctgatttttgtctccgcgctttgattatgaagagcttgagaatactggaggttgttttcttcttctaaaaccttgtgacacctgctgatttaggttcacatagaatacaatggtaaatagagaataggtggtagagcttgtctttatatctaatgaaagaaaagtgtcaaagtttcagatgaatgtcagatacccaaggatagggctgcattatgactttcatgggccttaggcacttttgcctttgtgggtccgtttctccattaaaaaaaatagaattatattttatagttgtattggtataacgatgaatgtaacccaggctggattcattattatatggtcatcattgttatatttatttatgttcactttttccttctgggtttattaaaattaaaattttttcttgggttgcccaaagtgtcagccctgcccactgaacctaatgaataaattggccctgcctaagattatggacaaagagacttcacggaaccatagctggccccatcgatttttactgtcactgtaacagagaacactgctaggcccatttcttctatttttcctgatgttgtctctgaacaatgagcagctcaagaatcagaaatccctttctcggcaaggtagttcacgcctagagtcccagcactttaagaggccaaggcaggtggatggatcacttgagctcaagagtttgagaccagactgggcaacgtggtgagaccctgtctctacaaaaaatagaaaaaaattagccacggggtggtgcacgcttgcagtcccagctactcgggaggctgaggtgggaggatggcttgatcccagaagatggagactgcaataagctgagatcataccacggcactccatcctgggcaacagagcaggacccatttcaaaaaaaaagaaatccctttctccttatgtaacactacttggcctagaaaagccagtatttgtgtccactgtgctctgccagggctgcttatgtaggggccttcgttcataatatgacaacgaagcaggtgactgaatcaaaaattaattcctccatgatgctaaaagactgtgtctgtgttctccaaaatggagtcagtttgtgaagagaatttttgtcagaccagtttattcattgctacacaaagctttcttaagtgacatgcagtgggcaaacaagggaacaatgacaccaaagttatgtcaagcttgtacttgtaccacccacaaatgaagatggaataataatgttgccacctataagctaatgaacaaaatgcaacaatgggcccaaacatgcatatacccattgccaataaattaatctctaatgagacttttgctaaaattgaggtaatgatttacagaaggcctggcttttaaagaggcctgaatttagtctttatttatggttgccgtattttcttttcacttgcattgaaaactttactttcaaaatcttactttgtcaactttgtccagaaatacatttttttatttttttatttttttaccaatcctcttaagtgaatactttttaaatgatattctaaactcttatttctctcagtgcagtcttctctctgaactcttttcatgagccatatcttattaaaatccattatatattgtaaaagaaatagccattggaaaatattcataggccaccagttcctttgaacatagcagattgaaccaaagtttaatttgaaacatcttttgataaatcttataaattgaccaaattttctcaaaatcattgaactttttctaaagttactaaaaacagacaaatatcatatactaatacaagaataatgatcttacttctttggagcaatggaattattttttacatttacgactatggaaatcttgggtaaaaaaaaaatcttaattttttttccttgaaatctagtacttcattgtatcagcagtgacctagtataactcacttaaggggcctgtaacaggcaatatcaatattattgtcaattgttttaactgtcaattatataaactatatatcagataaattcttttttttttttttttttttttgagacaagttatcactctgacacccaggctggagtgcagtggcacgatcttggctcactgcaacctccacctcccaggctcaagcgattctcccacctcagcctcccaagtagctgggactacagacgcacaccaccacacctggcttctattttttgtagagatggagttttgccatgttgcccaggctggtctccaactcctgggctcaagtgatcctcccaccttggcctcccaaagtgctgggattataggcgtgagccactgtgcctggccaaattcatttctttaattgccaatgttaccaaatattctctcctatggagcttatggtctatattcagagaattttctaattttaaatacatttattacatttttatatttaaagaaagtttaattggaatatttgacttctccttattctctctcttctctctctcttctcattccatttccatattggagtctaggtttgtacattttattttgttaaagatatatactgcaaaataatctcaatgattctcttagtagttggatatctttgttagaaaacctttaacttcagcactgaagcaaatcattatgtatttgcctaatgagaaaaataaagtacttcagataacataatcccgtttatttgacgcagaagattcgtgtattgatccagaagaatggatattcaagtttaagatgtgaagtgctgggtagaaggaggtttcagagatgacaggttaatcagagttagggaaatagacccaattccctccttcttgtgatagtcccctatgtatagcctgtcggagtccatggtttcctttgaattgacttcattcttctgaaaacggcgctgcaacaccctaagcagctccattgctgagagagttttacttcctgtatttctgcgagcaacaatggaatcatggctgatctgggtgttttctaagcaccctggaaatctacatgaaatgcgacacaagattccttgttatggtgtcaccagaggtaatattaatagtattaaaagaacaagctgaggactttatgcatgatcttacccatgacttcatgaattgccactgggattaacgtaaaatctgtaatcctcgcctaaataggccatctttgtctattatccatcactatatatataagatacaacttaaggtttttcttatgtaggataagttcaaatatttagtccactgataacggtatttcaccacttattcaggagaatcacataaacaggcaaattctcactatgcctctttagtaatccacatggaatctgtggatgattccttcagagccagcataactcatttgatttggaaaagggtgctcaatagtgagtcagattctactgtggatcaagcaggacatgtttagaagctgccttaactatttcagatcaagcagacctgactatgcgcaataaaacttggcaataatcaattgctccattggtaaaatggagatcttagggacggtgaatggatggtgaatgcactttccataaatatgtattttttactccaaacatatatattccttggagcttggactctggagttaaggatttacatctccgctcctccccttaccagctccgtgcccttgggtaagttacctaacctctctgtgctcactgtccctgggatgatagttatagtgatacttcttcatggtttctatagtcagataaacaggagaatgcatgtgacatgattggcataatgccagcccaaagtaaagttcagattattttttttactctgttttttaattatctgaaactaaatactgtgttttgcaaaaacaaaattaaaaggcaaaaacaaacaaacaaaaaccagctccccacctgctacataccaaacagtatgttaggtactgcaatggcagcatcgcactgtgtcttttcaacagcagtccagggtaaataccttaacctccacttcacaaatgagaaaacaaaacctttgtgatttcaaggtcatggaaacagtggaactgaccccactctgtccagctccaaaggccatgctcttttcaggacatgccttcactagatgatctcttcagccccctcccgactctgattttgagtcctctggaattgtctcggatgttcaaggcttacctcactctcataagctcagcctgttttttgtttatcgtagcgtggcctttctttacattccaactgcagacctggttgtcattctccctgtgacatagcatttgatgtccactgggttctagttatgtctatataagtacaaacagtcccatttcttttttcccgatccattctcccttatcttaataaaaagttgtgaacaaaccaaagagccataaagttatctttaccaataggatagatgaatttgttttcatgttcaaagtatgagttgtcctcggaggggtgccctttccctcctcccctactagtctgtcttcatgatcagataatgcatgaggctgagcctctttagaatacccacattttggttttttaaagtttctcacttttgttaaaataattactagttgttgatatggagacaaatgtgttttgtataaaatgttacacttaattacagagtccaaattcaaaatagtccaagattgttaaaagttgcttattcttaaaaatgaatggactaaaagctgatcttaagcattctactctcagaaacattttcccaaacataacattactatgaagcaatatcaggtaaaatctataattaatctgttatttccttagtcttgttcttgtttgataaatgtagttgggagcccttgcaaaggtagcaagtacaatagaagaaacaggccattcaggcaagattctgtgactctaaaaaatatagtaagagctaaatcaagtttttaaaaataacatcaaaggccaggcgcggtggctcatgcctgtaatcccagcactttgggaggccgaagaggcagatcacaagatcagaagttcgagaccagtctggcccacatagtgaaaccctgtctctatttaaaatacaaaaaattagctgggtgtgatggtgcacgcctgtaatcccaggtactcgggaggctgaggcaggagaatcgcgtgaacccgggaggcggaggttgcagtgagccgagatcacgccattgcactccagcccgggtaacactgcaggactccgtctcaaaacaacaacaacaaacatcaaaacaccagaagtgaatggaacaagatcctgatgctgacctgattatcagaacatctgttatagacaacattgatcactctgaggaaatacatagcaaaagcctccttgtagaaaatgtgccaatccagaagccaggaatcttctaggaaaatctcaagttttggtaattttcattaaaatattaagcaaaatgccggaagatatattaatattcctttgctgctacatggaaataaaataaatgaaaatatagattttgggctttaattcttaagttagaaaagcgtgattgaacaatgtcgatttgtggtagcagtaaaaagacatttacttggtttgctaatcatatctactttataaaatattatcatgttacctatgctgagcattttgagctagatagtgtgcaatacccgtcagtagttagatagatcaatcagtcgattgataaatagatagatctgtgatttggtttcactgccaatatcttctttctttagtgaatactgttggtttttagtgtctttcgttttagtgttttagtttttaaccacctatgtttcactattttcattgtgagaaaaatatgaaaaggaatgatttgaaggttactttcaccctttccacttttctccccaaatacttggcgaattgagcccaatgtttcatctcaaagtaaatttgcatgtttgaagccttaggcctctgagccaaagcctgtgaaggtaaagccagagatgcacggcctaaagcagagactctggcagatacagccagcgaagctggagggagttccttgagtgtcactcctgacgaaataaaagttcattgtgtatttattctctgcccctttcatcttatctcaaatccacagagcgctaagttttagtcaaggaagaatgaaataaaagtaatagaaggagaagacttgatcagaatcttcagtgttcagaggaggatggaatattctttttcaaacttggcagaaattctcatcagtgcttctactgatactagttttagcaattctgaggcttgttcaaagtgatggccaagatgtatccacacctcccacggttcgtgtgtaaaaccttcaaagttgcaaacattggaatattcagtgttttgcatcagtgccttaaatcttcatggatttcggcactgaaaagtgaaaactggtccacgtgtacgcatctttccgggcacctgtagttggaataaggcagacacacagagatgacagatctaatggatcatccttcttttgctgtctcctcagagtaaaggaagtgcgtatgtcttctcacagccaatcaactctccaagtctattctaccccacagtcccttccatggccggtaaacactacaggtggtaatatcagacatctgttttattctttctgctctttatgttgtgaaaggactcctaaatcataaaatcataaaatttaagaagcgtaacttaaaaatccatcagattaatcccattattgtggaaataaggaagcttcagagtcccacagttaatggcacagatcacacgtcctaactctcatctggtggcactctttagtcagtgtcccatcacagcctgcaagaaaaccctgctgcaggccacgtgatgtcattgctgcagccctaagggccctttgacatgggcgtaaacaagctgagaattcaaagaaaggtgaagctaaacagggaaatactgttagaaatattagaataggcaaagtgattttcactctttaaagtttgtgttccaggacaatgaattgttggtctatcaccctctcaaaaatgcaagagatgataatgctttgtattatccccagaaagatgactatggtcagtatattattaggttaaaaaaaataggttacaggccaggtgcagtgggtcatgcctataatcccagcactttgggaggccaaggcaggcggatcacttgaggtcaggagttcaagagcagcttggccaacatggtgaaaccccatctctacaaaaactacaaaaattagctgggtgtggtggcaggcgcctgttatcccagctacttgggaggctgaggcaggagaatcgcttgaacccaggaggtggaggttgcagtgagccgagatcacgccactgcactccagcttgggtgacagagtgagactttgtctcaaaaaaaaaaaaaaaaaaaaaagttataggctgagtgcggtggtcacgcctgggaggccgaggtgggaggatcacttgagatcaggagtttgagaccagcctggacaacatagcgagacgttgtcttgaacaaaaaaaaatgttttaaattagctgggtatgatggcacgtgcctgtagccctagttactcaggaggctgaggtgggaggatcacttgagcctgggaggtcaaaactgcagtaagccatgactgcaccactgcacttcagcctgggcaacagagtgagaccctgtctcaaaaaaaaaaaagttacaaaattgtatggaaacaattatctaagctattttaagtgtgtgtttaaatacacatccaaaagcctggaggactatattttaggcagctaacaatttatctctgggagtaaaatcacagggacattcaattttggtttattgtttaaagaacaatatttggtttttaatattttacagacatcgttattcatttaaaagtcaataaagatatttccgagagaggaatagactacctggctgaagacagtgaacctagcaatgctagtgttagatatcagtaatgacggcaggatacagttacagtactaaaccctttaaacaagtggtctactggctattcaaaactagttagcatttattggcagttactgagtgaccacgttaccgaaacagcctggcacaacagtaagttcagtaaatggtagatattaccattcattcattcattcattcatgcattcattttgttaacagcttattgtgtgtgaaagatttggtcccagtggccaaggagcacactctggaaggagaaagaagacagaaattgttgtgacatggtgtgccaacccagctactggaggattatacacagagccaggggtgtccttagctgatctggtgaaagaaaagttggtgatctggatttagggctaagcccacaatctgtcacaaattttgcatagaatattaattctggaacgaatgagtccagttcctctttgaaaacacttctacagaagttcctgtgtagatgagcgttaaaataagtgactcagggcctccagtagtttatgagctaagaggatcacaggataggatagggaccgggttcctcagatgttgctagatcaaatgctttactcttctcaccctaagggctcctgaatttagctttttattacacagaacccagtaaactaattaatggaaatctaaaaattatccttcctcttcttagaaaagaaatatactgcatgatgatttgtgcttttcgatttaatgtcacacaatcgtttttacactgtatgtgctttccctccccacagccccagtcccagccccagtctcgcagttccattccttcagggcagcttccattctaccgtgagtttttattgctttcccctaaaacgctgccctggagtcgcgtttattggacactctttagtctgtaaaggaaaaaaacacaaacaccggaggagaatcatcctaacaagccgacaacatatctatgggcctaaaaaacttaaattctttcccgttattagcacttctcgatcgttccaggaaagcccgatttgtagcttggctgccccaggaaggggcctgcgaccagaaagatgcaaagggcgggacaaggttacgagtgggtgcggggaagcctccctaacctgggggccgcgtcccagagctgcgagccacgcctcctctctcccgcccgccgcgccgccggactcttattttgaagggcggcgggtgaaggctcggagcctcctgagtcacccggcgggcgaggtataaagcccgatacctgccccgcgcccggtccgcggagcccgctgcagctcccgctcgctccggacgcggaatcgggcagcagcgggaggcggcccggagagccgaggtaggcgcggggaatcggccctgaggctggtggaagaaatgtgtgaattaaagggagtgcagcgtgcagggtgggccgcgagtcgggagtgcagggctcgggacagggtgggggcggggaggacaagagactcgtcagcgcactttccacccggccggttccttcccgagccctctccctcccccggcccgcgggagcacagatccctgaaagcggagctccagataggaatgtctgcatcatcttggcagggcccagacgggagaagatgctctgctgccacggacgatccctcccgctctcctaactcttctctgaacacctcgcacccccacggccccccgcccctctcttaatcttggccacgctccctgaggggtcagacctggggtgggagagcagagaaagcggggctggcagagacaggggtgagggccgggagaggcgatgacatcattccctggcagctggcggggagagggtggggacggaggggtccccccgacctgagccgagccctcccttcccaagcccatcctcctttctttgggatggttcaccccacctgggcgccattcaaaggaagtttgcgcgtaactcggggcgtcctttccccggccgggtgctgtgcccggcccgcagtcggtgtttcttctgggcctgggggcggcgtggagccggcggctcagtcccctcagtcccaggccttggcagccgctttgttcacgccgggcgcgggccgaacccgaacctcagctgcagcactggcagcgcgcaccggccacgcgtgggttcccggccacggccgggccaacaagggagggtcccgtgagcagccaggctggccctccccgggcctgggtgagctcccaaagctggagcgcagggctctaggccggccccgccccggggctgggggcttcccgcccgtttgtctcattttaacttttgggggcagctctgtcccgaatggtgagtggtccagactctagaaaggggtttggtcgcttgagcccggattgaggcttgggacctttgctctcttgctggggacggaagggggcgcgctgggcaggagagggggcgtctcggtcgggtctccctgggctcgggcatcttcccaccctgcggagccgggtcttgcgctgcgtgccccgaacaggcccgggcacaccgagtcccgttactggtcttcaggcgaaattccaggacgggtgtgcattcatcaacctgggagtctctaggagccagagatgactggctctacattttaatgcgtaatcacagagaaactagcacgagaaaaggacagagggaccgacccaagcttcagagacatggaataatatgatcctggttcataagccttgaaaagctcccctccgccaggttaaggaatggtgtcaccagccttggctgtgaggataatttcttgatttgtgttatgcaggctcctgtcaggactgtctccttaactcccactacctaaggaaaagatagccagagaattgtccagggatttgggtttgggttgcttctagaaagacagcatctttcttgctattttttttttcacatccccccaaaacaatttttttcccccttcagacttggcagactttgatttagataagaggtttgagttaatttgattttccccatgtctgtttagatcaatggatataggagatagtttgaagctaatgtacccctatgcctttgtgtgagtgtaagatttataacttgagggaggcagttaataaatagcacatccttgaaccataaacatacgagatagacaagagctagataataaacagtttttcccccaatccctaagctttacttattttttttactgattcttgtactttgtcattagaaaaaggagtggggttggtttcccagtgaccgcattcattaagaaactgggcatgtacagcaagtagcaaaatatgccaacatccacaccatctctggctatgtgaaaacttggtgccctgtgtgaggagcatgggggatggttggaaataatgcagctttatttttattgtgattgttggaattcatgaatcataaaattctgatagctgggatggtgtggtagctcacctgctttaaataatgtaataacgacaggcccagtctgtcccaggtgaggaccactgacttagtaaacaataaacaggtgtcctactcatagtagccttagtgttgcttcagtagatccttatgagctctagatagtttttagttgacttttaatatttttaaaggtaacaataggccgggcatagagactcacacctgtaatcctagcactttgggaggccgaggcgggcagatcacgaggtcaggagttcgagaccagcctgaccaacgtggtgaaacccggtctctactaaaaatacaaaaattagccaggtgtggtggtgtgtgcctataaccccagctactcaggaggctgaggcaggagaatcacttgaacccagcaggtggaagttgcagtgagccaagattacaccactgcactccagcctgggtgtcagagcgagactccatctaaaaataaaaaaaaaattaaatgtcaccaccttgcattgtacttgatcttcagaattttactctattgtcttaagcctttaaaactttgctcatgaactatattatttggactacctttgagggtagttgcatttttgcatttttgcaaaatattattttccctaggttacagtaaacctttgactctgttatatttgaagcaactaattattcctgaaacatataaagcatttcctggcaatgttggtggagttcatactgctcaaggtgctgaagtcattatttcaaggggaaattattagcgtgttccaacagttcttaattgtccaaacaattgttgatttcccccctttccagatttctttcacaatcattgggaactataaaaaggtgtattcgacattttcttttgtgtatattttccacttcaacaattttgtatcaaaacgtatggcactttttcagcacttatttcaagagatccggataaactctgagtaatcacaattcactatacttcaaaaattgcctcccattcagtattttacaaataatcttctacaagtaaatggggaaaatagacactaaccatatactttttaaaaataatacattaaaagagcactaaagcgttctttgaaagtgctcctggtactatatacgtattggctcattctagcaatgttcttttgagacaccatacaagaaatggaactcgaccagatttgagaaaaagctgcagagaaggtgaggatttgttccagggccatacagagaggaaattgagacactcatttcttcttagttcagtctcccaggtgtttagccctagatctctttgagattgcacgaatttaagggattttttttaaaaaacagggaagctctgttatcaaattttaagagaggataaagaattagagatggtagatgagaaatgtttcatccaaagagttttttgtttgttttgttgtttttttgagacatagtctcgctctgtcacccaggctggagtgcagtggcatgatctgggctcactgcagcctctgcctcccaggttcaagcgattctcgtgcctcagcctcctgagtagcttggattataggcgtgagccactgtgcctggctcaaagagttttaatgaatagaaaacagtgacccattcttgtagaaaagacatggagataaaatgaaataaggagagcctgaggtgtcagggaaggagaaagagcattttgaaactggtggcaggtacaattctctgcctaactccgtggactacttagggcacagatttcttcctgctcagtcagtgttagctgccttcctggttatgtgctttagggttgaccgtaattggtaacataagccattccagttaggtgagcctctcttccttgtgtattttggataatgactacgaggaaacaagatggaaatgtgggatggttagctaatgtcagtgccgagtctccctgctcaatgcgcgttagcccaactgccaaagctctgccactatggtaagtgaagatggtgattttcagtttggcagagactgttggaaggcgtaatggcttatttgatggaaaagatttcctgctgcgggagaagctgccatttgcagacaaggtgtgtcagccagaagaaatgagcaataaccgttttctggtttctactggcaaaagctttgtatttttttcatatagaagtgttaaaaatagattcataagaaaatgcatgaaaccaagtaaaaagtacagacactgaaatttcaccaatgaatgggagagaagagagctaacctttgttgaatagttattgctaaccaggtgcttcagttctcacaaaattgtgtgaggtaggcccgccacattagagaacggggatcaggcaaacagagatgaagtactgctggagcgccacgcaggagactcttaagcttggcgttgacgtctatgacattcggatgcctttgtgaggctgtcaaacctactgcgaagtaggcggccctcagctttcagatgggttgtgttctgattgtgggtttgtaaaactcattgctgggaaccctgaacacactttttcactgaaactatgtcatatttagtggtttcccaggccagcccagaaatcatagctgaagtattctgtcttattaatagtaccatagaaccaaaccactatatataacatggtttttgtgggaaaatgcactcagagctccaacttgagttttttaaggtttttaattccagttacaatggcaaaagggactccaccttctctctttttccatttaagccctggagggaaaataaaggtacacagagatacatttcctttcacgtttcctcatgctaacagagaccccaccctggactgcagagcgatggggaggggggatcctggcagtagctggctttgtgacaacagaggaaagagaagagggggaagagagcacaggtagcggaagaagtgaggtctagatgtcatcacctatgggaccaattttggatggcttatcaatatgagctgcaggctgactgacatcgtttccttactaaacatcatttttactgagaacttagtaacctagacctagacattaatgttacttagttgtatgttcagtattttttaagtgaaggttagtttttaaatagtcttcagtagtagaaggaaagcacatatgtagacatcttatttttctttttcatgccagtctactgaatgtccaaaccagcacctatcggtagctgaatacactcaaggtaaacctggatgctaatggatatgattcgaattaatcatagaatatataccgttcgttgagtacttcaaaccagaaaatgtgctaaaatgttgaacacattttatgtcatttaatcctcaccacaatcccacgtagtgagtactatcagcactcccatcttaaaaatgatgaaagtgagattttaagagggtaagtaatttgtcaagatcacacagatcagaaatggcaagtctgggacctcattaattcaacaaatatttttggagcaagtcctgtggcccaggctctgtgttagactctgggagtaaagcagtgaatgaaatggacaaatatgccgaaatccttgccctcgtggagcttatatgccagtggaaagagatgaacagtaagcaaaacaaactaaacagctagtgcctcagatacagttatgtgctatgtggtaaaatagatctagggagcatgaggaatgccaggttggggttgcagttcaggcaagtagagaatacaggctgaaggacagctgtgagataacaaaatcagtccaggagtacatacgctattgtttctcgcagcaacccattttatgtcgtaacaccaaatgttgagtacatgtcaccctcatcagtcactgcttctactgcagcaagtgactggggaggtatccaagaatgactggtgaagggcttggccttttctatcccaaggtcaggaaagatgaggacagttgctggagggatgtcctagagcggctggggttttgtgcacaagcagagggcttgacctcagccaagagcacagagctgattctcctgtagccccagaaaacaggcggaatctgggggcacagatgagggctgggtggaaggagcaatggaagctcgtggaagttctgtgttgcttctgttttcttagtggaatggggagtgtggtcatcagtggggagcgagggtcggggagggagtgcggggccgggggtgcagtttgaggagagagatgtgaaacagtcacctggcagaaagggagcctgaatttagctggtgaaatgtacactcaggatctgcccatggtcaaattctgactcttaacatccttccacagtatattggagatcagaattctctagttcacttcttgaggagagagattatcttctaactccttttttttttttttttttttttttttgctgtgtcatttacttggagcagagtcctgcacttactatgtgtatggttaatgcttgttgagtgactgctacaggaaacctacacacttgtccagaaatttcatttaagcttttcgtcctaattgtcacattgttctctcccttttctgaaatgctgtgatgttcctagttcccaaaacagtacttgtatagcaattactgttaattatttcattgagttaatctcattcccataacggattaagttttagactaagaaataattttttttgtttgagacatgaactcactaccttcacccaggctggagtgcagtggcatgatcatggctcgatgcagccctgacatcctgggctcaagtgatcctcccacctcagtctcccaaatagctgggactacaggcatgcgccaccacgcccagctaattttttgtatttttaatagagatgaggtcttgccatgttgctcaggctggtcttgaactcttgagctcaagtgatctgacctctcagcctcccaaagtggtggcattacaggtgtgagccaccgcgactggctaaaaattcttaattgtatactcttttgtagtattctcttgggaccacctaagtcaagcctcattcccaccagatggtgcccctgttgggggcagtgaagaagccttctatgtctgtttcatgactccttcttggctggcacactgttgtgggcgctctgtaggtagtcaatgggaaacgggaaagctacttgcggttagaataatacgagaactagatattggtaatctcagctgagcgaatggcaaaggaactgatgaagcaggtggattccaaggctagttaggagaaggaattgactacaagtggtgttggtgggatgggaggggtgagggaggggggatgggaggggtaagggacgggggtgcatcagaggttactcccagggctctgccagaccctgggtagatggagccgccgttttacagaggtaaggacaagagtttagttttgaacattccaagtggagatgtccaggacacaattatatacctaggctgccattctgggaggagatctgagtgggagaccatgatttgggaattatcaccacagatggtaatttaagccttgggagaggatgagtttgcccccaaagagagcataaagtaagaaaattgggctctccgtgtttcaaggttgactaaagatcctgtcatttgactaggctctgctatagtctgcaaaatctgcccagggacagaatattgaagtaaataaagtgtattccagtgaaacctcaaatagattgattcaaaactggagttagaaaaacttgtggtttttcttggtaaagcttcattttctatttgtcttcataactataaatggatgtatttgtgtggaagatgtagattttttttaaaaaaaatctatttttggctctattaagagacaaaatgaatccaaatgtattccatacttctctcacattgcaccattttgttatgtaacagagaacgtttgagtacatactgtccacaccagcaactataaatctgtcctggcaagtgactgtaagatacccaggaacaagagataaggagctcgcctctccagggagaagcttttatttgcaagagagagagtgatatacaagaacttgcaaatgtctttgaagggcagaaaaaatcagctagggctaataaggcagctgtccaagttcatgattccttggcccttctttatacacaaccaccaagagttgtcagtttgcaaacctagaaaagtataccattgtaatatcagttcatctcccgcttttccagagctactcagaagcgtggtggatgcttagtgaaacgaccagaggtgtgaagctgccagacctttacccagatcaacttctttgactcagggtacaaatgaacaacgtagtctgacagctcacctaaaagttatttggaatgattttatattgagagatttttttaaagcctaaatttagattcatcagagcatatcaaggttgagatatgtgaaaggcagtgctatatgggagggtcaagttccattcgtttaaaaataccaggacatttgctgctgtttagtaggggagttgggtagggtagatatcctcacctccactatacagatttatttatttatttattttttgagaccaagtttcgctctgttgcccaggctggagtgcattggtgtaatctcggctcactgcaacctctgcctcccagggtcaagcaattcttctgcctcagcctcctgagtagctgggattacaggtgcgtgccaccacgcctggctactttttgtatttttagtagagatggagttttaccatgttggtcaggctggtctcaaactcctgacctcgtgatcctcctgcctcggtctcccaaagtgctgagattacaggtgtgagcctctgcgcccggcccactatataaatgtttaagaattaacatgtataaaggttgggactttcccaaggtgagctgttggacctggatctcctgaggccaactgtgtttttcttctcagcacagcaagcatcctttgagatgcagagtgatcttaccacttgaaaatgtgcatcaagggcaactgcagaattttccaaaagcttaagcacagatggcaaatctggcaaagtcaaattgagaacactgactacatgttcaggaggaaagtttttaagggtaaatgcttaaaaatcctgaagaccagtttatttgggaaagcaattccaatggaaaagtgcggttggcttactgagggaaccacacagtggcagtttctacaacttggccagctgccctgggctggcagttgaggagaaaatgcagcagtggggttgagtagacacctcagccacggagtgacagtcattgtgttctaggtaccacctgaccgctctctgtctgctccttctgtggctctataatatctgagctcctgggtaagctccatgcagcctctacaactctgcttggagctcagttttcctatgtgtttattttgattttgtctacttattaagttaaatacaaatctgaaaatgaaagaataatcaccttggactcctgaatgtttgctcaatgtcatttagctcccattgtttcctgtcaccatagcagtctactgaaatctctcagcatatatttcagaattactctgatagtgaaagatttcctatcctatgtagtccaacaattattggtttattatgtgaaaaataaagcaagtatgtagcatttacagagtaatccagctccactgttaatactgtcatttgaagagttagcaaggaatgtgatgaagactgaatatcttgaaacaaagtttggttgtgcagttgctctgctatgaattatgggtctgattcccctctttatatgtggcttttggattttcttctgcccttgaggtaatctgctcctcctttcattcaccgtgcttttaggtttggtttcagatacagcatcccttctgctacattctttaaagttaaaaaaagaaaaacaatttcacttttattggtgatgggcattcaactgaaattacaaatcgggaaaacatgacattccagctcacagcagtctgattaaaggtggaactcttatgaaaccacaggatctgactgaacatatggatcatcttctggcaagcttaacagacacctgatgttttccttggccatccagaaatctgcatcctggtgtagatatcatgagttaatgatggagtcaagtgtagaaatgtgtctgggacttgcagacctcttgctttgtgatactttcttttattttcttaactggctgagaaaatggctgtcactccaagtctatcttctgatgggctggtagctctcattcaggccatccacagccagctgcctttccccagacaacctacattgccttgagtcttctcttaaagcaaaaagactagaggagaggagtgctactttcttctcagccttgctgtccctgtcatgtaaggaggtacttaaaaagcattcctatccagttctctctatctgctccgtcttctctccatgccctcatggagtacttggtaaaaacatttaagtagatgactttatggaatatgattccccggttttggagaaataaaaagatgaatctcagacatcagtaagggccacattctagttcaaattataagcctgtacataatcagtaaaactatattagaaataaaagcttctcaaaaatcccaagtgctcgttacccaaaaaatgatgatagacgggggtcccacaaatgtgtagttgtgtatatgtcatagtatacgaaggccagggaaatacatagtgccacctgacctaaccagctgttaagcataattactgtggttttgccagaaaggaattctaaatgcaggaaggtttgccattagtgggccacagaacatgaaagacttccctgcaaaccttttagaaaatttatgctagtttatatttcaggaggtaatacccattggatatactctaatttgggaaacatgggatgattaatgaattgatacaacctctagaccaggggaacagaagaaagtttggcttgcaaaatcacaggctccacctggtcagcgcttatcttccttgtttagctcaagttaggtaagtttacctaatactccttaaaaggagtattttaaatttatgtttgacatttaatgatttcagatagttcttggacatcaggataaacaaattcagtgtagcacatacgtagtataagaattctgttgatataatgccgcagtcatagttgtagcccattattccaggtaataatgatgctacaattagaaagttttccaattgtagttttgatttgcacagtagtaattgctgtttctattttcataggcaaggagaatccacacatgaattagaggctttccatattaggctttttggagacatagacatggtggtgatcgcatggggtgtttgagaaaatggagactaattgaatgcaaagtattctgtggggcaagcagagtaaagaatccagtcaaatgatgtcagccaaggatggcaagcccatgcccgaaaaactggcagcagctcacccataccaagccacctgagacatttcctgggctggaaacaacgttacggaaattgaacttccgtgccaaatttaccacacctcgccaaagcctgggcacctctcttattcatgggtgcctcaggagtaattacagctttatagcatatctactaagaactttagtgaaagtgaaaaggagtcggtaaccttgaattttagcaaactagagaaggaagatgtgggtgtcctttcctcacgcgttaacaaggatgctgttaggttgtctatctactctgaatccctacttaggaggaaagtcacgtatctggttgtgcaaatcaaagagctttgacagtttgttttttgtttgtttttatttgggtgcaatttttctagaagactaaataacctgtaaaagattaaaaaccatgattgagtgtgcctagaaataaagaccacccttgactgggctttttctacccaagtccaagtgaactgctttatccatttagtcaatacatattcagtgatgctggttatttacaaagtattttatctacattctgtattaattctcaacagtcctgtgagatcattgtttattcttgttaatacacatatacgcacacagaagagagaagtggggaaccccacaagccttgagaatttcaagaatttgtggatttcagaatggttgagcagctcatagcttttctaacactgaacttttctctctccaagtcccagtcgctcgtcaaaaactgtgccatcagcgcaagaccctgtgatttctgtggtattctaattttatctgagatttattagaatatatgaggtggaaaaaaaagttgtgcaacaggagattggactctggcatcccacagcgtatcttccctgccaacttcctaataaagggtgaactccaaatattaaaaagttattaacgtgcttgaaagtctttccaaatgcttcaaaaagctagcagacacatccagtatcatttattcagcaaacatgtactgagtttgttttgtgctcagcattcccgactaagtaggacattgaccaggccatcatgggttaggctcggaagggaggggcccagatgcagaatgaattgattagttctgtgggtgaaacagattcagtgtcctctgaggagggactgaccagctctgcctgggggagtaaggagaagcttcaggagagaaccaagagctgagagtggagagtttgggagaaggctgaagctgggtagagaagctggaggggggagggctgtgtgtccggaggatggcaggtgactggtgtggctagagaggcaccggagcagaggaggtgagggaggctttaccagctgtggaaggccttgctttccacacccaaagtgccatggaaaacatgaaaatgtgctttctatcaagggatacggtcagaaatcgaacaaaatatttcctacctgtctatatcattggagaaattgttctaggtcctttaaggaattttaggacccttactaacacctttcttcttttccaatagcatcatctgtcttagataatagttggccctctggatccctgggttccacattcatggatttaaccaaccacagatcaaaaatatttggaaaaacaaaacaaaaacagtaatacaacaatagaaataatacaagaaaaaaagcaatatagcatgacagctatttatatagcctttacattaggtattataagtaatctagagatgatttaaaatatacaggaggatgtatgtaggtgatgtgcaaatgctaggacatttttttatcagggacttgagcatgtgtggattttggtatccgaagggttcctggaaccagtccccctcaaataccgagggacaactgtactcacgagacaggttgttagagtttaagagattcctaaatcataaaacctcttgtaaaaaggaagacttatacatacaaagaactcagctagtcaagactaagaaagtaccagtgggaagtaaagccacggttttaaatagtaatgtaatgaatgcttcccaagggcttgaaagtcgtttgtcttaagcagcacttttgccaattgttatactactgatttatttgacaagccccctttttagttgttagtgaaaatctcagaggtatcacagatttcaaattaatgtggtctcaatcagtgaggcttcctcttgcaataatctgagatggcaagtagctgttctaggatacctctttttgctactcttctgtcccttaactgaatgtcatttcaataccaagtcctcttctctaatatgcattcaaccatgcatgtacaaatattgacttgtccctttgctcaaccctaagcccactgcacgctttactattttcattcttacataaaagatctagaacagaaaatagattggaagtactatatagatccactacatacagtcaaggggaagtctcaagttttctcatgtttccttttataacgtggacaactgaaagttaaatatgtccgtttgatatgggtaatttaagcagctataggtacttggtgattattgtaaacctaagaccttaaataatacataaggaatcaatttcaacactaataacatctgatcaacaaagagttccttttataagatgagaacggcatggaattatttctagttgccttaaatgaattttaaacacccgttatgcgagggagagtaggtatggtctgtaagaggaactccaggaagcccatgtggaattttgcagtttcctctttacaggtgacctgttaaacagcctgcatgtcatggtagtgagatgtaacagaaaagctatgttaattaaggtgactgattaccattcaaatacatgtaaatcacagtctacccagaggaagataggagtcctctaactgcaggcttcttccgaagaattaaagggctttctgaaaagctgaggctctcaaagtgtgggtatggtacccacactggtggtgtcagcatcaccatcactgggtacatgtccatggcatccagtgggtaccaggacatccatttcttacccactactagaaataagcaattcgcttacggttagcaatattaccatgaaaaaatgttaatttgacaatattgagaccaaagcaaaacagaattttgatatttgctaaaaaagaaaaggcctgaaattagtgggctggttgaaaggggactggaattgcaagctgctcccatctgccattccagcttttaaggcttcttaattgaattggaagctcagttgaaaaaagaaaaggatcatctattctttcctctgttttcagataaagtcctaagaacttttttgagggcaatttatacccattaaaatgtcaaattcacatatcctttgacccaataatctcatttctagacatgtttgccacagaaaactcaaaacaagtatacagtacaaattagttgtacaggcagctttattgctacactatttgcactaatgagtacttgaagagagcatgtctatcattaataaagaatggtttatactatggaatactatgaggccattcaaaagcatgaaataaaccttcatgtaccaacatggaaggatacccatgatacatcgttgaaagatacaagatcactgagggaaaatgtgcatatgcttcatccaacttttgtgaacaaaaacccaaacatgtaaacatatgggtgttgtaagtatttatatttgtatagtaaaggttctggaaagatagcaccaagattttattggtgttttgccctgtggagtggaattgtatgaggattggtggttatgtgggaaattctttacatttactttattatcgtactactttcactttattttttaattaatattttatctttaatttttgtgggtacataggtgtgtatatgggctatttggatatggacatgcaatgcgtaataatcacatcagggtaaatggggtatccatcacctcaagcacttatcctttgtattacaaacaatccagttatactcttatactttctgatacttcagtttctcacaatgaatattccttttctaaaaaagaaaaaaaaaggaagaaactaagtcccaggcatattaagagagagctaattagctgtagaactaattctgacactctatttcccaatcagtattattcagaattattttttacttccctgtaatagttactcaattttagagccagaatttagcctaatctactcatttaacctctaagaaaactgagcccagggggtgctaagttcctggagagtggtcctcaggtggtgactgaggactgagttagcctcctccggcaaccctacccccgtcccaccccaccccaccccaccccacccctgggcaaagtgaaagtgaagcaaactgagaggaactcctccactgtcccttctgcttactcagcagatgggagccagccactttgttttgtcctggggcctgtccttgatggcttctaagactaaaaatcaaagctgtaaatttgtgtaatttagagattgaaggtactgatcgttgttgtcagtgactggaaaccaggcctattgagcaagagccattgttcagtgcctgtcagcccagagagtgtgccgaatgcactggccatcttagacacagatctacttggtggtgttctgtgttttttctcctaaaagaaggcttctcacaccaccactgatgagaaaacaattcgaggaaaacgtaggcacactcagtacatgaagggagacactattaaaagcaaaaagagggttattgtcaaacttagaacgatgctaatttgagttctgagctctaaaactggtagaattcaaacattaaatgtagaatgtactagtattctatgccttaaacagttgaaaggaaaggcttacattggcaaaatgtatttcacaccaaataatgatcctaaatcagtcttttgcaacgtcataagatgcagctttgtaagtatactttatttctaaactttaccaatctcaaaggctacctggagctcttatttctgaaataatttcaagatgttcattctctacagttttgtggtatgattaacttcgaagtccactgcagacacaaatgaactttccctaaaatgcaacacgagagtactaactacagtcagtaaagatgagagggggttattttgtagctcttcctgcaggctgtgagaatttttttcgttaaaaaattcgttaaaaaagcaggatatactgcttcagtccttaccatgagagccactcccatcggaacataaattagtcttagtatatttcaggttctcccacatgttcacattccaactgggtgcaacagttgacttttgtctttaactttccttggcaaaccgatagcatcagaggaagagataagctgccccttagggagctgattgtaatgcgttccagacgtctgcacgcccctggtgcaagcaccagctttctgttaaagactcagggttatgttgtttggatgttttgttgtttgctttttgaaaaagccagatcagatttttgtcattgtataaactccagtaggagaagagggatgcgtttttaaggtgatttctagaatgctctggccgacttagctgcagaagaaaaaggagaaaggaagagacagtgtatattttggcactgaaacttctttagtaacaatgcattcattcacaaatctggagagaactgaatgtctgctttttaaagtctgaattgaattctcgactagactttgagaccctgagaaggttttcaatccaaaccatgcttaatattcacgttttatcattattgatggaaagtgaaagaaaatttgaattcttggtagccagatttgacattagacttttacatttataacctcacttaaactttacaagaaatctcattacaggtattattatccccatttttaaagcaaaaaaaaaaaaacactgacccttggaaagaagaactggcactattgagattcacaccacgtgtggctggctgcatcagggggctcataaagaattcagagctggcccccagcttatcttccccattccctcttctcacccccaagctacctccattaaaagagatgccaggctatatttattttattatgtatacttacgaatgcatttgctcatctttggtgtcataaaatacaatgaataaactcctatccagtttttcagtgtatttccttaatttttaaagcaataaactcctttaatcctcccttatactcaatactaaaaaatgaaagatctgattttaagcaggaaaagttttgtcttagcatatagccaggaaacttcatctgcctaggtcctgaaatgtaagtgatctgccagaaccaagcgtgggggtagctcgcgaggcctcagccctcctgctcctgtgtgagagtgctttcttctgcaacctggctcctggaaggaatgaatgctcccccttcagcccctactccccaccaagaatttaaaagataagagggaaacatttccctgactctaaaatggtttgtttttaatatggtatgtccaggcctgcactactaaaatccttcataaaagtcctctagaagataacgattgttcacattgcaaacctgtttgaaaagcctggaaaaaatgcggtatactgtagggaaagtcagtctccttttctcacttatataatttgtaagtctgtcatttcttttttttttttttttttttttttttttgagatggagttttgcttttgttgcccaggctggagtgcaatggtgcgatcttggctcaccacctccacctcccaggttcaagctattctcctgcctcagcctcctgagtagctaggattacaggcgtgcaccaccacacctggctaatttttttatttttagtggagacggggtttctccatgttggtaaggctggtcttgaattcctgacctcaggtgatccgcccgcctcggcctcccaaaatgctggaattacaggcatgagccaccgcgcccagcctaagtctgtcatttctaatatgctctcctagttttagctcagtagtagctgagtattatacaaaataagctctttttactgctgcttagcatgtgtctgcgaaccctagctcagtacctggcattccatgggcaggcaagaaaagtttgcagaatgaattaatctggcccaagtgtgactgagaggccagaggaggtcagtgggtgccgtctcccaggccagcagcacacacacagcttcctacagtctcccttcttgtctttgtctctttacatcctcttcccttcctcccatgtgtctctaacctgccaattgcaccaacatttattccctgctgcagagcctgtggacccacagtctggcttacctttattttctccatctccagaatatgtctctcctccatacccccataaattaaaagtgacttaaatatataaaatggaagagagaggcaggataaaactgtttgataacttaatagtacaactggccagtctctcgtagattttttgcattcattccaaacctgttttttgttttgttttgtttttgagacggagtctggctgtttcacccaggctggagtgcaatggcgcaatctcggctcactgcaacctctgcctcccgggttcaagcaattctcatgcttcggcctccctagtagttgggactacaggcgagcaccacctcgcccagctaatttttgtatttttaatagagacggggtttcaccatgctggccaggctggtctcgaactcctgacctcaagtgatccaccctccttggcctcccaaagtgctgggattacaggcataagccccacgcctggctgaaacctgtttctattaaaagacttataccttggaactttaataagtaatttattaaagaaccgttaatattagacattaaaataattatgactcccttacccctatttgataagcatataggtgacgttacactaaatactatccctgtctgccaaaataatctaatgttgaagcagtccaccgcatttcaggtctcctggaaatgtgctgcgattttctgaaaattagaggcaacaacttgctgttgaggacaggaaaaaaagaggaggctaagacgcaaggtcctctgaagcttctgccagctctctcaccagaacctaactcttgataccagtggagtgaatctggaagtctcctgccttcctgagtgagttggagacgtagacactacctggacaggctggagaaatgagggacttaaaacgtagcacaccccttgccccatgccacctgactagaaatgcctgccaaaggtatatggacatgcaaggctggcacagatgtaaagctcaatatattaaactagatagcaaagaaatatacaccaagcccagcaatacaaagcaccctgccttcatgcagttaaacattcttctgttttaggccacactgtacttgctggcttcatgtggcttcatgaaggcaagtgctgtgtctgttttgatcactactagatttctggcacccaacatgtagtaaaagctcaatcagtatttgttaaattcattgagagagctgggaaagaaggtagaatgaaaagaaaagaaaagaaacaaacaaaaacacaagcctgggcaacatagctagactatctctacaaaaattagccgggtgcagtaactcacacctgtagtgccagctactcgggaggctgaggcaggaggattgcttgagcccaggaagtcaaggctgcagtgagccgtgactatgccactgcacactccagcctgggcaacagagtgagaccctgtctcaaaaggaaagaaccatccacaaagttagtagtgcctacaagagtgtagttgctctttaagcttgaatttttggttattttgcaagaggtattatttgccttaagccatggtaattagatttattctgctttgtgggcttttagatgagttaatcggctacaatttctcttaattccctctaatgctttctaggtgtggatatcaagaaacctacatgttgtgtttagaatattttatgtatcacagatatcagtgggtagtagactttgcactggaattgcccttttccctgcctcagttgtttttggtaatattaactctttatttactgttaaactttacaaaaaatgtcaagtttactttttaggactaataaattagttttcataattttagccatttaggaaaaacagaagaaaccacattgcagtgtaaagggagaaaagtcacacatagctaattattgataggaaaatgagaagtgagatagcaacatctgagaggacttcatatatgagcatctcacagagtaactttttcttttagccagcataattactagcttttcccatgtgtgtacagacatttttttccttagaaattttggccttaaaagtcaaatacaggttgttttacagatgatcaatggtccttctagaagaagtccacagaagctctcagatgccctctagaccagcctttactcactcctctgtcagcatcctccctcccagctcgcattttaccaaagctagaaaagaccctcaagggcctgggtgcgtggaattattagagaccagataaaagacatgtaaggagtgctggtgtggcagatgctgcgaaaaaaatgtgccacaacctctgagggcaggaaactgaaagacctcgtgtggtttggaggcctgaggaaagagcctcaggaagtgatgtttgacctgacatctgaaggctaaatgggagacagagacaggtgtgcagtcaggaggaatcgcacattgaagggaagggctgagactctgagaatgggggtgggagggagaaaagaagaggctacagggggcgaccaggcctggtgggccaggtgaaggaatttggagttgatcccaagagcaagcgaaagtcactggggacagggaagtcaagagtcacaggattccatgtggtttttgaaactggctgcatggaagagaacagcgtgtgggagaagtgtaggagagggaaaggcaggactcatgatggttgagatgagacggatggagacaggcagctctgacttctgcggttctgacttgtgaaacaggatcagggatggtgccactgactaaagaggaagagaggattccagtaacaactaagcactattctcttttaatctctgcaacagccctactctgtgggttctattattaccccattacatagatgagaaaacagaggtacgaaagattaaatttgtctagagtctcctggtaagtgttcagtaaatgtttgctactactgcctctgtttactcatggagtcattcattcattcattcattcattcattcatggatggtatgctgtatctaagataatacattgttgaacagaatagatgtgaactctgctcttgagaaagactggtagtgggagaaaaagacaataaacaagcagttatcttgcttggacaagctggtcagggatggtaggacggtctaggtttcttagactggaatgttacaattctagctcttgcataaatcttggatggatatacagaggaaaaatacgtattgacaaagccaaaaaaatgtttcccagatgttctctgaggttccacaggcatccccaatgagttagatcagaagtaggccctgtgccgattttgtaggtgggaagctgaagatgcaagaagagaacagccgtgcagctgtgctgaggtctcaaagagcaagggttccaggtgccgccgctcctgctgtccagcaggttcagctgcctttgggcccaccaaggtaggaaatggcccatatctgactgcctctgtacaggtcaaatcacagctccctgttctctactatatatagtaacgaccttacataagagtgctattaaaaaaggacgacagagaggaaaagagaatgccagctgaattttttccactaaagctcatttttaacagatgtgttttctctgtttccacaatgacagtgtaccaggggactgttctccaggtcaggagggaagcaacccaggtacttgtaggactgtaattgggtccgtctgtgctgagcacaacaataaaattacttgtacttccctttttatttaatgttactctcctcatcagttcccattttcctgatatttgtgggaaggaggccatgaagaaggatgaaaacactgtaaaaataatttaaactaaactttacaatatatttgggataatgctgagaaggaatgttcttttttttttttttttttttgagacggagtctcactctgttgccaggctggagtgcagtggcgcgatcttggctcactgcaagctccgcctcccgggttcaagcgattctcctgcctcagcctccaaagtagctgggattacaggcacatgccatcacgcccagctaatttttgtatttttagtagagacaaggtttcaccatgttgaccaggatggtctcgatctcttgacctcgtgatccacccgcctcggcctcccagagtgctgggattacaggtgtgagccacctcgcccagcctgaaaaggaatgttctaagttcagcaaaatgagtgattaacatgtaagtggtacgtctatcttaaatgctttaaattataattcatgattttttaattaaggctttcttattccatctgatctcttatacactctagtacccagtgatacacaaattttgttaattttggtaagtcagtctgtctgtgcagtgtgtgaccttgacattatgtaatatgaatgggatggctacgtgttcccttttccccaggacagtcaatctgccagttgtctagagttctatatagttcagcctttgtcccagattaaagggcccacatttggacactgaattatttacatgaccgtcctgaatactaatagctcacatttatcaaaggcatgcttgaacattgctcaaaatacttcacatgtactaccacatttcatcttcacagtctaggagggaagtgctatcatgacccccattttatttattttagattcactggttacatgggcaggtttgttacaagggtatattcatgatgctaaggtttgggtttccattgatcctctcacccaggtggtgcacacagtacccaagaggatgtttttcagcccctccccacctccttctctccccacttttggagtacccagtgtctgtcgttcccatcttcatgtttgtgtgtacacagtgtttagctcccacttatcaggaggtatttggttttctgttcctgcattaatttgtttaggataatggcctcgagctgcatccatgttgctacaaaggacatgattttgctctttgttgtagctgtatagtattccatggtgtgtatgtaccacattgtctttatccaatccaccattgatggcatctaggttggttccacgtctttgctgttgtgaacagtgctatgaggagcaagtgtacatgtaccatgtggggttttttggtagaatgatttattttcctttaggtatatacccaatactgggattgctgagtctaatggtagttctatttttagaactttgagaaatttccaaactgctttccacagtggcctaatttacattcccaccaacaatgtataagcattcccttttctccacatcctggccagcagctgttgttttgacgttgtagtaatagccattctgactggtgtgagatggtatctcatcgtggttttggtttgcatttctctgatgattagtgatgctgagcattttttcatgtttgtcagctgcttttatatcttcctttgagaaatatatgacccccattttaaagatgaagaagcaggttcagaaaaattaagtgatcaaagaaactcagccagtaaataatagagtctaaaatttaaacacaggcagtctaactccagagcctacatggctaagaagtacagcattacctttcattcctaaaccagttaagaagtatatgaataaaactcctagaggatggaagggtcctttggaactgggaagttcttggagtccttgaatagaaatgctttcccaatttgccagtgcaggggccctttatgggaaacagtgaggaccatccaacagtccaattaactgagcacaaagcacaaggcatatttgtttttctttcttttgaaaacataaatgttagaaaagttcagaaatgaagagatttagaagtataaacttataactgttggaaccatcctcgtattttctagaccagtcttccttctctcgacaacccttctctcatggccattcctcgccctccatgttttcatgaacagtgtgattgactactctgattttgttagctagccaaagtggaaaatgagaactcggtgagtgggctggtgtatgctgcctgccagaggcagcgctctgtaagacgacttcattgtttgcttaccctaatgctccattacatctcaggatttatttataaattatttgttttaggatatggtactagcttcatgaaccccattgtagacttcacatttagaagtgttttttccaactcttttttacttaattttcatgagaatagtccttacgtcaagatgaaagaaaggtgaaacaccaggtagaatcagcaaactgataagcagccctgtttaaatccatggaaaggtaatgtttaaagaagacatttgttttaattgatttttattttacgtgtacacattaacttcataaatcttacctttcataccaagaagcctagatcagctagcgtgttaatatgctgacggctgagagcaaaaatagataacctaaagttgtctaacaaattagacatcacttaagaggaaactcaagtgtgtttcagggagcagtggcagatctgccttagatttttaaccactgcatcatcctgttaatcaagatcaatcagatacaaaaatctttggtcagaaccagtattacaaaagaacctaagaatttctgctttctcatctttctgtttaccataacacaggcatatatccaaaaatatatagaaagcaaaaatttggagagaatgacatgcgctttcctaaatgcaccttaatgctttccctggtgttactattactactgttggaagcatcactgttgaaatgagcctgtacgtcacacacattgctccccacacagcaacacttctgatgagggcagccccctgccttgttattcattgagaaatagaaactctgattatttagagcaaaatttcagatttgaagaagttttcctaataaggaagaatgatgtaattttcatggaggggggccaggttcccttcatttgttttatttatattagctgaattccaggggaaaatgggctatgaagcatgagggctgctaactatatttagccacacaaagttagtacatcaggggtcattttttctttaagttatacactcataaatgggctggaagatatttttcccggcatcttgtttttataaagtttgatcaagcataaatacttttattaagatgctatcttttatttcgagtgtgaagaaagtatccattgtaatctctttaatttggcatgtttctctgagatactggtttttgggtcaaaagatggataactaataacaataccttggttcagaagattgtattaactttccagagtgctcacgcctgtcatcccagcactttgggaggccaactcaggagaattgcttgagcttaggaattggagaccagcttgggcaacacagggagaccccatctctacaaaagtaaaaaaattagctgggcacggtggcacatacctgcggttccagctacttgggaggctaaggtggaaggatcacttgggcctgggaggtcgaggctgcagtgagccgtgatagtgccaccgcactccaaccagggcaacagaatgagacccagtctcaaaaaaaataaaaattaaaaaaaaaaatccagagtgggctttaagaaggaagcaatagtagtttcttggaagaaagataatgtgtgtttaagagtcccgttctgcccattgtctggcactattcaatctggattcactcccatccccctcaccttactctaaatataaaaatagtcggtgcgtcttaagacagtagactatcatttttgtacttttgcattaagacttttatttaaatgtatttataaactggagaaaaatttgtagcatttaaacataaaacctcagcgttataattggtcattccttcctcttgtcaacgtgttacaacatttttgctttgctctgttacatgactcggggcttacctgcatttcacgtgagagaaaagtcaaattcatctccaccccacagcctgctatcttctgccttttaccctaaatctttggaggcgacagcttcctccccatgactgatagttatccatgctcacagctgctggcaggactgactcctttacaactgtggccttgtagttgatctgaacaggatgatcctgtctatggaagcggagtcttctctcactgcctgaaggagaaggctctgctggagatggagggctctcatctgtcaatgggtagcaccgacggtgccccagacatgctgaccatgtgtggatgtcttagaagagtggaaaggcttgagaaatgcaagcttagaatcatttctaatattacttgatgggaagtcagcaaataggaaacttgtaaaaaattggaggacaactttttgccactatcatggacaaatctatcaccactaccccaaatatcggtccctcagagaccaagtccttagattctgaggctctgctgtataattcctgttcagtagagcatctggcgaacctctagtaggacaaacagacagtaacccttgtgagaagtgagggaacttttagaactaggcctcaaggagcactgtacagtagaaacagaatgtgaaccaccacaatgaagaccacatatgcagtttgttttctagtagtcacattaaaaaggaaaaagaaattaattttaatagtacatgttgtttaacccaatatattcaaaatattattttaacatgtaaataatataaaaattgtcataagatcattttccaatatctttttaaactaaattttttaaatctgctgtgtacttgacacttacaacacgtctcaattctgactaaccactgttcaagcacttaatagctacatgtggctaatggctaccatagtgggacagtgcaggtctggaggatgtgaaatcgggtgaacacacaacctttacacccgaaacagtgctgcagaattgatgataattactctaaatgctcatctcttatcttttcgcgtctgaaaactgctgctgagtgtacaaaccaggtaacagtaataagggccaatcccagtggtagaaatggagttgatatggtggagaaggatctgttgacaccagaccctcaaccacagccatgcacagctggacagaagccccctcggactcccaggtctggagtcggggcagaggcagaaagtctaaaaagaaatacatcagtgtagtcatttcagtaataaatgctgtgaagtaaataaaacaagatagtaaaagagagatgggagtactcttcttgctcactccaatagttgagtgagtcatctgggaagtaagttgtgctgtggagtgtgaaaggtgattttaattcagcctgagagccaggcgcagtggctactgcctgtaatcctgcactctgggaggccgaggtgggcagatcacttgaagtcaggagtttgaggccagcctggccaacatggtgaaaccctgtctctactaaaatacaaaaattatctgtgcctggtggtgcacgtctgtaatcccggttatttgggaggctgaggcacaagaatcacttgaacccaggaggcggaggttgcagtgagctgagatcgtgccactgcactccagtctgggatgacagagtctcaaaaaacaaaaaattcagcctgaggaaaatacttcctctagtcctcaacgtgactaaagagatcctcatttttctttaagagagaatttcattatttgaaaacacaatgcccaaagaaatggaagaaattgaagaagctggtttctatgtacttcaaataatattttggtgtgaggccccacatgacaacatctttcccccaggataccacagctgacatagctaaaatatgaagtatggcctaaataatacacagtgagctgataacttaggaaatattttttgtttgttttagccaaggcaaacgaattaaaaattttaatgttttgtttccatatttgcttaagtaaacttcaaaactaattacttgcaaagaattttgcctcggctacatggatgaccagtgaatgcttttgggagtgtaggactacactgaataatcgaataaatctattgaatatggaattaaaaaaaaaaaactaagtaaaaaagcattagaaccaccatacagcttatatctatatgcttattatgtatgggctggcttaggagggaacttgagaaatggtaacagtatttggttgatgctggagagggaaattggactgggaagaaaaagtaagagatgaagatgtactttcagtgttctctttatatcttttgcattttgaagagcagaggtttttaattttgatgaagtcccagttcatcaattttttttctcttatggatcacccttttgttgtcttatctaagaaatctttacctaacttatggtcacaaagattttctcctatgattccttcttgaaatgttatagttttagattcacatttatgttgaagattttttttaatttttttttatttttttagagatggggtctcgctctgtcccccaggctagagtgttgtggctgcaagatcatgacctcctgagcccagttgatcctcccatctcagcctcccgagtagctgggactacaggcatgcatcaccatgcccagctaattttttagttttctgtagagacagggtctcactttgttgccaatgctggtctcaaccttctggactcaagtgatcctcccccttcggcctcccaaagtgctgggattacaggcatgagccaccatccctggcctgttgaagactgatattagttaacttttgtataaggtatcagttgtgagctgaggttggaaatccaatagggtttggaggggttttttgtttgtatttaatcatgtgtattctttaaaaaataggatttaatttcaagagattaaaaagaaatattgtatagaaatgtctgcagttataataagtagttcaattttaaaaagaaaaagttgttttgtttgctttgttttgagacaggatcttgttctgtcatccagtctggagtgtagtggcatgatcatggctccctgcagccttgttctcctgggctcaagcaagtagctgggactacagactcacaccatcacacctggctaatttttttttttattttagcatagacgaggtttcactgtgttgcctaggctggtctcaagatctgggctcaagtgatcctcccacctcaacctcccaaagtgctgagattacaggcatgcaacactgtgcccagccaagaaaaaagttttattatgactactgtactgattttcaggaacagtcattgtgctttaattctctaagccaaaaatgtccaattctgttgggcaaaaagactatgttgttgattgcgctctctcatatggtcccttgccttcagccattttcataatcaaaacttgatggcagtattttgttacagggtaagaaactaaaaatggtaaaagccatttgtcagggtaaatctgaactaattatttagatcagctgaaataaaaagggttacaaagacaagttttctgtcttcaggaggggatgtggatactaaaacttcaatggaaatgaaaagatatggataaatttgcatctgccagatctgcttagggaaagcatatacatgaagtggaggaagtcttcccatatcccttacataaggattgagatctgctgccagagacacatgttgcaatatcaatagaaggtcgtcaaattgccttccatgagggagtgggtctgtttaatgctatcattttgtgacattgagaacacgtgaggccacccacaccttctctgcccttcaccagagctggggccagcctcttccgataaatgctaaataatgactatcgctttgaaggtgcacttattagcaagggagtccatgtgtctagggttcttttacgccattacagtgtatgaataatgtacatttgacgggggatgatcctctcaccctactcaagtttggaaccatttgacagataaactgaggagtcagaaagagatccaagcaccagatttgtactggggagaactcagagaagaaaggggatgcactgctgggcctcatgagttggcttatacttcaccttgagctaagcatactaatacccagtccaggcagcattgaacagctccgcgcagatctcaccctccaaaaaacaggaagaaaaagccctctcactgcaagcaagatccaaagagagaagagcaagggaggggctgatgtgagcatgcccagatccatcccccacccatattcgccaccaagggcggagacaggcaaagagggcccctgtcctggaaatccctccatgaggaagcagtgaaggatgcagggcccactctgtcagtgtctagtgttccactgatcctacatagtaattttgaaagacgatagcatgatgttcctgaaaggaaaaaaaaagtttcctctatgaggtcattaacatatatcttgagtgactttattgtcttctggttcattttgacatttttgtaaattctatagatcttttatttactcctgtgatatattttaaagatcaacaaatgtccacaccaaagaaaaaaatcaccagtaagttcgtaacttttatatttctatacttttaactgttacattaatcctgtcttattcaaaaggtattcaccacaaaaatacttactaatcttggtttcctggtatgaactccttgtgcttctgagattagagatacgcttttctttacgggtggccacaatcaagagataagatcatgcctaaaaggacaagttaggaacagaagtgtgattaagtatattctgtattagttttaattaggactatagtcctttaacaatttcatcatatttaagcttgaaaatatacatgattgctgataccactatagtcatatacatgtatatatgcacacatacacatgagagatgagactgtgttactcagacatagaaccacgggacagtcagctacacattacttctaggcaatggttcatcttctctcttcagggaaaaagtaacccttgttggaacctgacagattttgaacatatcttttctttgttctttgtaatgtttatctgtattcttgttagaaacgactttctggttcagttatttaaaagattaagccttttagtgaaagaagttctcaccttggtgtcatcacttgagaggctaagagtgaagcaacctagttactactctgggctctgttggtggcctcctgtgtggcactgcaccaaacgtacttattactcagctggatgagatgatcccggttccttccatccacatgttccatgctttcctgtgtatctcggcgcacagatactatacatacttcagtggctttttccgttgtttaaatcttaaaaagaaaaggcatattctggtgtatatactacttccctaaatgaagggccatctactatataagtcttacagtataatcatgaaatccagatgtggtgtgcaacaaacttcattatttacatgttttggaaaagattaataaagtacagcaaaataagctcaatactacagctgtacacactatactataaagtattcttcttttgaaaagcatttcaagattttgcagcatttttattgtattggaaacagtcacagataccatattatagaaaactctgtttgacagaacgccagatgaataactgttgactatacacagtcatatataaccacattggaaacttcatgtagctatgataaatttctctcattttttccttaggagtaattacattagataattgaactgtttcatctaagaatttattttcgtggttttagtcatttctcagggagggagcctcatttattacagttctccccaagacacactggatagacttcatccactgctggaaggactggtgctgccccctgaggggaaatggctaggcagcactgtcttcactgcatcttatcctttggcctctaaggaatgtcaaggtcagctggtcaaaagctaagaagggccaaagccatttaaaatttacagttcttttccacggtcacaagtctcttaattcatgctgctaggctgcatctcttgtgcttgccaaaacgcatttttgagctttttcaagaactttctccttcttcagaggagaggttgggaagggagtctggtgatcaggcaagccctgcattcacaccacggaccctttggcttgtatatcttggccattagcatttaaactatcaatggtagacttgtaagaggaaataaattgctctgagtatccagatccaactgtgcattcctcacattgattgcaagaccaaaatatgtagaaaatgttattggcaacattatttattcaaaaatgtttagttcttcagttataggcctatgttaatagaaatttgaaaagtcgtctttatagtgttgttcaccatatgatataatgtttctaaattgtatcacatttagtgatacagtatctcaagagatggaacagcataacagatgagtaatattagtgatattcagatgttcaaatgtacaatcttgaaagactaaagaatgaatttattagcatgggcacattttaaaaatatttaaaggggactatttaaaaataatcctactatactgcaaagatatgaaagaaagaccgagaatgatttagtgaaggccacacagaaaattggtggcacagtcacttctacccgggaaagtactaagtagcccagtggcagcagatgctaaaaaagggctgtcggtgatttaaaaacaaagctatttaggccatgtgtggtggctcacacctgtaatcccagcacttggggaggccaaggtgggaggactgcttgagcctgggcaacatagtaagaccctgtctctactaaaaaaaaaaaaaaaattccactgggtgtggtggcacacaccagtagttccagctgctcatgaggctgaggcagaaggatcagttgagcccaggagtttgaggctgcagtgagccaagatgacaccactttactccagcctgggtgacagagcaagaccctgtgtcattcatgaacaaacacataagtaaataccaaactatttttaagaattcaaatccaattattttggaaatgattctttttgtatttatttttttctaccacaaacgtgttcaaaaaagagagtgaaggacagaaccataagtatgtaggaacttccataccatgaaattctatggtagtatttattgcccttatgtgatatatgtctcttgatttttctcagaaatttgaattaatactatacttggaaaatgtgaagtaagaacctttatcaattggtttcatcttcctgttcacattttggatatacaatatttagctgtaaacacatgatgtttgtttagtagagaccaaccattcattagtttctcaatataatgaacgctagttgatggtacttacactgaagtaagaaattctggaagcaaatttaatttcttagtttcaaagtcagctcctccaggttgctttgtacattcttatagtttttccaagaaatgtttttaagtctagcatatgagacataactacctaacattatatgcatggaatgtgttcaggacatagcccagctgtctctatagctgttttgggtgccattgcaatatctgtatctcaataacaaagaaatagggcataggaggggcagacttagagccatagtcttgagtggagcccaaatcagaaaggtcctctgtgtctgaggaagtcgcattgcacatggtaaatataagataagtcgtggtgctttggttagagacatggtaacgtcatggtcatgagccagagctcctcagtttaaatcccgtctccacttctttccagctgcataatcttggacaacttactatatatctttgtgcctcaatttcttcatctgtaaaatggagataataaaagtggcctctctcctcgggtttttgtaaaaattaaatgagtttagagggaaaagtgcttaaaatggtgtttggtacatagtaagtgctctatagcagttagctctcatcactagatgtggtgacgctgttggtgctggcagtagtagtagcaatagtcatgcttgatgaaattatttggaaaaggcctcccctggtggctttaaacacaggaaatggatgaatggatacccttctcaggcctccaggatattttgttactgtctaaggcctccttttaagttacaaacttatggagttttatgttttaagagtctttttaaccactatactttttatatgcacatagttaaaaacagtcaaatagtatagaagagtataaaatgcaaaaataaaagatgtcccccctccacctcattctagtcttactttccagaggtgaacactttagactatttgtttttagcccttctggtggtttctttcacaagtttatgaacaatatatgaattcatccatttattgattcatcaactgccgatagtgctattagattaatttttatattgttcgtaccagcaagatgttcttgttgggcctttggtaccaaccagctgataacagcaatttcttgatctccctgtgtctccatctacatatcataaaataaggatattggacttgttggtttccaaggccactttctaaaaagtgttaagagaccatttgaactaatttaagtgaagagaaaaaaaaaaaaagaaaaaaaaaattctgagataaaactggtctgagggttatctggatccagcggctaaaatagtattccaattttaactgcgtctctccctttttcttttatataaggaattggctgctttttatgtactggcttcctttttgtagacccttccatgatggccaggaactctaggtgattctatgcttctagacacatttcccttccatcttcagtacgaaaagtcccagggaaaggccctgcttggcctggcctgacctggattatatacttatccttggataatttgctgaagccatataccagttgactagtcctggatcacatgctcaccctgcaaccaagggcaagaggattgtgactggcagacccacaaggaatagggtagaagcgtatctgtaaagggagggaggagtgctattaccagatgaaagaagaatggtagagaataaaaacagatgtctgccacacttggagtttcaggaaattgactttaagaagaaactcattcaattctccacctactagtgagtcattacttgcttgtaagaatgcttactgccacacattcaaccattggcctcattctccttccagaaataaagcatgaactccacctacacattctttaacttagtatcagccataagcgattcctggcagtacttcacaacacttgaaaaatgaatacagacatcagtgtgatgttccaggcagacatcagtgctttagcttctagcctcaacacaggcactcaatgcggccttgttagaaacactctgtccggtcttttatgacttgctacactacacaatggacacacaagggaactgtttcctctctctgtatagggaccaactttgttatctcaggatacagtctatgttttgaaaaagtggctgtagaacagtgcagggatgggaagaatgggtcctatcaaagaaaagaactgcctagagatgactgaagttctcaccaagtactgaaaatatccccaaggcacttctcttcaaggtaaacataaacttattgcgtttttgactgataaccaaatcaaatggaaaatgggcactggtacaggctgccactgcctggaacatgatggagcgcctcacagatgccagattaggagctgcattaccaggttcacaaacgttctcattcgggtttgggagtttcacattttggatactaacaagccagaaatatataagtactgttacttataagagctctgatacatatatatctcctttattagaagatgcgtttccctttcctgtattccacacaaaaggatgcctggcaatcttttgacaggtagtaagtgacatctatgtgcaaaacactgtaataatcaagaagatagaacacatctggctctgggcgatctgggctggtgtgtgagatgataatgccactgccaaactgacagtgccatgccagccttgtgggctggagtagtatggaggagggagtaagaactgctagatgttactagggagagcttcaagaagaaatgggcattgaaatgggcacagaaggatgaagacagtggatggagagaagttggtgggggtggccctccaaaagagagcagtgcatgagaagaggccaacaggaaggaaaactcaaaatgggtttggggaacaataagagtaacaaacttagaagaatgaaaaggtagagatacagcagcattagttggagataagattgttaggactgtttgaggccaaattatgggtatcttaaatatcagatattattttagggagacaagttagatcagggtgagaggagctctgtctagacataagtttgaagtgaagtagcacatttatgttacatggaagtggatagtggaattcaggactgagggctgggttagagagatcagggagtgagagtgatgcagctgactgactccttgtgcaaagaggagtgtaaagtttagatcttggtaaggtacccatatttagagagatggagaaccagtgaaggaagtaaggcacagtcccagaagtaagagaacaaggagagttgttagtgatgtcaagggagaagagtgcttcaagaaagatggagtgggtgagcccactgtcagaggctgcagagataccaagaatgaaggcagagaaaagccatgggactgctgagcatagcacaaccctatcttcatatttgaatgaaatgtcaaagccaaaacatccaaaagagtagtggcagaaagaggggaaagggttattaacagaaccttggccacttaccactgaaatagtttccatgtttcctttaagggaaagcattatagcagaaccacatccaactctagccccatagaaactattttgagacacacaaaacctaaaagctatttttgtcttgatctgggtagaatttatctataggtatatctgtcttaagaaaaaaatgcaattgacgttagctagttagttgacagaatattcacagaacagattattcacagaatattcttccttttgtaagatttaccatggaattgtttttatctgcctctcgaatgcctttaaaatcttcttctgttttccaaaaactgatatatacgtttttcaaaaacagtttaaataggtgtgaaaacagcatatgcataaggttaatatatgcacacacacaaataagtaccatacttggacttgtttagttgtccaagtttaccagtgtctttgaaatcaggttctttataatatttaaatcttacagggctaaagaggacaggtcataaaatctaaaagtttattaggaccttaaagttgaaaaactaccccagaaaggataaataaaatatccaaagtcataaacagaacgtggcagagcaggagccacactatttgaacgtttctctactgggctgactccatgtttttacttgtaaataacctgcatgatagtggctttatttctaagaatactctcttaggaaaatgcaattgtgtgttgctgaatgccatagagcttgatggaacagggagttttacattgtatagaaatctagggatttgacttcaacagatatttattgagtggcttccctgtgagtaaagaggaagatactgaaaatggagggctcagcgaagtgggaggattgctactttttgtaaagccatttggggagtagataatggttatttgtttggaaagagatgacactctgcccttagtagtaatcgactcttataaatactgactgcataccactgttttggatgtattcaacccagcaagcataagctatgatgggactgacacaagggatggcaccagccattgtgtgatgaatgaaaatgaaaagttggggaaacattaaccatatgaaaccttaaaatatgccaaattcgtcatttcattggaagacagaaagtgaaatatctgtctgtcctttcttccctaattcttcaaaatctcagagaaattttatacttaagaccttaaagtttctcaacatctgtctcacagggagcttttccttggtgtttcaattagaaatgagatcactgattttgcttcaagcattgaaaaaaaaaaggttgaaaaacagattttttcttcaaaaatgtactttgtctatgttaagaattgaaaccaaacattttctattaggaacagtcggtattaattcattttaatgtccactaaattagcatagtttttataagaatcaactaatatcttcctgctgttttcactggccttcgcatcagtagaaatgaaaatcattttgggcatttaactgtgatgcagagtcaactcttttagaagctgacttcggattcctcccccaaaaagaggctgggactgaagcgccagcattctgtgttagattcctcaggcacatcacaactgcaggcactggcaaagcctgtcccttatcatatgcaatttatgtcaggctacaaatcctgctcttctggtggggctataaattctttggaccacatcctgcagccctctcagagccaaagtgaccatttaccccacagagagttggatctccacagacctcctagatgagacatctcaacatctggaagccagcggcaggagtcaacttatgagaaacagttcacattgctactgacccttgaagagcaccatctcccctacctctcattcctattcttcatgttacatgagagactcagccatcctttgatattccagagaagttcccaggaggattaggaattggtcatcagttgctccttctctctctctctatcggtacgtggaatgacttcaaatagagatcaactttatgcattaagacatacaaagctactgtttttctgtggcagagccaaatatggctcttattctaagtacaaaggaaaagtctctctaaaagagactcaagtcatgtgctgatttcactcaggtcacttctcccttgagccctcctccataattgtgttcagttctggctttgtttggaaagtcagcacaatttacaaaaggttcagaatgcattaaaggtcaaaaaatagggctttgtaaagaaacctatgtccttttgcaatacattttaaacttatacataatcccaagcagtaatcaattttaattctagcatttttttgtttatggtactttgtagaaaatccagatttttatccctgccttctcccccaaccttaggggaatgtatttgaattatttttgcactcacaacctcccataagcccagtgcaatacattctcatttgtcttttattaatccttactgtgtaaataaatgatcattcttaagattgggatttatataccttttcctaaggggcaatcataagttagtgctaaacaaatcaagttgttagatattgaccttcatgcagtggacctagcttctgtgatatgaagatatcaattgagctctgagtaatagaattttaaaagacaattgaagcattactataataaagttatagatggaactgaatcggtactacctgagtgggaagcccttgtaggagttttattttctattttatacattcccagaattgatacattgaagtctcatgcatatgatactgagctaatcttagccagatgggaatatattgtggaaacacctagcagcttacccctaattcacttacctaccttcatttgaaaattcttaagatttcccagtccaatatgggaccctcctagtataggaatgtcctactgaatatgcctgatgaacccaatggggtacagaattgcagtaagaaatttatatcattgttgtcattgacagtgatgagtccaccatgtttagtgtttggccaggtgctgtgaggatgccgaaagttaccctccttacttttaaagtgcttataaatatcaggaccagaggagcttatggttcagagggtgcagtcttgcaactcttcatacaatggcttctgtcatacaatcaaatattaaagaaagcatataaaccaacagcatatttattcatagatcacaaatgtttttcagctttgtgatctcaagagtttttctagacaattacgaataccccatctttattatgagcaggggataaattacttgcaatccagatattgctccagagagacatatcaggaatttccaatttacataaaagttgttttccagaagtttactttcacatcatttattttaaacttgggttgcagtttcccagagaaaaagtggtatgtagtaataatagccaacattttaacaaacgttttttgtttactgagcactctatagagaatgatgtggcaccaggctttctgagccagccagcacttcacatccaggttctgcccttggacacattacttgacctcactaactgatggtgaattttttaaatggggataaccatccctgcctcctagggttggtgtgtgtctccagtgctaggcacgtgataagtgccctatggcttcgtgatgaggagaaggcggaggagcagtgctaaaaccagccatcttagctggtctcatgacagccccatctccagttccccatttgcccacctgccactgctgttcccctgccagccacttgcaatggacataggtgaagagaaacatcccctgcaataagtaaaacattgttcttgttttaaaagttctggtttgtaaagtaaccagaattgatttgattttattctgctatgaaagataatttattgagctcatactctgaaccaggcactgtgcccatttaattctcacaatgaccccacaagctagtagccggctgagctggggttccaagccagttcgatctaactgtgactctagccctttttgtcatgtaccattctgccacttgggacagtgtttttagtgtggttaactttttctgaacttgctttaatctagtggtaggagagatgactgaattagaaaataaattaggtcatacacctctccttatctctgtcaaatctaaatctttgccccatccaaccatctgtaaaattattcttgttgaaagctttctgcaaaccactggggtagaggagttattttctataatgtatgaggggaatctattgagttagcatgaaatcaagtttgaagtcagatattcttaaatatattcttaaatatgtatttaaaaccttaactgatgattcagatcctaaaggccctggatgttacagctgcagtaaggtataaaagtgaataaagtcctcagaaggaaaatatagccacagatttttttttttaagtcacattgaaggtcagggtccttttatgtgttacatgcctgaagtagtgtaaagagcagggacagacacaggttctaacctggctctgcaggtaacttgctctgtggccttgagtgttacttaaaaccagtcttcccatgtgtaagtggactgtgccaggtctagacggtcccctttccttcagtatcaaaacttttagaattgaaggatgggcaagagtggggaatcgcttagattttttgaattaggggtatggaggagagcggggaaaaaagaagctgggagaaatttgatggattacttgtgtaagaccaaagatttaaacacatgacactcaaagtacatttgcaactagggctatctagaacgcttaacttgtcatactatttggaaatacatagtatttccaaaatactatggaaatacatactatttggaaatacatagtatttccaaaatactatggaaatacatactagttggaaatacatagtatttccaaaaagttcagtttcatgttttcagagaaaagacagcagaaaaaaaaacggagaaactaaagaagtaatgaatttcttatgacaaataacttctaagtaatttccaaaagctataggcaaccttgcctttctggtacctttcattctttcggcctttttatctctgtgaaaatcaacttttctaaaaatagcttaatgaggaagaagaaaatggtaaaattgtgcatttcatcacatcacagtccagatatgaaatccatttaactcaagtatttaaaagattatcatttgcacagaaataaagtcagacactttaaaattcgaaataaatgtttttgcgctccttttccccacccctccagtccctgcatattatattcttgatgcctcactgaaccacttaaaaatggtgaagtcaaaacgctagtaaagttcttcactacagtatatactagcagccaaatcactagaatgcccattcatttcttgtgaaatgctacgttaataatttcttaaactgtcacttcatactaaagttagcgcttccacagctttaagcccacttgggttagcaaacatgatggttctttttaatgcccgaatgaataagctgacccatggagaagttgagaaccaatatagtcctggtctgggctttcctgccctggtttctgtgaatactggctctcaagagtcactccctaattctggggccagggaatcctcacatcaggtacagagcgtgatatgatgtctgtagctacttcagcagagccaccacacacagcaatttgctgatgccaggccaagccttaaatacttaaaacacagctgtggctttggccattgtgagcccaggtggggacagagtaggggagcagcgcctttgaggagagccacacagatggcttctaatccagatgcagaggtcagctgaagggtgtggaagagtgttgataaacatcctgggactgggatgcatgctgccctattgaggaaatgtaagagagacagcaaaggcagggagatgaagcatttggggactcggaatggagagtgctggataatggattttagagctagtgggtggtttttatgagttctattcctgggccagttctaaatgcatgaatgccagagcacatgtgctggacagtctacccaaaccacacagacatctggaacttcagggcagtggtgaatcccagcagtgacatgcctacttttaaaacactcaagttcaataggaccccacaaagttctttgctgttcaagtatttgatgctctgtacatattaagaacatagaaccatctcctcattacacctttcagttcccaagaaagtgtgtctttgtcttctcatggacttaagtgtaatcactttactggataattatagaagggaacagaagacacaggacagagtttagaacttgctgatgttcccacagctcatgatacttgagaaaagacctagatattttttcactttttattggccacttcaattctttgtattgctgagtctctgaaggcttgatttttgcctatggataagaaagttttggggtctgatttttagttttaaaacgtttattgtctattcatagataacttgttttatctgcttgttacagtgccgccttctgttgaagtttcttttgacagctattggtccctatgtttacctcatgtgaataaaggaaaacatcctggatgtacagcaaagtttttgagtaaaagagtgagatattagatcattgctagctgcttactcttatttcagaaataaaaatttgaactatctcttctcaatggtaaatatttggggaattaaatatacatcattacaaaatttttgctattgtttattgaacacctacctgttatagaagtcacttgtttacatgtgtttgaaataacatacaatatcaatgtgtattaaggtttgtgtaagaaattcgcaattcagtttactactaaaattttgcataaagactttcttaggggacaaatgtagagattaaagtaaattttttaaaaaatccacctgtggtatttattgaatgtagagttgacagcactgaaataggcaaattggactaacgtaaatctgccaaatataacttcaaccaagtgtttttttgcttttaactttctcatttgatagaattcttttaccaaaaattggctacgaatgagaggactgagaattgatgtcgaaacgtttttctcttaatatttcttgatccgttaaaaacaaattatggctcctggaagtcagacaaaatttccatcaggatttgtaaactggttgggatcaccttatgtgaaacttaaatgagagtgaaatgggcgagcatacttcactgacttagcgcttggtccagaatgaactgctggccccacacttgggcctgctaacgtgtgcccgttccctgggtgttctctgcagctggcctaagtgccaagcgatgtccacaagctgagctcactcctggaatacacgttcctggccgttccatctctgaaggtgtcacttctctttttccccccagggaccctctgaagctccagcaactccagaaccaaatccgactggagcaggaggccggcgctcggcagcctccgccagccccgcgcagcgcgccgccctcgccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgcccccgcccccgccacccccggtcttcagccccacggctgccttcccggtgcccgacgtgttcccactgccgccgccaccaccgccgctcccgagcccgggacaggcgtcccactgctcgtcgcctgccacccgcttcggccacagccagacgcccgcggccttcctcagcgctctgctgccctcgcagccgccgccggcggccgtcaacgccctggggctgcccaagggtgtcacccccgcgtgagtaaccgccgcggtcctccacttccctgcccctccgcctcgggtcgccctgggactcccacatctccatacacgcgctcccatcagcctgcaacccagagcgccccagtaacatttcacacatttctctccgtgcgatgtaaaaattcttaacggcaatttgactcagtgattcttgcgtagccacttaacattatcaaaatcagaactttttcctctgaattaatatgagattctcatcaggaactattcaaaatctatgcagtgccctctcttaatcattatgggggggggggtgcttagctatcatttattgagcactgtgctaagcaactcacatgtattatttcatttgatacaacattcctaagaggtagcattgccccagttaaagtactgaggagtctaggagttaaataaattgcccagggtcacatagccactaaaccgagacacgaatccatgctctcaccaccaaactatgtgttttattataatatttcatgccagcattacaatggatgtgaaggagtttggttattaagtatatacttagtgtttttgaaaaaccttaattaacagatttaagaaataagcctttgtgtaaatctagtgattgactggaagggggcaaaagcatgtaaatgtctttatgttttgatgtagataaatgagggtgtatgcaacctagtggagaaattatgatgccagttttgtccctggcctgtgacctcgagatacattacatgcctcctctatctctttctgtttgcaggtgatctaatatgtctctctttacatcacagtgatgatgtggcagccctatgaggtctttaaaatggaaaatctttgaggataaataacacctacagaagtacagtaaaatcctcaaaaaaatacagtacaggtgttaggcatgtttggttgaagagtaaaatgagtaaatgctagtacttactcattttactgaagatttcaaaaatgaggaagtgctcacaaaggttaagccagcacccatatctcaactcttccttctgaaatcctacttcagagtttgccagaagcatactattgttcagagagaaaaagaaggaactctactaaacagtaaaaaggagaagatcttagaattcaagttattttcattcatctataaaagtgttccattgctaggatacactaatgccaccttaaaggcaagcattgctatgtcgggcctcgacaaaggtgtaccaggcagcttcagttagcaatgcttcttttgttgggcacttcctaaatgttgattacattaatttgaaatgtggcttcttctcaaatccttattgggtgaaacacagtccaatgaatatataaagaaacaagtccaaaaaaggagccaaatatagtaatgatgtgataatggacttctgttgaaagttgtcagtcaacttgtctgaggagaacctttgtccttctcccttgttttttctctttgagcttttatttagctgttagaaaaggaagtgtattatcttggtacaaagaagctgttagagagacccaaagagccagagtttgttgcatgacactttttcatcctctctcattaaaagggtaccaagtcttgcttcccaggaagaggagtactgtgtaaataatctgttctaatatttctcttatagaatttgatcaaagattcgtttttcaaaggtggtgatgattgtgccatttatcatttgtagtagaaacagcagtttgtgctgatcagtgactttgaaaccttcttaagataagcaagttttaatggcttacctcaagtaacaggagcacttgcttcttgtcagcatctatcacagtgactcattttatggagtcaaaatagcttataattgttaccacaagagtccagtcgttcctgccatttcttaaaaattaatggagaagtcgtgccgattttgtggccatggaaaactgtacccaaagatagtgaagtgctgtgacatcaaagtggcaataccagactacagatttttagctccatgcctgctcagtaagccattattatgtggttaccgttttgtcctcaaggaattttcctgttgctaaatcacgcatacttgaagaattcattattttggtttgataaatgtgtcttttgaaacatgtttttcctctggcatactatgggatctgtcatttgcattctgaattaaaaacaaaaatgttactatttttgtttaccataataatccaaataatttgccaaagattgagtgtccctatcagggctgccatgactttggcatcctggaacttgcaggaactgccaagttatcataagatgtatatattcagtttcacttataagtgttatttctttagctggatagttttgccatatatatcaagtaccaacaaattggttgattatatgtaacacaatgaagtagaaattcattaggtttttttcacttgccttgttttaccaaaatcttaaatgtaaatttccaatatcttagttttcttttcttttcttttctttttttctgagacagtcttgttctgttgtccaggctggaatgcagtggtgcaattgcagctcactgccacctccgcctctgggttccaacaattcatgcctcagccacctaaatagctgggattacaggtgtgggccatcacgtccgtctagtttttgtatttttagtagagatggggtttcaccatgatggccaggctggtttcaaacttctgacctcaggtgatccgcctgccttggcctctcaaagtgctgggattacaggcctgagccactgtgtccagtctctcttagtttgcttaatcatacttgtatacttgctgttttattctgtttgtttcacactgttcttattttcatctgtagacaggaaggttagtaagtactaagtttctaaacagtctgtggagataaggttctgtttttcatatgtttgggtagcagaggtcaaagcagggaacaaaggtcatggatgtcagtgataaaccacaaagccgaggcaaaagacagtaaatctggggaagaaaggcatttgaggaactgtatgtatagaagttccccagaccgcagtcaaccaactgcatgctgttctgtgagccggagagaggttgactgcggtctggggaacttctatacatacagttcctcaaatgcctttcttcctttatgctacatcttccccaaatttactggggtcactggcaaaatattgccctgcacaaagctgtcaacagatacaaatattaagttgacaaactcttttagatggaggcagtaaggagagcatgccttagagagaaatctgtttgcacttttataaaattaatgtattctattcccctcactattgctggtaagttggtgttacagcctccattgctgtaaccatgtttctccacatagtaaatcagccctaagacacagaagaaacccagaagatttggcagtgccgacaggcatagtgtggcagttctgctctgctggtctctgagtggccatactaagtctgaagggtgaatcagatcagacccatccctggaaccagactggcactgtttcttttgccatcttcacattcttggaatctgtgctcataagggagtgccacatagccacagtgccacaatgttgtatgctcttaactacctcttttatataagcagggctttggtttgaaatgttgccccatgtttgtcacaaagaagagcatgtgtcaataagagcttttatacagatgtattaatgacagcttttattatataggcccacagctccttatggacattatctcattgtcgctctctttctccctcataggaaacgggtaggtggggacactatcatcgttactcaagaggtgacgggatttcccagggttctggaagaaatgcctgagcaaggagagcatagcgtgacttaggttcatctcaaataactctaatgtctaacatttcttgattaaagaaagctgttgtagaagcagcaaatcagaatccccgagtcaaggaaaactttgtaacaaatttaactgtactttaagattcatgacacagggcattttcaccagttttcaagtcaagactgtggttagatagtaaccagtgaaaaagaatccaacagatacaagccgcaatgtactttgcagacatctcatctacctatctttctcctatttttcaggaaacagatagtggggggcttttcattctctgacctgaaggggttggaggtgttattactgggctcattagggtccagtatcttatcaagttgtatccaatcctggacaagtatttaccaacaaattagtaggcaaggcctccaggatctgctgcgactgggttattctgttgaaatgtctctgcccctggggcagctcaaaatcagacctgtacggctgtgtaccaagttgtacagaatgaatgaacagaagtaacccgaagccagtggatcacgaggtcaggagatcgagatcatcctggccaacatggtgaaacaccatctctactaaaatacaaaaaattagccgggcatggtggtgtgcacctgtagtcccagctacttgggagggctgaggcaggggaatcgcttgaacacagtgggtgaggttgcagtgagctgagattgcgccattgcattccagcctggtgacagagcaaaactctgtctcaaaaaaaaaaaaaaaagtaacccacgtgcctttgtcattttcttttttaaagaacccaaaatataatatgaggagaatttgatattacaataaagttatctattttcctttaaatatgagcttaagttacccattttttgtactttaacagcctttgctttaccgtaaaattcagtaaaaggaaaacagaattgatatacaaaagctcagtttgtatatcttgggctcttttatatattaatacattacattcttgaatataagtgatatttaaatgccaacatgttaatgagtttgctcactctgaaattttgtggaatttagttaccatcagatttcactgaatgtgagaagagtagaataagaggacttgtaatagttaaattctctggttgattctggtaccttatctctttaatcaatattgtgctctggaaatttgagtttctgaaatctgctcacagaattgacctgcaatagcatatcaagggaaggatgctttcaagattattcagtagccaaaaaaagagacctcttgggatttggtggtgattgaatctggaaaattttaccttccagatgcttgtgtatatgtttgagatgtttttatcccaaccacatgaatattgtttttaaatgacaaatgacttactgttaaagccagagtaaacagatcagtaatgttttttgtacagttgggctgagtgtgtatacaatgaagtatttagtgcaggaggcctgttacaaattgtttattggttaaggtttgcctctgagtatggatttttgtgaagagttctggttttggtaactactaactttgaatactattttatttttttttaattgtgcaaaccatcaaaaaaaaaaaggagatcatgtctttgtcaccactctttttatttcctaatgagttgctactcttcatttatcaaaagaaggtgccacttcagggagcagaactacaaccatcttacattaaactctaacatagcattagttttataggaaaacaaactcagttgccaaatttttgcctcaaaacttataactgcttttctttcctcatgcctcccctttcaaaatactccacttttatttctaactctcaccttgcatgctacccctaaaccctgtcctcaacttttaatttcgtaaagtgtttctgaattacgttagtccagtgagatgctctgaaaaagagaagaggttccatattagaataagtgtgagaaaactgtattccatacctctttcctcagggttcacagtgcccatccgttggccctgccaggctggttctggtcacaggacctctgcactgccaagctctccctgtaggtctcacatagccagccacttcctatggtttaggccaccactgtagagtcacctcctcagaagtctgatggaccacactgtctgatacagtcatctgctcatacttctgtcctttcattgcgtttaccacctcctgatatgtcttgccttccattcttttctcttatctctttctgccatatccaccataaaaatacaatttttctaactattgtgacctagttcaacattgtatttctagcacctagaacagagttgaacactgagaaggcaatcagtaagggttatttgcacattcttgtaaattctggtcaagaattcttggcatctttttaaactccttcccctcttccattctgtttatctcagccaatcttgtctctgtgacttacttccatgctgaatattttctgtttgccacttcagatccactcttactacaccaggcgctgttctaagtgtttagtacacattagttcatgtagtttacccagtgatcgcatcagatacgagctgttaatacccacattttacaaaggaggaaactgagacatatggtcattaggtcactagcccaaaccacacagcttttaagtggttaaaacaaaacaaacaaacaaaaaaacaggttatcacgtctgtttctttattcacgctgactctgaatttcttcttcttctccactctacttgtctacatccttgtcatctttcaagggcttataacttgcctctttcatggagtcttctgcagtcattctagccagcactgttttctgtttcttttttattcccattgcatctagaattggtaccacatggtttgctccttaacttattccccaacttggttattagcctttgtgatcaaggaccatcctttaggatgtgggggggtctttgccatctcacttaaataatgttgagtgcttgctttggcagtgtgaatactaaaattgcaatgatacagagaagattagcatggcctctgtgcaaggatgacacacaaagtcatgaagtactctgtatttttaaaccatatagcctctatgaaactgccatttttgtaagttaaaaatgttcaaatattaatcgttgtaaataattgcccactggaatgttttcttattccccctcaagtttcaatttcaagcactgactgctaagattggcatgtctccagccacgtacatttgcaaaaagtcagatttgcaatgtaatatgtcatggagctcatgcttgttgaagagaatctttgataggctggacacattcattttagtaggaggcagaggtggcctaacagcaaactctaggttcaggatctaattttcatagccttcaaggatgaatgcaatataaactgtgtagtagattgtgatgctcattccaactagggaggcaagcatttgtacctgctatctacaaggcaccaaataatgcatgtgtcaccattgctataaattgtcctcttccaggacctaactatttgggtaaagaacctacagttcccatcaccacctatgtatgtatgtacaaacataaattagtccaaattctaattttctcttatttttctttgtggaaaaacagataagaaagctcagtaaaggaagatataagcaattaatgttacagttcttcaatataataatttgaattaaatgtactaagaagcaaaaactattagtgttgagactatcatgatgaagcttttggtttttttaatatattttcatttttatgcataaaatcttaatacatagaattccatgatgtcatcaggcattaacaatcacttaccttagaaaccaactctttttttctaggcttaacagggtttgtattaatgtattggcctagcactgggccctgctagatgctcaataaatatttgtctaatcactattagacattttaaaatatcttttggctgggaacagtggctcacacctgtaattccagctctttgaaaggccaaagcaggaagatcccttgagcccaggagtttgagaccagcctgggcaacatagggagaacctgtccctacaaaaaatggaaatttagccaggcacagtggtatgcacttatggtccctgctacttggaggatgactcaggaggattgcttgagcctcctaggatgtcaaggctgcagggagctgtgatcacaccactgcattccagcctgggtgacagagcaaaacccagtctataaaaagaaaaaacatatttcagtttatttttatttctgtgttaattgtttagaaccaagaaaatatgagtaccttaaattctgtaagtaaagaggaaaatgtctttaacattgtaggaaattaggaattaagtaactgcccttcatactggtaatcttgatatgttgaaggaagtgacttgttataagatagaggccaggtatggtggctcatgcctgtaatcccagcactttgggaggccgaggcgggcggatcacgaggtcaggagttcgagaccagcctgaccaacatggtgaaaccccatctctactaaaaatacaaaaattagccaggcgtggtggctcatgcctgtaatcctagctactcaggaggctgaggcaggagaactgcttgaacctgggaggcagaggttgcagtgagccgagatggtgccactgcactccagcctaggcaacagagtgagactctgtctcaaaaaaaaaaaaaaaagaaaaagaaaaagtagaataatcagtttttacttgagccaaagactaattgtaattataccctttgaaaggataaattacccttgtggcagggacacaaaccaaggtgacaactctatggaatgttccagagcagttgttctaagtccctttaagagtcaaatatactgagaaatgcttcccaaggaacaggacttattctacagtgaatagacaggtattttcttgtccaagggaacttgtggctgacttttaaaaaccagttctccgctcctccgattgagatgacctgttctgaccttgatggtctccctgtctcccctttctttttcatttgtgctgagaacacagctcttagtgtagtctacctgcagaaacacagtggtgccttctgtcattgaaggctgctcatcagcacatagttgttctatggtctacatcgcacaggcttagagtaataatgggaatgtgtgtgttcccagtccttgctgatgtaacagagagctggctgccttcagtttacctttaagatgacttcaaaacctagctcttctagttctcagatgtaaggctgtagtgaaatgcagagaacttcacttccaaaattgtataatttttacttgtcctgggcctgactttttacatagggtctgatttcacatggctctggcacaagttttcttgactgaggaagggaggggagagagaaatcagaagtagagatggacagtacatccattcactcatttcagaaatattatttgagtgtctgttaacagcactgtgattaacaaaggagccatggtaagggagagacaatatgaaaaaatagtagagtgatagatgctatcaggaaaacaactaatgggacaagcttagtcagggacatcctttccaaggagtcattaagctgaagactgatgataacaaccccagataaaggagtaggaggggagagaggttccaggcttgggaaaactagcaaactatgcacgtgtttgttaaaggattccatggtactagaaattgaagttataaataattcctatggttcttactgtctcagggtctccttaaatatcaaaatgagtttgtaaagtctagtgttaccttatttgaacttcagggcaaatgactaaaagggacaaacctagaatagcaggttttaatcagttagcatattttccactgtaggtatcagaagactcaactacaaggagattcgatgcacagggtttactgacttatgaaacaagtctggggtagggtagttccatggtaggttaagacagtgcccccaaaacattatcagggcccaggtattctccatcttttcagtctatcatcattggcacatatgggttctcctcttacagttatggagtgaacaatgccgcttttgacattgcatttctgacacagtgatatccagtgaaagaagaggggcatttcttccttctgtttcttttcagagatgagagaattttaactagagcacctccaccctctgactaccccccactcctccagtctcattggcccaggctatatcgcatgcctttggccaaactaatcactctcgaggggattgagaccatttaaattggcgtacattaattaccccctgagtctggggagggggatcacatttctataagcacattgaagggtgaacactcagcaaaattaggaaaaaattcagcaaggaaacaaaggggagtggccaagaggaaagaacagctgttgggaagaccaggagcacaggcctcaggagtgcatggcatcatgacttaggagggacggtggcagagtctttacaggatcctcagagtttctgctgcatacttagtgactgttttgttcccagcactggtgggtgaaaccgtgaacccagtgtttaggtacattcttagccttacttgtgctttctactgtatcagtgaagtgacatgaggcacacagtgccttgacgctttggcagtaaagttttgtttgtttgctttattttgtgtgtgtgtgtgtgtgtgtgtgtgtggtttttttttttttttagacggagtcttgctctgtcgcccaggctggagtgcagtggtgcgacctcggctcactgcaacctctgcctccagtgttcaagcaattctcataccccaacctcccaagtagctgggactacaggcgcccaccaccacacccagctaatttttgtatttttagtagagacggggttttaccatgttggccaagctggtctccaactcctgacctcaggggattcacccaccttggtctcccaaagtgctgggaatacaggcgtgagccaccacacccggcctgcagtcaactttttaaactttgaaatatcttatcatgaactatgtaatataaataaggaagtatatacaatttatacgtatacctcaataaaatgaaattcttatccatttctagtacctttgaagcccccatttgaccctccccaattgcatccactactctccctgagaggtaactgctaccctgaatttctgagttaatgattctcttctcttcatggttttaccatgtatgtatgctcccctcagtttctttctaaaacttttgcatgtaacacctagagaacttgttaaaacacagattgctgggccccaactctgaatttgtgattcagtaggtctggagtgatgccaaaaatctgcatttctaacaacttcaggtcatgctaatgctgctggtccagggaccacaccttgagaaccactgctgtagcagggggctgttttgcttttgcctgtttataaatacaagtatatcatatatattcttctgtgacttgctttttttcaccggaactttgtttttgaagttcagctttgttgatatgggtagcgataggtcaattcatttccccattgcttagtattctatttctcattaatttttgtccactgccctatgagggaagaggaagaaaaataggaagcaacttgcttaaggcaccaacagaagtgattctgtacccctcaagcatccagcaccaatgacccttggctcacacagctcaggtcattgttgctgcctttggaaggaaagaggcagtgagatatcacctgtcctaagagccctggcctcaccagaagttcaggaggctttgagacaccaggcacagcaggacctgcagacctcccagagccctcttgtataaaatagacctcaaataacattggcctaccctaatcaaatcaggatataaggggatggaagggaaggtaacaaacttaatattgatttcaaatgggctaggcactattgttgaataatgattacaaagcactagaagactgaataaaagtatgataaaaatacgttctctttcaacctctcaacattcatatgtggtatatatttttttaaaacttgcccaaggtcacaaacttaatacgagatagagtcagattttaaacctagctctacttataaatcatatcattctttcactttatgctgccgcctcgctaagacttaaatgtaggccttccccatccttggcatctacctacccactaaggcatactcccctaatgtatgtgaaccttctctgaaacctggatccaattagtgttacctgaaccagctttcatggttctttccatcatagttgcaacagatgtagcataaaaaatagtgggagtgacatgctgataccttgcactgtctttgttggacttgaacgtttgacttggatttatatgcctgacaactaactatactgccttgtgtttttatcctgcagaggatttccaaagaaggccagtagaactgctagaatagcctccgatgaggaaattcaaggcacaaaggatgctgttattcaagacctggaacgaaaacttcgcttcaaggaggacctcctgaacaatggccagccggtactgatagatttgggacctggacttggaatgttagctacccacatacctttcttcctttctctaagacttaggttcttgatatttgtccacaacatcatcattattattattattatttttgagacagggtcacactttgtcacccatgctggagtgcaatggtgtcatcacagctcactgcatccttgacctcccaggctcaaacaatcctgtgacctcaacctcctgggtagctggaaccacaggcacatgccaccatgcctggctaattttttatttttgtaaagacagagtctccctatgttgcttaggctggtttcaaactccagagctcaggcgatctgcccgccttggcctcccaaagtgctggaattacagatgtgagccactgcacacagccacattattttattacccttgaatctcaacatttctcttgatattaggatttgaatccaaagacaaaagagaaaacgaaaggccttccttctattcagtcttcactgctttctcctatgcaaaaaacctttctaagagtgaagagagtaagtgggaaagaaaggaagaaggaagggcagatatctggttgggagaggaacaaatgagcaatgccaatggtattaaaaaaaaaaaaaaaggaacacagggattccattctggctgatagggttggggagggatggagaaggtgcgctttggaatggtttgtatctacccagaaacagcgaactgcaatgaaagtatcaaaaagagaatttgttttccatggtatgtactacttacacacgcacacaaatctactagagaaaccattggggaagttctgttcttttctcccagactactactagatattaattcagcatctgaaagagtaaaggctgttccaaaatcttgttctggtttgttagagcaagataactaaactgtaggaaaaaataattattttacagctgcagaactgtagagtacctaaatagatttggtaaaatatatagataagatgttttctccactggatttaagtctttcctcatcagtttttgtttgttttttcatctcttttgttgatgctatccttttaaaatactcttttctttttaaaatactatttccagaatattttaaggggatgggaaaagcaaatctagaaaataagacttaccaggtaaaggagaggaaccttctgtagctttattaaggaattgtcactggaaaaatttgcctggctcttaagtacaagacaaggatctttttgtataaaatctccctttcagacacctttttcagagtagaaagctctctataattatgttttctgagaattttaattatcaaacattgataagtaaaactgtgagaacagaccacacttgaaagctggagagcagaggaggggtgctgaatgctgattttagtttattagggtatcttaatctgattaagaaagattaaaatttcaatgaagttttgtgttagttactcatttcactgagtatagaagattttcacaagaggaaaatattttctccctgaaataagtgattgcatgtgtaaatgtacatactctggaagttttccctggctctgtcaactaaatcttttaaaagattaaaataaatacatatgggaactttttcaagccaggtaaggcatcactccagcttttttttttttctttttggctgtctatgtcaatgttccttatgaactaagattctcttggttaaggtaagacttccttaagctattggtcaacccacattatatatattgtatgtatatttatattcatctgtttagcagtgaataacattcacagtaagttccacaggtatccacacttgagagcttaaaatgacaagtaaggtttccctttttagaaaatgggattctcaaccaactttttcctaatattatatatcattctctttcttatctttggtgtctgtagacacgggcttttatagccagatggcatagtgacttagaaaaaaaactgtgaagtatatttggcttctagtggtagcaggtgcattctggtgaaggaatagatatgaaattgatatttctgcttataaggaacagagtgaaaatcactccaggcctgcctttgatgtgttacaattctccgtgaaaagattagggaagctttttaagagatcaggtatttaagactctctttgaaaattgaattcactgattttttaataggtgtgagaaaattaatttaataacatagtggactcagatgcttcatgccgccctcagactcctacctctgcctcttcttgtcctctgacctttctttattaagtgaaataatttgaactgcaggactatttgtcatttggcacttgacttgtttcacttcccggtttcagctgggattgagatcagcaattactggaaattgtaaatttacccaacatattttcctgattagagagcttccaatcaaatttgcatttatatttagaagtttggaagtttatctgaaataatttctgtacattttttagattctgccttaccaattattctctatttctaatcaaacacttgcttataaaatgctcccgatgaggcaggtggtatctgaaagttccttccaaacctgtaagtctaaggcactttagaatgagtattcaagagcaggtatcaccccaacagtcacacaaaaatgccggcatttcttatgtataagaatggcataggtaaaacggtttgggccaattccaaagtgctagctgcgagatgcaagaacactaccactttctttgcctgatgggcaagcagtctgcttctgggtcaagtcaattgaggctgttagctttggcaagtgtcttgtgtaatcctgttgctaattcagccatgtgcatcattctctgtggattataatagttgccgccaatcccctacattacacagcagcctgggaaatgctcttagaggtaagaaccccatcactgccagctcatccacatcttcctttagctaaacatttactgagcacatactgttaaatgactgatagaattatttccattagcgatacctgttctttttttagtcagtttattctccttttgagtatctttgttttttctttcagtcagtattagagctgacttgggtgttctgaagctgatggatggctataaaaataacatttcttttaaattgtattttgctgtttaaatatctttttttccatgtttttcattaaggacatgacaaatcttttctgtgtggtttcttccttgtcgcttattgctcactttaaatttgtgctgtaccaattggtggctctctggattaggccattagtactagaaagggaggtaaaaaggtagaacaactgaagcaagaaaaagaaatatgcaggtatctgaagctggagagagaacacttacagaaaatcatgaaagtgtgttgttttttactctttttcatagggcagtacatatttgtgatttttttctaattttgtattttttgtgacttacgttgtttagaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctgtggaaagtagagggcaagtcacagaaaagcagtattaatatcatcagtcaacctcacagctaatttttattgagcacatactatgttaagtgactgacagaattctttccatcagtgatacctgttctttttattcttcttcttgattattctcctttccagtacatttccattttcctatcctaagttttatgcaaaataattttgtgtggagaaacacattttcgccgacattgtctgaaataactagtgaatatttcccattagagttggaccttgaacaacacgggagttagggggaccaaccccaagcacagttaaaaacccacatatggccgggcacagtggctcatgcctgtaattgtagcactttgggaggctgaggtgggtggatcacgaggtcaggagatcgagaccatcgtggccaacatggtgaaaccccgtctctactaaaaatacaaaaattagccaggtgtggtgacgcacacctgtagtcccagctactcgggaagctgaggcaggagaattgcttgaacccgggaggtggaggttgcagtgagctgaggttgtaccactgcactccagcctggcagcagagtgagacttcgtctccaaaacaaaacaaaactaaaaacacatatacgacttttgactcttcaaaaacttaactaacagcctactgttgaccagaagccttactgataacaaagagttgattaacacgtattctgtatgttatatgtattatagactgtagtcttaaagtaagctagagaaaagaaaatgttacaaagaacatcttaaggaatagaagatacatttacaattcattaagtggaagtgggtcatcataaaggtcttcatcctcattgtcttaaattagagtggtctgaagagaagaagacaaggggttggtcttgcttatctcaggggttgcagaagcggaagaaaatccatatataagtggacccatgcagttcaaacctgtgttgttcaaagatcaactgtttagtcttaatatctagtcaaaataaaatagaaaatattatctctttatcttctttcacatatatacagatgttcttcaacttagtatggggttatgtcctgataaactcattataagttgaaaatattgtaagttgaaagtgcatttaaggcggggcgcagtggcttacgcctgtgatcccagcactttgggaggccaagaccgggtggattacctgaggtcaggagttcaagaccagcctgaccaacatggtgaaaccccgtctctactgaaaatacaaaaattagccgggtgtggtggcgtgcgcctgtagtcccagctacgcgggaggctgagacatgagaatcgcttgaacccaggagacagaggttacagtgagccaagatcgtgccactgcactccagccaggtgacagagcgagactccatctcaaaaaaaaaaaaaaaagtgcatttaatacacctaacctactgaacatcttaggttagcctagtctatcttaaatgtgctcacaacacttacattagcttacagttgggcaaaatcatctaacacaaagcctatttaaaataaagtattgaatatctcatgtgatttatggagtcctgtaccaaaagtgagaagcagaatggttgtgtgagtactcacagcaccgttactaccaaacgcatattgctagcacaaaagtttcacttaaggaaaattagaaatcttgctgcattcttattatttctattattagtcttcacatctttttttctaccattacaggacattggttctcctcatgcttctgtagggagtcctctggatggtcaaaaggttaagcttttcacctttcttctccttccagtctttctctgtgtctgttttcttctgttcttcctgttttacgtgtgtttctatcttttctgccatatattaattataaatgctatgaccagtgtctgtttcatttaatatcagatacacaaaattactgcaacatgagttttcttgtcatgtatttaccagcttgaatttatttatttatttttactttatgtatttatttatttatttatttattttgagatggagtttcgctcttgttgcccaggctggagtgcaatggtgtgatcttggctcactgcaacctctgtctcctgggttcaagcgattctcctgcctcagcctcccaagtagctgggattacaagtgcatgccaacatgcctggctaattttgtatttttagcagagatggggtttcaccatgttggtcaggctggtctcgaacttctgacctcaggtgatccacccgccttggcttcccaaagcgctgggaatacggcatgagccacagtgcctggcctctgacttgaatttaattctgtcattagtggatactctgaacattaaatcaagaaaaatttttcatttgttatatatacctttctatggggaacaaaagtgctaattcttcaagggattaatttgatagtaattagatgaagcaaaacaacttgtggtataactcttgcagttttattcatactgttgtatttcttccctcaaaccaacaaacttgttttttaaacactgagtaacttctttaagagaaaacatagttaaagttatctttcatttaatattaaatagggaatatttacatagactcccttgtcttcattgcacttttttgttttggagacagggtctcactcttttgcccaggcttgagtgcagtggcacaatcacggcccactgcagcctcgacttcccaggctcaagtgatcctcccacctcagcctcccaagtagctgggacaacaggcatgtaccaccatgcccagctactgttctttttaaattttttgtagagatggggtctcactttgttgcccaagctggtctcaaactcctggccagaagcaatcctcccacctcggccttccaaagtgttgggaattacaggcatgagccactgtacctggcctttaatgcactttgtaggcaaggaaattgtaggatccaccgtaatcaccacaggaatgttgatgggttgttttttttttttaaagcaaaattttggctagactgtcagtcctattttttcttctaaagatggtgggttcctaacagctgcagagctgaggaggcggcccttgcaaggcagggattgttagaggtgggggaaaaaaaacaaacatttttttttttctattattcttttactattttttctattaccattttttctagtaccattttttctattattcttttactataattgtatataatatggcagctgcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactttccttgattcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaaggtgagctgggagatggaggctttttaagagtcattctctgaggaaaggtttagcttccaaaacatagcatgccagtaggagaaagagatacaaatgatctttctcaatacccacgatataaagggttttaaatattcttaagttctgggccatcttcaggaggcattagaaaccaaaaaaggtggtggggggagtggagtttgggtttgaagaatagagaataactaacagggagctcttcacacacctatatcatttattcctcgttgttattcccaaatcacaaataactaaactgagttctgtgaagtgagtttccaaggtcagagagctggtgagtggccaggcctgcatatgaacccagtgctctgtaccatacagacaagtaatgctcaccactggttgtaaaaacttccaatctttaatcaaaaaaccaaggctgcttatattaatatttacagagggaggtggggtgaagaatattgtttagaacggataatgacaaattctgataccatgcaggactaggatgacctggatgggagctctctccatacaaacatatggaaatgctggataaggagctgccctatctttaaaggaaggactagaataactgtttactagcccagcaaggcagtaaacaggagtacacttttccctagagcttgagtgaaaagaataaaaaaaagggaaaaaattaaaacccctaaactacactatcacatgatagggagccaaaagctgagaaatgtgaaatttagtgctggatgattaaaattcttagaagcaagcaaaaagttgccttatataaaggtaataatatgtgaagaaataaccatgaggagagttgtgttaggccgtttttgcataaagggattcctgagactgggtaatttataaagaaaataggttttattggccaagcatggtggctcacgcctgtaatcccagcattttgcgaggccgagatgggtggatcacctgagctcaggagttcgagaccagcctggccaacatggtgaaaccccatctctactaaaaatacaaaaattagctgggcatggtggtgggcgcctgtaatctcagctacttgggaggctgaggcaggagaattgctggaacccaggaggtggaggttgcagtgaccaagatcgcgccattgcactccagctcagggcaacaacagtgagactccgtctcaaaaaaaaaaaaaagaaaagaaaataggctttactggctcacagttctgcatggtatacagaagtgtagtaccagaatcttctcctggtgcggcctcaggaagcttacaatcatggtgaaggcgaaggcgaaaaaggtgaatcacacagcaagagtaggagcaacagagagaagtggtggaggtcccagacttttaaacaaccagatctcatgtgaactaattgagcaagaactcacttaccaccaaggggatggtgctaaaccattcatgagggatccaccccatgatcccgtcacctcccgccaggccccacctccaacactgggagtcccatttcagcatgagatttggaggggacagacatccaaaccatattaagagtcatagtacaagaaacagaaaaacagaaggccaagtattgcacaatattgaacaatcttaagtaacctctaaaataactttaaaaagattgaaacaattttaaaaagaatggaaactataatgaaagaacaagatagtaccaaaaaatacaaatttataaaataagcatagagcaatgtactcaatgaaataaaaagcttaatagtggcataaaatgaaagagggaaaagtgataaaaaaatacctgacacttttaggtgttaatttcctatagctccatggcattgttttgttttcccaccatggcaagttttaccatcatgttcttttcttaaaactgaatcgcaacgccaaagtcaaagatcaaagaaaagagccttgaattttcaaaccctatatacttcctaataaaatgggatttttaaaataaactccattgttatagaaaactttttacaatattcttggcataatctgcattaacaactgtgtattcacaacatgttatcaaacgcatgtattaaaaataaatttgtagtttatgaacgaaattcaataaggaattatatcttgaacttccaagatattcacaagaagattccatattactttcaaaccttacacaaggcttaagatcactgatcaaattctaagattattgattcttatagaatactacattaacatgaaagatgggcttttgtttttaatatgactgtacttttttcctaatataaatttaaatgtttcacagctagaagggacttaattgtttaaacttttcattgttaaatgttattctttcatccctccttcctctccctcaaccttcattctccttctcattgttttcttccctctctcatttattaaaggtctactttggcatatgccatataaattacattaggattgttaaagtatggaatattcatgtttaaagaaatacatgtttttttaggcttatgttttaaaaatattttattcctcccttgacatgcttgttctagttgagccataggaagactgaaaataatttctgatttaccctgttctcgtgcttgtgccctcccgaatttctccctccattagtacgcttggtaaaattttggaaatatttcttagatcttatttgaaagttgtatgccaagtataatggaggtgaaaaatatgattaaagaaataactcaagaactggcattgtggcaagaatgcaaaagggaagaaattgtatacttattacagcttcttttttccatcagaaatagtcaaccatagccaggcacagtggctcacacctggaatcccagcactttgggaggctgaggcaggcagatctcttgaggtcaggagtttaagaacagcctggccaatattgtgaaaccccatctctactaaaaatacaaacattagctgagcatggaggcgcacacctgtaatcccagctactcaggaggctgaggcaagagattcacttgaacccgggaggcagaaattgcagtgagccaagatcacaccactgcactctctagcctgggggacagagctagactcatctaaaaaaagaaagtcaactactaaaaagtaaaataattatgaagtatgatactttacataatttaagttttacaactcaaagttattagtctagttggtgattactttttagattctagagtttaatacgtaatatagtttctgtaaatttggagctacctgaaaaatacgagtttgaaaagttagagcagtcatatcctgataattcatccatttatttagtgctatatatttctggtcttttcctttcttagaatgcaggtttcaaaaagatttttcagattcaaatactttgacagacagttgaatttgaatgtcagtttatgttaccaatttacatactgatttatattaaggaagaagtttgttttaacaactaaagggtctaaagtatatttgttttgttaggaatcaggaatacttttggctgcaaggaacaaaaaatgacaacaaataacttgctgtggcttaaaaaaggaaaggtttatttgcttatctagtaagtctgcaggtggggtgatgtagctattaattcagcatctcagccatgttagggctgttggcactgtgattcattatgatgggcctatctttcaactgtgttgttcataacttaaatcgaaaataataatgaacttagccaggcatggtggctcacacttgtaatcccagctactctggaggctgaggcacgagaattgtttgaacctgggaggcggaggttacagtgagccaagactgcaccaccgcactctgcactccagcctgggcaacggagcgagaccctgtctccaaaacaaaacaaaaccttagaactcggacatccatggacaactggttttgtttaaaagtgagggaaggaaggaggaccctttggactacttaaaaatattgtatttaatcaaaatttacttttattttttacattgtttcttttgagacagggcctcagtcacctaggctggagtgcaatggcatgatcatggctcactacagcctcaacctcctgggctcaagcaatcctcctgactcagccttccaaatagctagggctatagacatgcaccaccacacccagataatttttttattttttgggtcttactatgttgcccaggctggtcttgaattcctgggcttgagcaatcctcctcagcctcccaaagtgctgggattataggtaggcatgagccactgtacctggcccacatttaattttttatcaacccaagttacatatctgaaaattattatacttttcaatactactgtgttttctttaacataatggggataggtgacaaacatttaacctttgatcatatgcttcctggcccagaaataaagcagtagtattccacccatcaccaacccttagtcatcacctccctccctaccaacctcttttatttgtcaaacacaattcagtgaaatgattagagtttggggtctgcttttgttctccaaaacaacctttttacctttattttataaacaatacattttaattgctggtacatttgaaaaaagaaaaatggccttcatagaaggccacttcatagaaataatggcattctatgaatgccatgaagtaatgccacttcatagaaataatcattgccaaaattcaatatatcccttcatataaataatatatgaatgtaagtgcaatatttttaaaaacaaaaggaagatatataatttaaaaactcaaatagaatttaaattgttacctgccttttttcagtgaaaaatcaattccttagtcaggtatttggtttaacattttaacatgaaaactcagatcagctctgcaaaccacactgttactattttcagttctccaaatagagtaggaatacacaaactcctaatctttaatctttgtttctattcacagatctattggtttaaagatgggaagcagatctctccaaagagtgatcactacaccattcaaagagatctcgatgggacctgctccctccataccacagcctccaccctagatgatgatgggaattatacaattatggctgcaaaccctcaggtaaagaagggtataggtctgggctcagttctgtgtctagtgcttacaggcatttgattagacaaaggaactatttaaaaggtgaagttaagaagtttctttgatttatgaaactatttttccaaattctacatccatcttggtttcagaggatagaaaaattctttgtttcatgaatacttatttattccatcaggtgttattctactccttccacaaatattattaagggtctaatatgtacacactttctatgtgggtgatggggttgcagtggtagactggacaaagtcctatggtaaaaaataagcaattaacaaataatataacttcaggtaggattacatgaagaaaataaaggagaaaaagagtgagtggcatgcataggctgtataagaaaaactcaacaaagtaaaatattttaaaagaaacacatcagtgggatttaatgtgcaaatgtagacaaatgataattttgatagcattcaggtttatcagttttcatcaaaatgttttctcttgtatttgcctttagacttagggtcaaaaaatcagttgccttcttagaatttaataggaggctgctgggtatcatgttgccagttcgagcctgcaaattcttttttattatgttatacattttagtcactatgctggatataggggatacaaaaatgagtaaaaagttattttgtaccttaagagctcaatgtatgacaggtagttttactaaagtctgcaaaagtagtataaataacacacttttaaaaagaaaaaaaaaggcatggtaaaatgagcagttttctctagaagtcatctttttagaatctctgatctacttatatcattccatattatttcttttgaagaaaatatttagcattagaaactatataaataattttaatgacactacaaacttttaattaaagtttctggcccaggtgcagtggctcacatctgtagtcccagcactttgggaggctgaggcaggtggattgcctcagccccggagtttgagaccagcctggccaacatggcgaaaccctgtctctactaaaaatacaaaaattagccaggtgtggtggtaggcacctgtaatcccagctactcaggaggttgaagcatgagaatcacttgaacctgggatgcggaggtttcagtgagccaagactgcaccactgcactccagcctggttgacagagtgagactttgttttttgttttgttggttttttttttttttttttttttttttttttgagatggaatctcactctgtcgcccaggctggaatgcagtggcgcgatctcggctcactgcaagctccgcctcctgcgttcacaccattctcctgcctcagcctccctagtagctgggactacaggcacccaccatgcccggctaatttttttttatttttagtagagatggggtttcaccatgttagccaggatggtctcgatctcctgacctcgtgatccgcccgcctcggcctcccaaagtgttagcattacaggtgtgaggcactgcacccggcctgagactctgtttctaaataaataaataaataaagtttattcaaggtttattatattctaatattccatggtcatataaatatatttttctgcaataatattaagatcagaatgaaaacagattatccagctaatcaggttgtgatagagcacagcaaactcttcactgttaatgaaaagcttctatattaatgcacattcttaaagttctaaatgttttaatcaatgaatacatgaccatcaccctgaaaaagtctaaatcactattaagaagttgcattttaatgtttgtgttcatatttgatatatatgaagaaacaaaagcggaacttgcttttttttcttttttttttttttttttttcttttttgagacggaatcttgctctgttgcccaggctggagtgcagtggcatgatcttagcccactgcagtctccacctcctgggttcaagcaattcttctgcctcagcaccaccacgctcagctaattttttgtatttttaatagagacggggtttcacctcaggtgatccacctgcctcggcctcttttttccttattatattttcagtgcatttccttgacattaacaaattctagcttttagtttagttttctgcctgtttaagaaaatggtggagaactgacaaaatccaaaatttttcttcgtgttgggtcatttattcctcttttgccctagaaaggctggggtatattatgggatggaattatctgtggtccttacgtatttgccaacactgggaacctgctattaatttcaagacatttttcttagcatgttttaaattgttattggaataagccattttatagaacaaaagaacataaacgtaaaactgcaattgtgagtccgcttagtgtcttcctcaaattataataatgcatttttacatgtggaaaagttctcagtgaggaaggactgactcagtgctcatggccaatggcagtgtgcagagtttaagacagcaggccagccttgggggtcagtagtctccagtcatttaaactctcttgacaaattattatgaagtcactagatgaaggtgagctgctgaaaatctcccttggatcattccatattacatacatataatatcacattgtaccccacaaatatatacaattataatttatcaattagaataaaaaagaaatttttgtttattcatttagagacaaggtcttcctcagtcacccaggctggagtacagtggcataatcatggctcactgcagcttagaactcttgggctcaagcagtcctcccatctcagcctcccaaagcactggaattacaagcgtgagccactgccattagccaaaaataaatttttagaaaataaatgtaatcttacccaaagcccaatatataatgccaaaaaaaagaaacccttgttaacataggaaaaaaaggaaaggaaggaaataaaaaagaaatgttactacaaataccaagattgtagggcaacaccgatgatactgaaaaaacctaggatgaggccggcaggccatgcagtacaggggttatgagcatgaactttggcatcaggcaatctcagctggaattctagctctgccactcactacctgtgtgaccttagcaagtcacttaacttctctgtgcctgtttcctccctcgtaaaatgaggatgataataataataataataatacagatttaaatagtacatgtaaaaagcattcagtttacctggcacatactatgctttcaataaatgctagttactgtcattattttaattcagagacagtaactaccccatcttaaagcaacaggcctacaacagaagcctgtggaaccagatgtaaaggatcagttctgtgtctaggtactccgttcccacagtactgtcagaaagtaagcaagtcaatttgggatggaatttctacccagtatgttgttgctgtgtggtcttctgacctcctggcttttccattttatcacctccatgggaaaggacttaggcagcagatgtggctgtgccacaactgccacagctgtgggcttgggtggaggagctgtgagctagaggacggccacacccatagcacagctgacatcagccacacatgaagctgggaagctgctctctactctcagcaccctcagggccaagagaagccccaaaagagagtggttactgcccttattccaggccccagaattctctgctttgcaaatcccaggctgagccccatggttaaccctctctggttctttgctctaccctttggagagaagacaaagcaatgagaagtggaccaagaacagccctcctaatagaatatcctatccaacctgtgatttcagccaagggtaaaataactactctgggtctatcaaaaggagaaaaaaaaaagattcaaagaacccagagcatcacagtaaacagaccagtttctaacactacctattatagtattccaaccaactccaaagatcagttgacactcccagcatcttaaggggtagggctaagagtcttctttacctaaataacccaagacaggcaaaaggaagggaaactcatgaagtctaggcctcagtgtgtaaatgtatatatcccactgaaattgctgtgagagaattttgatatttatgccacttagcagtagtagtatttgttccaagtttctgagcatgttgcctagttgattttaattccaagagtaaaaccccttcttttctgtcttgggggcttcagtaactggtatgtccaaatatggcagatataagttctgtgagtcatcacttaaaaattggagtgaacttcactatccattagcaaaacaaagtggcatttaaaccatgaccagtgacacaccatttttctacctaactcttggcataagttaccatttgttgctgtaaggatgccattctggaaatgtttaatgctcttagaatctcagctttacaacatctattaccgtatattaaaacttttttcttataatttatgaattaagacatgagtttaaatagtcatgtcataaaaggtggtgaaaaaaaaattcaaaatagctaaatctttcaagatatagtaatcccaaaagcataaagtgtagttgacagaaaactgaagttgactccttacttccttaatgccctttagttaccttaaattttgaaattttaaagttatttgagtttagaaaaaaaagtatttgggtttgaaagggagaatacatgtatgttttctagtacactgtagcccagatgaaatgaaataaccaaggaaaagaggaagactagagtggaaaaattagttcagtaatgaaacacagacggtagagctctcctgagcagtggaaaataattacagaaagcagccaagagaagggtgagaaccaaggagggaggaaaatattaaagttcagcagaatattttatagaatatgatatttttccacctgggttaatcttttgggaataagaaaaacattagatattgttgactgcatccaaattctacttgggatagaacacacagctctaaacatatactgggctgtgtatcacactcgatgtgtgtagctcaagcaattcataagagaccaaagcaatcacatagtttagcaaaataatgagtgactgtgcagttacaccaaagagaatgccaaaatgaggatcacaaatacagtttattttagactctaatcctatctttaagaacaacgacatctaaacacgaatgttttactttgttttgttgtgttgctaagttactttgtattgcacttggattttggaatggctattttgcagtctgatgtttcctcaaactgcattatgtatacaagtggcaagcttttatgaagacctgtgtgccacaagttaaatttcataaactatgaaatataaatgttatttccatattacataaataattggccttgcacaaggtatgaaataatctttacaagctggatgtttaatacagaatcacttttagaattcaaacttatttgtaatataagctttaaactctgtggatttgtttggaatggaaaagtaacacacaactgagttaaatataaaatgttagtttgttgcttgtgttttgttttagcattataaggtttcctggctcatttcaagcttcactctaaacattcccttccattattcttatgttcatagtaaagcagatagaaatgagaaaattaataaaagcaaatgcagcagcattaatgtgcatcagagcctactaactatgattaccagggttaataggcatattattattaaaatcacttattgctaattctatatgacctttgtcaaaaatagtatgttcagacttaaaaacctgaattttctattatgcacatggaaggcatcttttcaaaaaagcttcactgaactctgggggttttttcccccaaacaaaaatgacaaaattatacaacttcttagtttggatgctctctaaatgctcctggttatgtattggttagtaatatatttagccaataacactgtataaatcaaactaataattctgcctcctgaagaccacaccttcccctttcatgttcagaagtgcaggttggtatcagaatagagagattacaaatgataactattcctttttcttaaatttgggaagttaaggaaatattctgtggcaatatttgtatatatggttctaagcagtagcagcaaaaaccctgaaaacagtgtagaaatgtgtgacctttccagagtagtatgccaacctgtttactttttttttttttttttttttgagaggggaggaagaggcaggctaagcatatcaaggatctgtttagagctgaatagggcatatttttcctcctccacatcaaatgcagccatcacactaacaagtacatttcagtatgattgtgcttagcacctttcaagcaccagcagaagttaaaaaggttaatctgcttcccacatagtctgcctcctgtgccaaaggtattttgtttttcctttggagtaaattacattctaataccaagaaaaataaaattccattacataaacaattctaaaggatgcctcaaaactggttattataattatatccatagtgagtgctacaataatttaacattttgagcattggcttcatgcaaaacacaatgctgcccggtgctttacaagtattaatgcctttaatcttcataagaacccattaggtattaactatatggccttgttttacagagaaggaaacttagaaagattaagttacctgcctaaagtcactcacctgtaagggacagcagaactggtttacaaacttagactgattccagagctactgaatgcaatacgaaggtatttaaggctcattccaggattaagagcactaagtggcaggggagatagtggttaaatatgaaagaattttagaaggaggtaagcatatacctcatgtaaagtatattcacatggaaattcttgctggggtccgccaagctgctggggctcctaaaaaccatcttgatgcatgtccatgcataatgtctcagacccatgataacacagtaccagctatgaggaatttaataatgataatttatgatgtcacataccatttgatatttatgagagcatttaggttacatcatttaacccttaaaacatccttgtgagagatatatgtagcatccctatttgtacagaaaaagaaacaaaggcttgaacaaattcagtgatttgctcaaagttttaggaaaagtcagcactcaaatccaggttagtgaggtgtgtttgtttgactgtttgtaacaacccatacctccttttccaaattcaagtttaagtctgaatttaacttacattatatctttttctaaccgcataaatgattagttcattttaacttaccatggatcttctgagcttcatatcacaaggaaggatatatccaaattataagcatttcatcatggaagccgcaaagcacataataaggaagccatatcccacatcaggacaattggaagctatttgtgtaaaacaatacacacacttccttgtcctcaacctccaaaaagaatcattaattttaagtgttcatgtgttatcttgtatgatgcatcagttggatagttcatgatggaggtcttctaagcaagttacatctagattttctacagcaagtacagatctggagaacttggatgaaattaatttttagatttcaggctagtttagggaatcccaaatgtttgccaagagtttagcataagaatctgtatcaagtggcctgtgcttcaggtacagttaatctgagctagaaataattctccttcataatgttagacttcatgtctccttggaaattttcaggaaacacagtgttttaactatgacctcaatagcaaacaccgtgaatgccagacggagtcacatatgtagtggtataaaactagttatgtttgtttctttgtgatgacctctctttggtaattcctcattcttctcctgtctgtattacattcctatgtgtctttgccttttctgggtggttatagccctaaagaagtccaggttttaggagacctagagaacccccccagttagagtcctgcccttcagtgaatcttgctatgggatttttctctgcattccctccactagtgccctcaccctgacccccactccagtctactcacagttggaaagcagttcttcaaaacacacagaacactgcagcttctgttacctgtctctataggcagcttgcaataaaaatgacagccaatgggagaattttattctgagtgtaagtgcatgagggcttctcatcaactctgagctagaactcactaagtctaatcattgatggtacatctgcttcttgtttttcctctcttgctgttacctttggcagtcatcacaatttagaagcacatcttctcattcttctgagagagtgaaggagaaaaatcatcttttttgctactctgctggtaacagtgaaaaaaacaaattaagagaaagggctgaaacaaaaaccaaagtaacaatgtgtggcttatccatgtcatctgggtgccctgagtattacttgtctgttcacatatgacagcgtttatcaaactctttttttgcttttattatttttagttgacacaatgattatacatatttatgaggtacagtgtgatatttcaaagcatgtatacaacgtataatgttcaaatcatggtaattagcatatctgtcacctcacttatcatttgtgttggaaatactcaaaatccactcttccagctatatgaaaatacacaataaattattgttatcctacagtgctgtgaaacactaaaactttttcctcctatgtagctgtaattttgtatccattaaccaacttctggctatctccccgaccccaccaccccgtcaaaatttcaattgacaaatttaagagaacaaaatataggtttttttaattacataggcccttatcatatgacccacatattttaggtatttaactgcttctagtttttaaatctcaaatatgttcatttcatgagaacatggcttcatttagtcatgaagctctccttatcatcccacgcatacttcttacataacactcattttatcatgctcattttaatgtatggtttggggaagggatgccactaacttttttttttttttttttgagacagagtcttgctctgtcacccaggctggagtgcagtggcaccatctcagctcactgcaacctccgcctcccgggttcaatagattcttctgcctcagcctcccaagtagctgggactataggtgcatgccaccacgcccggctaatttttgtatttttttagtagagacggggtttcaccatattggccaggctgggctcgaactcctgacctcgtgatccacctgcgtcagcctcccaaagtgctggcattacaggcatgagccatcgtgcccggccagccactaacatttaattagtatattactataattagtatattactaaaaagagaaaactgaaatcatctaggtttgatttcagaattggctacagctggtagatgaccatgaaaatggaatcttcacaagagactgatgtcctcctgctatattttacaattcaacatcatgtgttacggagacctttgcaggttacaattaatcaagggttgtcattttaaataccatcctagataaaacagtaaagcttatttaagagttccaaaaaaagaccttgtcaccttcaagttcttcaagtaaaaatagttttactgaggcacttaactcacagggaaagtgtttttctgaaaagggttagtcattactcaaatggcatactgaattttttatgaaataatgtcttatagagaataggacagtaggcatgatagtgcttagtggttaatagttttaaatagcaaatcatttatttcctgatatttctacagggccgcatcagttgtactggacggctaatggtacaggctgtcaaccaaagaggtcgaagtccccggtctccctcaggccatcctcatgtcagaaggtatttaacatgttccttcccagaagtgttacattattttatttattactataaatgtagtactattagaatcatcatatgaccacaaaagtaaacataactggaagatagaataggaatgcaaacctgaagcctgtggctccttgattattatgctcccttgtgatgcagaaagggaatgggaacaaacattcgctaatgtgtgctaagcccattcacatatactattagtttgttaaataagacatattttatagacaaataaatcaagactcagcacttttaaatggcatatgaaaatactactaaatggtacacaaatgttggaaaccaaacttctgtaaccaacagctgtgtgagtggacgcacacattaaaagctattaccactgggtttcttaaaatcagctcatttgttaatgttcatttttcagccacttagttcaaaacataagaccattagactacaaatcttgtaggtaagatctgtcacattttaaatactcagatatctgctagcaatagagatgctttccattcctagtagttctgagtctatgcaaggacactgatggaacaatggtaggcagagatagagaaaggattattacttcttagtaacacatttgcacttaaaaaaaattcagtaagtcaaccatcctgtcaacttggcctgtttagatattttatagacagaatatcctcaaatagtcctgagtctaaattacaggccataggtgcaaactcctttagtgaagagaatacatagttagctcacagagagtaggcaggaaaactgagtaaacatcaaacaagtggtgtgtgactgcatccacacagacttttgttcaacatttggaagacagttctggcaccagagcatgtgtagatttaattctaacttcatcatggcaatacctattcacaggatgctagcctgtatctttgggtataaacatagcatatacaggattaggtccattgtcttgcattattctctttgcttctcttgttgtctgcaacacatttttaagcctttccttatatcagtgggtcctggaaagctttttttcccataaattagatctatacttagagaagggtaaactatattaaaaagctaataattattagcctagtatgcttctttcatttgttccactcttgcttttcctagttaagtgtttttaaacttatcttctagtcactactgacagaatttgtattcaacatcttttaagtcttccctgcgattactttcaactgtattcctcttaaaggtttctctggcaacctttaaaagtgacagagatgcacagaatctgggagatttgtacaatctcattttttaaagcaaaaaataatgcctctaggcatatggataactaatgcaaaagaaaacttgcctaaaaatgtaatttgttttcctgcttaatatgaaaaggaattttaattaaaaatatattgaatttttatcagaacttttaatttcctacaaatttaaaaatcacagtgtaaagttctagtaacttctgttgaaaaagatttggtaataaatgagcaataatgctacttttcataaatatttaaaaatatttaggaaaaatatgttaatatgtaataccccatttttttccatttccccttttatgatttatagtagcctgcaattggcagacaattaaatttatagtaaacttccaaactaaacaagagtttgcttttctgattttttaatgtgtaaatcttagctgtagggatcagataaggaaatcatattattaccccatgtattttaagaaaacagatgactaaaagtctggaagtaactactatctatatttctatctatctgtcatctttcttgtttcaaggcctcgttctagatcaagggacagtggagacgaaaatgaaccaattcaggagcgattcttcagacctcacttcttgcaggctcctggagatctgactgttcaagaaggaaaactctgcagaatggactgcaaagtaagattttgttattgcttgcatatcctattgccccacttctccctcacttgccatttctctatagttccttttggggaaattacataaagtataaaatgagagctgggcacagtggctcacacctataatcccagcactttagagtccaaagccgggcagatcgcttgatcccaggagttcaagaccagcctgggtaatatggagaaacccatctctaccaaaaatacaaaagttagccaggcgtggtggcgtgtgcctatagtcccatctacttgggaggctgagttggaaggactgcttgagcctaggagctgaagctatgtgagctatgatcgagccactgaattccagcctgggtgacagagcaagaccctgtctcaaaaaatgaaatgattctagcttaagggggggaaaaagtgaaatacgtcggatatttatatattgtttactatgattctttaaatctaaattaaatatgttctttactcagaaccctacatgacattactctagaaagtcatcaggaggttttatttatccctttaaatgttgaaataataaatatgataaatctaccatgtcttcattcttttttcatacaaattttgtatccatatatctactctgacttttattcctcccattttctaattctttttttttttttttgagacagagtctcactctgtcaccaggctggagtgcagtggtgcaatctcggctcgctgcaacctctgcctcctgggtctcctgcctcagcctcctgagtagctgcgattacaggcatgtgccaccaggcccagctaatttttgtatttttagtagagatggggtttcaccatgttggtcaggctggtctcaaactcctgacttcatgatccgcccacctcagcctcccaaagtgctgggattacaggtgtgagccacagtgccccgcccccattttctaattctaagataagttagagggacatctttctttcatctgttttgcagcagggctttttgtttttttggggtttttttttttttttttgagacggagtctccctctgttgcccaggctggagtgcagtggtgtgatctcagctcactgcagcttccacctcccaggttcaagtgattctcctgcctctgcctcctgagtagctggaagtacaggcacgcaccaccacgcccagttaattttttgtatctttagtacagacggggtttcaccatattggccaggctggtctcaaactcctgacctcgtgatccgccctcctcggccttccaaagtgctgggattacaggcatgagccaccacacccggcctacagcaaggctttttaacccaaggtccttgggtaggcaggcttcattaggtgtttgaactctgaaattacctacaaaattatgtgtgtaagataacgttcatccatttctcaaaggagtttagggaaaaaatatttaagaaacactgctctaaaattttttgtttgatttcttttttgccccctgtttactgatcttaaatttagtttaactcttaaatatggataaggttttaaaaagttatttgggctccctctgctggttctgtatggaatatgagaacacaaatataggctgcttagaggatttgggcattgtttcttcagaaagtaaatctgggattatagaaatgtataaaaagaataaatataacaaaaatattttatttcttaggatcattatttattttttacagtataaatacacaaattgtgtttcagtctgtatatattttatatatatatgagtgtgtattcatttttggtctataattaagaattatacagtacagctaccatatgatccagttaattctactagtgcttatatatccgaggaaaatgaaatcagaggctgggcacagtggcacacgcctgtaatcccagcactttgggaggctgaggcgggcggatcacgaggtcaggagtttgagaccagcctgaccaacatggtgaaaccccatctctactaaaaatgctaaaattagccaggtgtggtggcatgcatctgtagtcccagctactcagggggctgaggcaggggaatcacttgaacctgggaggcagaggttgcatcactgcattccaacctgggcaacagaacaagactccccgtctcccccacaaaaaaaaaaaaagaaaagaaaatgaaatcagtagcaatatctgcattcccatgttcattgcagcactattcataatagccaggatacgggatcagcctaagtgtcaacagatgaatgaataaagaaaatatgagatatatatatatatacatacatacacacacagtggaaaattataatcctgtcattgtgacaacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcatacatatgttaatcagctcagtttaggtattccacaacacatacatatttcaaaataatgtgcagaattacatacaatttttatcaattaaaaaacacttaaaaaaattcatacagaccacttgtaaaataacgttttgagttaaccagggaaattttattttaaatagataattagattataccaaagaattattaattttacgtgtaaaatggaattgtgattatggaaaagtcttgtttttagaaatgcatactgagctatatgggggtaatggtatataaaatctggaatttatttttaaatataaaaaataagagagtgactaaatgatgggtatatacacacttaccatactggttatctctatttttaatcatatttaagaaagaaataacagtactgtctttcactggactggcacataactgtccttaaaacgcctgccattaaaagaatattggaaacaaaaagtaaactgcctattgatttcactatgatgatctgacctggataaagaaaatgtgaaaaatcggccaggcacgtgggtcacgcctgtaatcctaaaactttgggaggccgaggcaggtggatcacctgaggtcaggaatccgagaccagcctggccaacatggtgaaaccccgtctctactaaaatacaaaaaaatcagccaggcatggtggcaggcgcctgtaatcccagctactcaggaggctgaggcaagagaattgcttgaacccgggaggcggaggttgcagtaagctgagattgtgcccactgcactccagcctgggcaaggagcaagactgtcttaaaaaaaaaaaaaaagtgaaaaaccttgccacatgtacagatagatcaggaaaaaaaaaaagttagtgtatttaagctttgaaaggggaaaaaatcctgacgataagccaaacactaaagcagcagcttgcttttcctccaaaaagccccctccccttttagcccctgaggaacattcctagacactgattatccttaactggtactaaattttcaggaaaataactaattccactcccatagcaacaagcatcactattttcatgtgtgctgagagtacagatctagttacattgtgacctgctggtggtgaccttcagctcctgagatcatgctgtctttacttagccaggagaactggggttagaaaaaaggtacaaggggcattctctttgccctagcatgagtaactatccactgggtaggttcactgtgaatcacgtggtttgagagtacgcgtgctttgggcatctctcctactaaacatactgtggcttcagtcagtagatggcttatctaggatctaacctggtaaagtaggaacaagcagtgccgctttgtttctagatgtgggaacaacaaggagcctgaccaaagatgtccactccctcttcctccacaccacttctgatgacctccaaacaggtcaggcagtgtacatggagagctggggacagcaagtggatagataggagaacacagagcctgagtgtctcagaagccaagctgcctaactactgctgtttgtttccaaaacctcttcatccttttaaccagtcatttaagtttactttaaatgctgtagccctttgctacatgtgtggtgggaggcatcttgcaggtaatatcagttgagtatcacgtagcaggaatggaatttgtgagtcctctggctgatgctggcaaagctagttcttcaaaagaactgttttacagtctaagtgacatctttttgtatataacttcgtactagtaaagttgggggtagggggtaaaaaggccttccttaacagtgcatttcttccattcaaaatcaagggcaaaactaaaaagctggcagatggcgaccatcctgaccctttgcggcacaacatgttattagcaattaaatgcttttatctgatctctggtccacacaactgtcaaggtctcaagattttatgatgtttccattgtgatggtaatttgttgagatggctttctgggtaatttcgtattgctcttgttattcagtttcaaggattataaaataataatagcagccctgtgtgctgacgaatgcattctccataactatggctgctccttgatgagaagctttacagtactatatataaatgccagctgagtatttgttattattgttggacatcttttttcaaagaagcccagagcctggtgctgatatcatcccattaatctccatagccctgggcaaggtaagaccatgacagcaattttttaaatcccatctcggtcttctctaggttgctctgtaagaattgtttagatgtaagctggtgagtgctcaggaagccaaagtttaaagcaaaagttttaagcaaaagagtaacatgagctgatactaaaagccatctcttggcccggtgcaatggctcatgcttgtaatcccagcactttgggaggctgaggcaggcggatcacctgaggtcaggagttcaagaccagcccggccaacatagtgaaaccctatctctactgaaaatactaaaaattaggctggcatagtggcaggcatctgtaatcccagctactcaggaggctgagacaggagaatcgcttgaacccgggaggcagaggttgcagtgagctgagattgtgccactgcactccagcctgggcaataagagtgaaactctgtccaaaaaaaaaaaaaaaaaaaagccacctcttgtactactgaaggaggaatttatgcagacttcttagctaccagtgatttcactctgttttaatacaaaaatttacatgtatttcttttatgatttaggtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctggtaggctcatctgtgaatccttgctctctgacagaatgaacatcagacttacaaatgtaaactaattctacattactaaccaatacggaaaataaagtattgaaaaaatagattgtatcatcaaaatagccaatgaggacatggttataaggcctagcaaaacagaaacagaaatctttcatttctcccactaacctggcaaagagagaaaaagattttattagctcttttgggtcattcgacctcctgtgtgtatagtggcccctagtgttacatagagaaatagtaacagcagcatggactccaagaaccaaagaatttgcttatatataaagttttatatttatatatatatatatatacacacacacacacacacacacacacacacacacacacacacctggtttttaaaacaacactgtcatctaccctcatagtcattgtcaaactacactcagatttgctttttcactgattattgtgtaggtaaattctgtaaaagtgctgttacatgaagtcttatgctttgagaagcctaaaaggaaaacacatttatggaaaggtttttataccatccttaagagttaggtgttgagtacctgatctcttttaagaaagaacataacaaaacatttatttcttctacctctttatgcaaagtgcttcatgtacattatgtatcagttggccctcacatgagccttatgagataatcagagcaaatcttctctgaattttccagggtcccacttagtaagctgatgattagatttaacacaagactcctagtgctcttctaaacacactacgtcactgagctctttcaagaaatagagtagcaatgagaataaaacccaagaagtcttgacaaaactcttggattatgattctgataatggtaccaagatgttttcacataaaaatgtggtaaatatgtggactgtggtgctacaggttagccatgctttcaagttttgtacaaagtactctatattcttacatgctacaattgatttcattcctctaacctcaaactaaaacttcacttttctgctgttaaatatgccttttgatcacatagatacctcagtgcgcatcagctggcactcctgtcagaagacggtgatgcacagtaattggaagcaaagtctttggggtcagatctgctccagtcccggctcttgtcgattttactagtgtgacatttggcaaatagctatctctgcgacttagtttctccatatataaaatgggaatataatgcctcacagtgctttcctaaggattaaatcataaaaatgtgtatgaagctctgcataactagtaccctgcacagcaatgctgcaaagtggtagatgttattcttactgatgagttgctatgacattaagacttgttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaaagaaaataagtaaaccttattcattctctgaagtactttccaccactactacaactgatccaagaaaacaatttcccattggatggtattattcagagtgttattaacaatcagtcctgaatttttcagaatagtactaaagttgtcttttttttttaatgggttccttccttcaaggttataataaagcttttttataaccttcaaagaatacaaagtggaatttgtaatttataggatatacattcctagtttacaggtaactatttaaagctgccaaatttagataaagatgcctcccctttaaattgccccctttaaattctatggcatgtctcacttaagagttacaaatattcagaatattcatggcaaacatggcaaacggcagtgagggaatctaagtggtcaaattcctagaaatacttgtcctcagcaccactaggtggcagtagttggttgaggctgtgaatgatcggtaacataatcactagtagtgaagccatcacagatgctagcaatgacttaggagtctcccacagctggtcagacaggcattctgtgaagcagatggccagtggacagtgtgagcctatcagacttgaattaattgaggaaataaatgagcggaatgaagtatacagacctttgcttggtaaaagaataatttggagaggggactagcatcttaccacctggagtaaaaaatggtatcataaaagatctattcaagcaatattccaaaagccttctgaattctttctagtgctccttttgtatatcattgatagagaattcatctcatgttttcttagctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgaggtaagactgcacaatgagaacctgatccttaactgttcagtcctaatgatgtatcaaaagatacattttatatagcatggaaatctatgtgtaaaagccacatagatgttttgatttttgatgaaatcaatcaaagacaaaaaccatgcgttacccaatgtaggattaagcttttagaaggaagctatgggtgtttgatctaatggtgatttcttaaaagtgtttatcattctatctaaaagaaaagatgaattcatttgctttagtgataaaagactattcagtggtttttgtaaaggcagatcctcaactaggaattaagcacacagatgtattcaactcttgacgtctgttctttctcccattaactttaatggagctagtaatctctacagaataagtatgaccctattatcagctacttgcacaattctgtttctaatgatctaattaaaaatgatgcttcatgtccaaagccacttttaaaaaatttagaaccctaatgactttatccttttctccagcatgcaccaggacaaccacggctacatctgcctgctcattcagggagccacaaaagaagatgctgggtggtatactgtgtcagccaagaatgaagcagggattgtgtcctgtactgccaggctggacgtttacagtgagtgccacttcatctcatttcattgcgtttactcattaaattatgaaaaattagacatctggacagcaaatcacattactctttataaacaactattgtgttttatttgtcaaaaaaattcatattgctctctctctctttctatttgtagtttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaaggcataaccatgtttttcacatgttcttgttactgtgttctgcaaatgactgccttttaacatttcttcctatattctatcgcagtgtcctaatgcactctaaacgtgtgttccattgatcctggaatgcgtacttttgtggcttagtgcttttctcattaatatatcttaagcagccagcagtagacttgtgtttgtatatttgtgtacatgcatcccaaatttaaagaaaattattcctattgaatttacagtctagtacaatcagcattatgttatccattgacataaaaaaaacactagaaaaaaattaagaatttatttaagaatttatttcagattttgcctcttcttgaaataactatgtgagggtcatcaagaaatgtgtggcctcaaccttccctactgtacgattcctttcagttgattagtgttaaagcatccacatccagcagaattcctaagtgctataattattttagagaaaatattttttaaaaggagaggggggatgagaattaggaagcttatcagctattccaaaggattccctgtgctgcagtgtttacttaaaaaaaaaaaagataaactacacttgacctttgtaatctagctgctttattcccactatcctgtatagacagtaaatctgcaacatgtgagtaaaatgcaaaagtgttcctaaattttccatgtttctaccatggatgtgttcaggtgccttgcatctatctagacattctgtatttatttgaaatatctaaaggctttccaagtatatcttgattaaaaatcttaatttactctttttctttgtagcccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttgccaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaat

SEQ ID NO: 35706 - DNA, 33967 bp, Homo sapiens
aggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggtgagcgccctccttccctccccgttttggcactaacacgttctgtcctcgggaggagggtggtggcggggattttggagactctaaaaggccggaaagcctctgggtctgaaatgtggccctcctaaagcgaggggagagacgagatgttgggcgaatctccttgcacgtcttaagacggcgtcgaattcccccctggccactcacaagtctgaccccacccgtcttgggcttggagccaggccacctcctaaggaggcggtggttaagagcctggtgttctgttagcctctgagttctacttctttgtaccttgggatcttattccctagggttgtctggttccagtgaaaaaatatgtgtagtgcttctgtcaccaccctttgtggaaaatcggcccacactgacgtgcttgtacttctggagtgaagagaagcacgtttggcctatagtatttcaagttccacttggcttagaatatttttgttgcttccccccacccccgcaaagattcatttgcaacttagaaaattgccctctttcccagctactgtactttgctctcgagggatgaaactttggctttaatcacagattctcgaagtatctgagatgcgtaattggaatttagtgaccgcagaagcggctttaaaaatgcccttctcgccttttttcccatttacagtcgaaaagaacgatggactttttggtagtgagggaaaattaccagatgcttgtttcagtttctggatgagaatggacagatagtccaccttgcagctctgtagaggcacgaatcggttacattattagtctttccgcagttacagcatgtatttgaattttctgaagtattttggccgattcagagtttcctagatgtctgttttatatctctctcgtatgtaatggcgtggataagggtaaaaaatatatatatttaaaaaaccaaaaaggtatggaaaaaggattgctctcgacgttgagaacatcagcttttctgttttttttcaccatataaattagagtattctttcgaaaaatgggtggtggttatggtacagaccataacaggctactttgctgctacagtaaggcatgaaagagttcagcgaagttaactgtcttgcagaatttgggggattacagaatggaaaactgctatatagtattcatcaaaaatgattgcattgtgtgacttatatcgttgtatttattggcttgagtgcagggagattttagaaaaagaatctggtttttgttatcaaagatcttggagtggggatgagagagtgctgggaaatttcggagctagactggaatgagtctaaggaaacttgccagtccattataccttcagttataaaaggagaaaactcatttggtttaaattcgtttgtttagaatagcattaaaaggcgattcttcctatttaaagaacagagttgtctgccattctctcgtttattcctcctccctcccgtgcccttgtatattttcttagtgactgagcacctgagccagcactgattttttgtgtgttttgttgtttttgttttgggagacggagtctcgctctgtcgcccaggctggagtgcagtggcgtgatcgcggctcactgcaacctccgcctcccgggttcgagcaattctcctccctcaccctcccaagtagctgggactgcagacacgggcccggctaattttttgtattttagtagaaacgggtttcaccgtgttgcccaggcaggtttccacctacggagctcaggcagtccgcccgcctcggtcttccaaagtgctaagattacaggcgtgaactaccgcgcctggctttttttttttttttttttttttttttctctctttttgatacctcttggttggcaccagccgtaaaatgaatgagcatagaaatactatagttactgctaggatttcttttttgttttctttccatcacaaaactctcttggtttttaacttacattaacagcattgcttcctctttgtggtgccagtcaaccgaaaccatgaacctgactctcaaaagagccaaggtagggtttctaaagattaaaatgtttaattaagctagacatttgaaaagtctttttttatattggagcaactctgaaaggatgtttaatgcctactccttaaaaaaaaaatgataatgctaagtgccgtagggatgctaaagacttgtataggtctgcctgatcaagaatattttatattggccgggcgcggtggctcacgcctgtaatcccagcactttgggaggccgaggcgggcggatcacgaggtcaggagatcgatactagcctggccaacatggcgaaaccctgtctctactaaaaatagaaaaaattagccgggcgtggtggcgggctcctgtaatcccaactactcgggaggctgagacaggagaatcgcttgaacccgggagttggaggcgtagattgcattgagccgagatagtgccactgcactccagcctgggcgacagagtgagattccgcctgagaaaaaaaaaaaagaatattttgtatcacttgtgagaggctaacattagattgtccagatgaaagtgctacagttatacattggtatgtaatgaattttaatttggtctgtcattgtcctttttgtggtgcagaggagtcattctgcctagagattggagctaaaatacattgcagaaatttgttttagactagtctcttatgtagattgtgtgggtttatgtagaacattttgtgttcagaatgcttttattaaccttcttcatggtactcttgagaggctgtccttatctcttactgatgattagactgagacaagtggaaagtaaaggttagacaagatgtaaagtgtgtggtttgagctgtgatgagcacactagggagttccagataccagtttgatgcttattcaaccatttaggttatcggtctgcgagtttgttttctgcagtgtgtgcataactagtgttttgtcctcttagaggatactctggggacattcttgagttttctttgtttattcctttccgtttaaggaccagaagtaatattcttgaattttcatttgttcagatctttgctctgtaattaagattgcgtgagagtttgttgtttgggccagttaggctgttgaatttcttgggaatgtggtttcaggcattttttggtccctttgattatatcattgtatgtggaactttttttgagagagagagttttgctctgtcacctaggctggaatgcaatggcgcggatcttggctcaccgcagcctccgcctcctggattcaagcagttctcctgccctagcctcccaagtaactggaattccagtcctggccaggaactttttttaaaaaagaggagcacgatcataaaattaagtcagattctttcctaatcctatctctgatttgtttttaattgctttacctgtttatctcccctcacccttttgttgttgttgtttgagatggagtcttgctctgtagcccaggctgtagtgcagtgacgcagtctcggctcactgcaagtccgtctcccaggttcaagtgattgttgtttctcagcctcccaaatagctgggattacaggcatttgccaccatacctggctaatttttgtatttttagtagagacatggtttcaccatgttggccaggctgggtctggaactcctgacctcaagtgatctacctgcctcagcctcccaaagtgctgggattacaggcgtgggtcacctcacccggcctcccctcaccctttctaaagcagttttactatcattctaggaagtaattgttactgttggcagcttgtattacattgctgccgttccccattataagattgagatctcttaaaaaattggaattaaatatatttggactttatcaacagtggaaagatgatagatgtttgttttaaaataactatcacctaagtaactaatgtcatggtagaaaaaataaaaaaaattacctaagcaaaaatggaataaaagtcaccttgtaacgtcaccacccaaagattaaaggaaccttagtattttattaaatatccttccgatttggtgtattttatgctttttacaaaataggattgtattatatgttttgtaacttgcttttctcaataaagcttaccacattttaaaactgaatataatttcattcttactttgaatctaggattttatggaagaccttgggttatggaacagagaaaagaactctttagaaggtaaatcttcattatatgaaggagagaggagaaccttaaactcttaacattttcttttgtttgaagaaatactaacagtgaatagcccaggtgcattttgatggtttctcaattgcagaagttattttaccttggtcccttttttcttcacctaggcctttgattttcaaacttttcctggggagctgaataagttttgggcttcaccttacccagagctgttgtgttttttaagagtgttttgtatgttggcatacattgtaatacttaatttttttaaattccactgattacaaaaaggttaaaagctactgtcatagaatattagctttgtatgagatggagatgctccaagaagagggaaatggagattgacagcctatgaatgttgcctgtttatacatatgtaattttctttctccttaaggctccagaaatgggaattaaatacatacttgtatgccccaaaagatgactacaaacataggatgttttggcgagagatgtattcagtggaggaagctggtaatctttttctttttatccataaattcaaaatctgtgaagaaaacggttatattttaaatgtagttgtacaagaattttatgacattttatttttattttgtaggtagtttccttttcttctatctggtaactattcagttagctgagattgaaagagtgctctgcgctagcaaggtcatgaccatatgtgtgatatcatgggcgtgctaggctgactccatctgttctgtggtcatagattgtgctgcttacttctgccagtggattaaacagtgggccactgggcaaagaagtgctggagctgggctaggcccagggcaaggcaagtgaggcacgtaccttgggtgcaaattttaagggacccccaaaaagtaatcaacataaataatattttatgcaatttttttaaaaaaccaaaattaatgcagaaattcatgatgtacacaatgctaaaattttaggtaaagacaggatcagcactactgattgttccttttgcttcaggctctagtatggcttggccttgtcagcagttactggtccttaaaccctagtccaggaaagtgggaagccattaataggctgtctttgggttttgttttgttttgttttgttttttgagacagagtcttgctctgtcccccaggctggagtgcagtggtgcgatctcggctaactgcaaacctcgccctcccgagttcaagagattctgctgcctcagcctcccaaagtgctgggattacaggcttgagctcctgtgcccggccggcctgctatgggtatacttaacgttgagttggttacataaaattgataaaaagtagtatagcattgaaccgccaaattagagaggtgcttttctttgggaacttgtaaatggtgaaacatttttgtacttgaaattaaatggtatacgcatatagctaacaagatatttggttacagagcccagccaaggcacagaaggctgaaagttttcttgaattacaaagaagcaattacagcttaccccatctccatctagtgttgtggtttactactctatttaagtgtgccttcaacttaattactttctggtggtgctggtaatgaaacttaatgtgatcaataatcaaaatagagtaaaaatgactatcttgagatactactgaaaattattcaaaaatatgtcttatagtatatactagtagtagttaagttgatttaggaaaattgtcaattgataattttaaaaggttaaaatctataattaatgtttttcccatagatagaaacaggtcaagattgttaaggccatgacttaactctggttctttttctttttctttttttggagacagcgtttgtcactttgttacccaggctggagtgcagtgactcactgcaattttgatctccccggctcaagcaatcctcccgcctcagtcccccaagtagctgggactacaagcgcgggtcaccacacccagctaatttttgtatattttgtagagagaggggtttgccatgttgcctgtgctggtctcaaactcctgaactcaagcagtcaacttgccgtggcctctcaaagtgctgggattacaggtgtgattcattttttttttttttttttttttttttcattttttttcattttttgagatggagtcttgctgtgtcgtccagactggggtgcagtggtgcgatcttggctcactgcaacctctgcctccagggttcaagcaattctcctgcctcagcctccctagtagttgggattacaagtatgcgccaccacgcctggctaatttttgtatttttagtagagatggggtttcacaatgttgaccaggctggtctcaaactcctgacctcaggcagtcctcctgcctggcctcccaaagtcctggggttacaggcatgagccattgggcctggcctaccctgattcttaagaaagcattttctttctttcatattataaagtagttatgtgtaggtttatttagttaggaattccagctgttcagagatggcaaaacaaaaaaaaaaagcaagatccagtaccatggctcatgcctgcaatcccaacactgtaagaggctaaggcaggcggatcacttgaggccaggagttcgagaccagcctgggcaatatggcaaaaccctcatctctactaaacaaaaattagccgggtatgcctgtaatcccacctactcaggaggtggaggttgcagtgagtcaggatcgtgccactgcactccagccttgggcaacagagcaaggctctcaaaataaaaaagcagcggctgcattttatgcctttcaaatgctgcaggaaatagaaatggcttaagttcagtaagagaattgacaattcagtgtttttgagaagtggcaatgaaagggaggaaaatgtttattgattttagcctgtttccccaaaaggataagaaactatttggaagtgaaaaagaagggcctcttattttctgttggttcagatttcaaaggtgtgaaaactattctttttcccttactgtgacattaaatcacttcaggcttgtaccattttgtatggcctgttgttaagttggacatgacaatttgtaaaatgtgaggatcttttcctttcttgtaagttagaagaaataacctcttcagttaaaccttcagtgaaggttcttttagttttctgttctgctttctaaaaacatagactctgttctttagagcaacttatgactctcatctctgctgcacgagaatatgagatagagttcatctatgcgatctcacctggattggatatcactttttctaaccccaaggaagtatccacattgaaacgtaaattggaccaggtaactccttactttttattcatttttcctgactatgtacttgaaactagaagtttactcagttgcttttacgatgttaaaaggaaatcaaattcctatttctttgttttctttttttgtttgtttgttttgttttttgagacagagtcttgctctgtcgcccagactggagtgcagtggcacaatctcggctcactgcaacctcctccgcctcccgggttcaagtgattctcctgcctcagcttcccgagtagctgggactataggtgcgtgccatcatgcctggctaatttttgtatttttagtagagacagggccttcaccatgccagccaggctggtctcgaactgctcacctcatgatcttcccaaagtgctgggattacaggtgtgagtcaccatgcctggttttttatttctttgtttctataagaattttttttactttgaatgctttttttttctttttttttttttttgagacagagtcttgccctgttgcctggagtgcagtggcccaatctcggctcactgcaacctccacctcccaagttcaagcgattctcatgcctcagcctcctgagtagctgttacaggcacaccaccatgcctggctaatttttatatttttagtagagacagggttttgccacgttggccaggctggtctcgaactcctgactttaggtgattcacccacttcagcctcccagagtgccgggattacagtcgtgcgccagtgcacccagccttgaatccttctgatagaggaatattttccaaattaagtaaaaagagctttactggaggtactagttcttctcaaatttcagtttgcataagaactgccttaaaagaatgattagaagtgaagcttggaagaatgctgactgctggactttatttcccaaatggataaggtggggaccgggaatctaggtgattggtggtcaagaaccacattttgagaaattatatataccctaggctgcttggcttgaatttacacctgagattacagaaacagggttttacctattagacattagtttcttcaattatatggacgaagagatgtctggaaatggctagtttcccaagatgagaagaaaaacagactaggtgaacctaattgagtgtaaagtctgcttaatgtaaaagctgcagacttcctttggtccaatgtagggggcttccattttcctttttttttttgaaactgagtcttgctctgtcgcccaggctggagtgcagtggcgcgatctcagctcattgcaacctctacctcctgggttcaagcaattctctggcctcagcctcctgagtaacggggattacaggcatgtgctaccacacctggctaatttttttgtatttttagtagagatggggtttcaccatgtttgccaggctggtctcgaactcctaacctcatggtttgcccgcctcggcctcccaaagtgctgggattacaagtgtgagccactgcgcccggccccatttttctgttattttagtttgctggtttttctatatacatgtcttatttctttaggcaaagatttatatgggtggcattaaaatgtctggtaaaaaatttaaggcagttgaaattttcatgaatgaagttattttactatttgataaaattctattctttctgattcatacctggttaggtttatctgcaaagggatcagtgtgccttttgggactaggacacagcctggctttttcatgtcttaaggttacttactcatgtttctgtatttttctgactttgttgggtcttctacaatcagcagcagcccatgaggactaggaggctaggccactttgttggatcatattgtcatataagttgagtatccctaattcagaaatctgaaatgttccaaaatatgaaactctttgagctccataaaattcaaaggaaatgctcattggagcatttcagattttggattttcaggttagggatgctgaatataatacagatattccaaaatccaggaaaaaacaaaaatgaaaatccaaaacatttttggtcccaagcatttcagataaggaatactcagcctgtagtgcattcaaacccaaatgagaaatgggtcccaaaactgtttaacttacgattttttaattgaaaatgtaaaaacaataaatctgtctttgaacattctagtaaggaaaatactggattttaagtataactgttaacgctgtaatgtttggaattcttaatttttttactcttgattcttttttttttttttctcctaggtttctcagtttgggtgcagatcatttgctttgctttttgatgatatagaccataatatgtgtgcagcagacaaagaggtattcagttcttttgctcatgcccaagtctccatcacaaatgaaatctatcagtacctaggagagccagaaactttcctcttctgtcccacaggtattgtatataatggctttacatttaactagtcttcttggaatatataacttataaaggaccatgggccccattctctctccacttccctcctcctttggtgtgtaaaagtaggaatctttttttagaagacatttttcaagatcctaaattggagaaattttaggaactaataaatgacaactgactaggcaaaagatttttatgtatttttaagtactggaagtatatgaacattacattgtcaatattaaaagagggatagtattgaaatgaaaactggagaaaaaccaaattacattgcttttaccttagtcacttctcatttcctcctacttgtcccctttttctgcccatgcatatctgtccctttttgcactcctcccactcccatctgggctcttatttcaagtagtcagcatagaaagcttaacagtttttcccgttttcctttctttttgcccctctggtttctttcattgaaaatattttagtctcttagttgcttctcaaaattcaacttacaggaagttttccccacacttccttgttcaggaagaattttagattaaattatttaactttctttgtgtgtattgtgagccgagaaccttattttagttgagtactacattagtacccagaagttttaagattatactgggaattaattagctgcaagttacagtttaagttgcagttgagtactaatagccattggtatatgcctttaaaaaaattttttttaaattttacttttaagtttgtattatttatttagagaccgggctataaaactggctaatttttatatttttggtagagacggggtttcgccatattgcccaggctagtgtcgaactcttgggctcaagtgatccacccgcttcagcctcccaaaatgctgggattgcaggtgtgagccactgtgcccagctgccattggcatattcttgtattagttctattatgatattatcaattcattctgtttggcgtttaattgtaactgagaaaagtaggcaattcagaattctgtagaaaatgctgcagttcttgtttttttagtaaacttgtatttctagtaactgtagtatcgtaagaattgatctgtactactgttggaggaaaaataccagattttatgaatttcttaaatgaactgcccactttagttccttgtaggaggccttttatcatttagatgaaaataatttagaattggcagacattttttccacattcaaaaacccatgggccttttgggaggccaaggcgggcggattgcctgagctcaggagtttgcgaccaacctgggcagcatggtgaaaccccatctctactaaaatacaaaaaaaaattagccgggcgtggcggcgtgcgcctgtagtcccagctgcttgggaggctgaggcaggagaattgcttgagcccaggaggcagaggttgcagtgagccgagatcgtgccactgcactctagcctgggcatcaagagtgagactccgtctcaaagaaaacaaacaaacaaagagaaaacccatgagcattttaattctgacttttttacttttctccctacatttagaatactgtggcactttctgttatccaaatgtgtctcagtctccatatttaaggactgtgggtgaaaagcttctacctggaattgaagtgctttggacaggtaagtcttttaagatttatacagtcaaagttgaattaagtaggacttgcagaaattgcttgttcttgttaattgaatacttttttttttgagacggagtctcactctgtcgcccaggatggagtccagtggcatgatctcggctcactgcacgctccgcctcccaggttcacaccattctcctgcctcagcctcccgagtagctgggactacaggcacccgccaccacgcctggctaattttttgtatttttagtagagacagggtttcaccatgttagccaggatggtctcgatctcctgacctcgtgatccacccgccttggcctcccaaagtgctgggattacaggcgtgagccaccacgcctggccttttttttttttttttttgagacagagcattgctcttgttgcccaggctggagtgcagtggcacaatctcagctccctgcaaactctgcctcccgggttcaagcaattctcctgactcagcctcccaagtagctgggattacaggcacacgccaccacacccagctaatttttgtatttctagtagagacggggtttctccatgttagccaggctggtctcaaactcccgacctcaggtgatctgcccacttcggcctcccaaagtgctgggattacacatgtgacccactgcacctggcccagagaacttgttaaaatacgctttcttttacaaagtttacatattctcttaatatgaaaaaacatctatcatggttggggagcctgagtggggagcctgaggtggaagcccccaggagttcaagaccagcttagacaacatagagagactgtagaaaaaataaaaaacttagccaggtgggctggtgcacacctgtagtcccagctacttagggggctgaggtggaaggatcacttgagcccgggaggtagaggctgcagtgagctgtgatcatgccactgcactccagcctgagcaacagaatgagaccctgtctcaaaaaaaattcagttaataaataataaagatttatagggaattgggctaaaaggtattgatcccatccttaagcagcgttaggaaactcttctattttataaaacgaaaaaaataaagctcagtaaaagacatgttgtgttttcaaaagaaaaattgtggctgggtgcattggttcgtgcctgtaatcccagtgctgtgggaggcttgagttgaggtaggaggatcgcttgaggccaggagtttaagattagcctgggcaacatagcaagcccttatctgtacaaaaaaattttaaattactgtgacatggtggggcacacctgtagtcccagctacttgggaggctgaggtgagaggattgcttgagctcaggagctcaaggctgcagtgagccatgattactccattgcacttcagcctgggtaacagaggagaccctgtctcagaaaaagaaacgttgttataaaatgtacatgtaaggggccaggcgcagtggctcacgcctgtaatcccagcactttgggaggccgaggcaggcggatcacagggtgaggagatcgagaccatcctggctaacacagtgaaaccccatctctactaaaaaatacaaaaaattagccaggcgtggtggagggcgcctgtagtcccagctactcaggaggctgaagcaggagaatggtgtgaatccaggaggcggagcttacagtgagccgagatcacaccactgtactccagcctgggcgacacagcgagactctgtctcaaaaaaaaaaaaaaaaaagtacacgtaaggaaaacaataaaaagttatatatgcagtatattttaaagaaccatgattcttttttttaaatatattttttaatttaaaataaaaagatagggtctcgctgtgttgcccaggctggtccgaactcctgggctcaaatgatctgcccacctctgcctcccagagtgctgggattacagttatgagccaatgcgtctagccaagaaccatgattcttttaacgaacggttgtcgttatttctaggtcccaaagttgtttctaaagaaattccagtagagtccatcgaagaggtttctaagattattaagagagctccagtaatctgggataacattcatgctaatgattatgatcagaagagactgtttctgggcccgtacaaaggaagatccacagaactcatcccacggttaaaaggagtcctcactaatccaaattgtgaatttgaagccaactacgttgctatccacacccttgccacctggtacaaatcaaacatgaatggagtgagaaaagatgtagtgatgagtaagtagcctgtacttgatctttcaccttgggaggagagctggggttaactagagccagtggaaagtatgcattcctttgtcatcacaacttaaacagttttatttatttttttaaaaacgtattttgttttactaaggaggaaacaaaaccaagtggttttattatggtatgttgtttcattctgttgatgaagatgtatatgatagaagaaaggttgagtgtctttggacaagtcacttaacctctttgccttagtttttttttttttgttttttttttttttagtatgattcagaagcagcgtggtggctcgcttataatcccaggaaatgcactccagcctggacaacagatgaaaatcctatgaaataaataaaaataaaatatggttcagtctttgaagtctgagtactagaggagacagtcttttaagtgtttccattatctctagaatcattcggataaaatgtattttcaggcaattttattgaaaaggatattttagataactagatactcttgagtcacttagatcatttagattcagcttacatttatcttttatggaacatactctttttttttttttttgagatggagttttgctccatcgcccaggctggagtgcagtggcgcaatctcagctcgctgcaacctctgcttcccaggttcaagcgattctccagcctcagcctcccgagtagctgggattgcaggcacacccggcttttttttttttttttttttttttttaaagtagagacagggtttcaccatcttggccagactggtctcgaactcctgaccttaggtgatccacctgcctcggcctcccagagtgctgggattacaggcatgagccaccctgcctggccgaatggaatacagtcttattttagacattggcttactaatttttaatttatgaaaaatctctaattaatagagttctaagtaaggtgcttgataattatttacatttaaataatctgtcatggggcagatgcatgttcatgggcactgagggggcaaagaataaagtagttttttttttttctttttgagatggagtcttgctcttgttgcccaggctggagtgcagtggcgcaatctcagctccctgcaacctccgcctcccaggttcaagtgattctcctgtctcagcctcccgagtagctgggattacaggcatgcgccaccatgcctggctaattttgtatttttagtagagacggggtttctccatgtcaggctggtcttgaactcctgacctcaggtgatccgccctcctgggcttcccaaagtgctgggattacaggcgtgagccatcgcgcccagccattcctacttttgagaaacagtctagtgttgggtaaggcttataggcaattgtactatagtgtgataagtgttgtaatagtttaatttataaagtgctgtgtgaacacgggagagagtgattatttttgctaagagatttcacagacttttaagctggatcaaagtatgaggagagtttgctgggcgttaaaggtttgtgggctggaggttaaaaacactgaacactgaaaatttttttttttctttgagacagagcctcgctctgttgcccaggctggagtgcagtggcgcgatcttggctcattgcaacctctgcctccctggttcaagcgagtctctggcctcagcctcctgagtagctgggattactggcgcacaccaccccatctggctgatttttatagttttagtagagacagggtttcaccatgttggtcaggctggtctcgaactcctgacctggtgatctgcctgcctctgcctcccagagttctgggattacaggcgtgagccactgtgcccagcctgaacactgaacttttgaagttccctgaattttggcccattttggctactgaagtgtcatgatagtatgtagtaatattaatagttgtcatctgtttctcaattccatacctctgctttgaattgtttattgaattaatgtctcccttttgtttggctcagtcattgtcatcctcctcccctcaataaaaaacaaattgggaatataatttaaatgctgtcagcgtacatggcacttaactcctacatcttttaaggcacagcaaggaacatactaagggtggcagacactatccaaacctgggacatacgtaggaaatattaaggaaagctaagaatagagagtttttaagtacaaaatcaaaaaattcagacttaattttctctaccactatcctggctcagagctttgttgccttatgtgtgctaatttgtgggtctctgtcgattatctcttttttttttttttttctgagacggagtcttgctcttgttgctcaggctggagtgcaatggcccgatctcagctcactgcaacctttgacacctgggttcaagcagttctcctgcctcagcctcccgagtagctgggattacaggtgcctgccaccacgtctggctaattttttgtatttttagtagagatggggttttaccatgttggccaggctagtctcaaactgcagacctcaggtgatttgcccgcctcagcctcccaaagtgctgagattacaggcatgagccaccatgcctggcctcttctttttccctcagcgcctttattaatgaagttacagtcggttgtagtggctcacgcttgtaatctcagcactttgggaggcccaggtgggcagatcacaaggtcgagttcgagaccagtctggccaacatggtgaaaccccatcttcacgaataatagaaaaattagctgggcatggtggcatgcgcctgtagtcccagctactggggaggctcaggtgggagaattgcttgaacctgtgaggcggaggttgtagtgagccaagatcctgccactgcactccagcctgggtgatggggtgagactccatctcaaaaaaaaaaaaaaaaaaaaagaagttacaaggccctgaaggctatgcaatgttttcttcatacgaaaagcatggtacttttgaccttgacttcccaacaattagtactcagtagacggttaagattgactcttccactgatactaaaatttatatttcttatttcaattgagattttacatttaacattacgtttaggttactatcctatatgaagtggtttggtgaagggtcttgcttttatttgaatttttatgtttaaggtttgttctcattctgttctttgtttctgtggttatactgtgaaaactagttgcatttattcttctcacttgtcagaaggcttttgtaatcaaaactatttttgtgcttttttattttattttttgcagctgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtgagtttggccattctttgttaagggggttagatcacatagttgagtcacaaagtaaagaacactgtctcccgggtgtggtggctcacacctgtaatctcagcactttgggaggccgaggcaggcggatcacctgaggtcaggagttcgagaccagcctggccaacatagtgaaaccttgtccctactaaaaatacaaagattagccgggcgtggtggcatgcgcctgtcgtcccacctacttgggaggctgaggcaggacagtcgcctcaacctgggaggcagaggttgcagtgagccaagattgagccactgtactccagcctgggtgacagagcgagactctgtctcaaaaaaaagaacactgtcatgtgccttaccttatgcccactaagcaaagtgaaattaaatgaaattgggggatctagagaataaggatttttaaatcttacttttggtcttaaatattagcttttattttgatggaatgctaatttctcttaaaaacatattttttgaagtaatttaagggtttttagacacaaattttcaaaagagaatgtaatagtagatgttggcatgtttacctcccaacgcccttccattcctgcatccctagtagtatagagaaatctcatttttcttagaggtcaaattaatttggatctaaaattgaggttccacttaacaaatatgataaagcatctttctgaatctaatgtgttctatctctaattctgattatctgtgtgaccattttatttatacatttatttatttttgtaggtaggcaagttgcacacagtggagctaaagcaagtgtagttgatgggactcctttagttgcagcaccctctttaaatgccacaaccgtagtaacaacagtttatcaggagcccattatgagccagggagcagccttgagtggtgagcctactactctgaccaaggaagaagaaaagaaacagcctgatgaagaacccatggacatggtggtggaaaaacaagaagaaacggaccacaagaatgacaatcaaatactgagtgaaattgttgaagcgaaaatggcagaggaattgaaaccaatggacactgataaagagagcatagctgaatcaaaatccccagagatgtccatgcaagaagattgtattagtgacattgcccccatgcaaactgatgaacagacaaacaaggagcagtttgtgccaggtccaaatgaaaagcctttgtacactgcggaaccagtgaccctggaggatttgcagttacttgctgatctattctaccttccttacgagcatggacccaaaggagcacagatgttacgggaatttcaatggcttcgagcaaatagtagtgttgtcagtgtcaattgcaaaggaaaagactctgaaaaagtgagtatgtttaatgtacctgctgctgaagcctgggtggttccccatactggtaatgtggaaaaggttcttaaatgagtacactgtaactgacagaaaattgaccatgttttagaatatgttctttaggccggttatgatggctcatgcctgtagtcccagaactttgggaggcagaggcgggcagatcacctgaggtcaggagtttgagatcagcctggccaacatggtgaaaccccatctgtactaaaaatacaaaaattagccgggcatggtgacgggcacctgtaatcccagctactcaggaggctgaggcaggagaatcgcttgaagaacccgggaggcggagtttgcagtgagctgagatcgtgccattgtactccagcctgggtgacgagagggaaactgtctcaaaaaaaaaaaaaaaaaaaaagtatgttctttacagtggatgtggactctactaaatctggtaccttcagtttcatagtttgcccttctagttaagaatgaggaaaggtcattattttaggaatatttgtcagtttggggagacacaaaatgatactttaatggttaagataaattgccagtacctgacaacataagcagcttaatgtgtaactgtgtctcagattattttgttaagcttacagttttttgagtctttttattgatcttcaatagattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttaaaagtatgttagaaagtactgactttaacttgctctgactgaatgctttctggatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaatactatgatgggtttcatggtcttggttgtgaaatagatatctgaaacaccgtgagcttagaataaaaagtagtagtgagattttccactttctgcctgtatacctttgagctcttaaatatttaaaaaaaaaaaaaaaaagtttccctgtgatacaactaattagctactaaaagtagagtctcagattgttaatttgaaaatagataactttttttggattgctgtaataacaggtagaagagagtattttgacctcatgttaaaaggctctgtatagcttcgggcgcggttgctcacccctgtaatcccagcgctcttggtggctgaggtgggtggatcacttgagatcaggagttcgagaccagcctggtgaaaaccagcatgagaccagcatggtgaaaccctatctctactaaaaaaatacaaaaattagccaggcgtggtggcgcatgcctgtaatcccagctacttgagaggctgaggcaggagaattgcttgaactcaggaggcagaggttgcagtgagctgagatcacaccattgcactccagcctgggcgatagagggagactccatctcaaaataaataaataaataaaggaaatactgaccgtgcgcagcggctcaaacctgtagtcccagcacttagggaggcctaggcgggcagaccacaaggtcaggagtttgagaccagcctggccaatatggtgaaaccccatttctactaaaaatacaaaaattagctgggcgtggtggcatgtgcttgtagtcccagctgcttgggaggctgaggcagaagaatcacttgaacccaggaggtggaggttgcagtgagccgagattgtgtcactgcactccagcctgggtgacagagcgagacttcatcttgtggggctggggggaggctctgtatagctcctgtacatgggagacatctacccttaggctcaagagacctcaatattggttgctggatgacaacatttgccttccaggtttctgctcaggttcttataattcattcttatagggatttaaacttaagtttctaaggcccttaggaattttgaacctgaaatctggattattgagcttgaaatgtattacagaaaacatttgatattcagtttttaatttaagaattattaaaagttaaattcttaatgatacacagtattgtttctttctcttctcagggtttatctctgcactgagcatttatggtggtagctttccaaaattatatagatacctcttacacaatctcaagctcttacagcaagcttgtccagcctgtggctcaacacaagtttgtaaactttcttaaaacattgtgagtttttttattttttattttttttaagctcatcaactatcattagtgtattttatgtgtggcccaagacagttcttccagtgtggcccagggaagccaaaagattggacaccccttgtaacatcttagaagttttaaataattatcttcatatccacatagctttacaaaagctcacgacagggagagtattttcttggttctgtagtaatttcagggggtttactgattggaacccttccttttcctcctctctccagtccagctggcattcagtcctttaaacaatgtggctatgcagtacttttgattactaatgacttctattatcttcttccccattgtgtacagatgggagaatcctcagcacaagtgtctactactattggatggacagcggcagatgttcacagcgcgtcatgattaattagtttaaattgcaaggttctatctgtgaggtagctcaggtagatttaagggcggtagacatgaactgaagtcacgtttgcgcagcgactgaggcattaaccatgttttcatttacacagctcttcgtacatgcagctttttattgtaatagttggaagtgctagttatgttgtagtctcaaagtagggggtaggggaaattggctgatcttaaagtttgagaggtatagtttttttcctgcagtgtaaattacactgagttacggaatgggacaggttctcgtatagtctaaattttgaccctgtttcatatttattttacaaatactacattttatgttttttaaaagtacccctacccttgaaaaatgacaaaccagatacaaactcttaatgggcctgaattgttaacaaaaaattggtttgctttgggactgtctgactagcacactatatttgtactgatgagactgttaacttgaacaggaggtagaatgctgtcttccaatggaaaagaactatattgcgctgctttatcttgtcagaagactaggcaagtgattttgatttggcctccaaacatttgcctttatgtcttactgttagctagcgttattgcctattaagttagttaactggtgaccttaaatagagacttctgtattccatgtgtatgttcagtgtattgcaaagattattataatggctggtcagaggaaccagatactgtcatacttttaagaaaagtatatttagctctgggcaaaataacatcaattggctctccttagttctcagaatctgtcagactggtattattagccaagtctgattttgaattgtttttgtccaaaaaaatttttctcattatgtttcattttgtcaacttaatttcttgtattttattctactgaccttagttttctgacaagattaatccttctcccccgcccttttcccttacctgtacccttcctcaaaatgtaaaatgtgacttcagacaggttgaattccttcatgggctgtgataataaagtgtctaattatcagtcattttagttaatagttactataattttatgacagagcaagcagctagcttgatttgtataatatctagggaatatataaagttgactcagacaaacttgggacttactttccttccagtaattaaagagtagaactgataatactgattattcattaattggaggaaggaacattagtattgaaatgccgttaacattttaaaaaataataattattatcatagccttgccctgaaaccctgattattgttagagagttatttccacgaagtgtttgtcagtttgttggacatttgagaccccaggaaatcccctttctcgtaacgttctccgcttggatctgatctcaacagggtgtcgtagtcattcttcagcacaattcttaattggagaccaagaaccctgggcctttagaggtggtctagcaggagagttccaggtatcaatatgaattcacaactgaattgacattttctttgttttatgagaaaccttatgttgcgcatcagatggctggaaggattggtctgccgaaggctttctagtcccaaattcaatttagttacatagctggatttttaaatcaaattttcctcctctttcacagtaatttctgaaggagatgctgccaatcccccccgcgcctgcgaagcgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctccttttttttcttcccacagcgtttgctgccaattgatggggcaaatgatctcttttttcagccacctccactgactcctacctccaaagtttatactatcagaccttattttcctaaggatgaggtaattgtctctctacctaccaacttggtgtatgggtatggtgcacacttaaaacttaaccttttaactcactggttaaaggaatccttctgtcttaaaactgcaaactttagatggagaaagttcattaaaacattcagtgtatcttgagaaatttaaggagtttagacttttaacatcttgtgccaagttctttaatttctcccttgagaaagtcagatgaaatgtattcagagttggagttacaaaatagttaatgtgtctaaatgatgtgttgtccttagactaattatctctaatatattggtgttctgtaattttctttcaattgtgaagtatctacaggctgttgacaatcagctaaagaaaaaagcaagactgtttaaagacagtaacagggccaggcgcggtggctcacgtctgtaatcccagtactttgggaggccgaggtgggcaaatcacctgaggtcaggagttcaagaccagcctaggcaacatggtgaaaccctttctctattaaaaatacaaataggccgggcttggtggctcatgcctgtaatcccagcactttgggaggccgagacaggcggatcacgaggtcaggagatcgagaccatggtgaaaccttgtctctactaaaaatacaaaaaaaattagctgggtgcggtggtgggtgcctatagtcccagctactcgggaggctgaggccggacaatggcttgaacccgggaggcagagcttgcagtaagccgagatcatgccactgcactccagcctggggcgacagagcgagactccgtctcaaaaaaaaaaaaaaataataaataataaaaaataatactaaattagctgggcgtggtggcgggtgcctgtaatcccagctactctggaggctgaggccggagaattacttgagcctgagaggcggaggttgcagtgagccaagatcgtgccattgcactccagtctaggtgacagagactccgtctcaaaaaaaaaaaaaaattagatgagtatggtggcgtatgcctgtaatcccagcgaattgggaggctgaggcaggagaatcacttgaacccaggaggtggaggctgcagtgagccgagattgcaccactgcactccagcctggtgacagcaagactttgtctcaaaaaacaaaaaaaccatcctctgcaaaagccaattctcagtattcctaaaaccttgctgttttttgctggttttacaaatctgactcaatgaataaatctttattttacaaagaagaggtgatatttctgatagatgtttctgacaggccattttgttactccctccccagactgacttgtgagttatattgttagattctgctgccatttttcttgatgtgttgcttaactagattatattttcaggcatccgtgtacaagatttgcagagaaatgtatgacgatggagtgggtttaccctttcaaagtcagcctgatcttattggagacaagtatgtgataagtatttggatttgagagtagacctttcatagtgaggcttatcaggttgaggggaggtgatgactggaaatatatttatttattttaaatcccactttggctttagtaaaatctgaatatgtgtgcatttctagtttcttacaccaaatgtaggttccgtaagttcatgcaagtacagtgggtcttggatcactgaagtctgaattttatattagcaactgaaaagtttactgtggcctctttccttctgagcaggttagtaggagggctgctttccctcagcctggattactgctttgtcctagaagatgaagatggcatatgtggttatgccttgggcactgtagatgtgaccccctttattaaaaaatgtaaaatttcctggatccccttcatgcaggagaagtataccaagccaaatggtgacaaggaactctctgaggctgaggtaatacaaaggttaagaattatactatggtaatggtcttttttatttatttatttttattttttattaaagtacttactaaaatggaaaagtacatagatacatcataaaatcttagtgctttctaaattaattttcttgcagaaagaattcttatggcttattcttagcatgacatttttcactgtttccccaatattgggacagttttttatttgggagtactattgtaatatttcctcaggtgaaaacacaataaagacaaagaacatttttttcctctgttttaaagtttcatacttaaagatgttatggtcttggtcaggcacagtggctcgtgcctgtaatcccagcactttgggaggccaaggcgggtgtatcacctgaagtcaggagttcaagaccagcccggccaacgtggtgaaactccatctctactaaaaatacaaaaaaaaattagctgggtgtggtggcgggtgcctgtaatgccagctactcaggaggctgaggcaggagaattgcttgaacccaggagcgggaggttgcagtgagctgagatggcgccactgcactccagccggggcagcagagtgaaactctgtctcaaaaaaaaaaaaaaaaaaaaaaaaacaagatattatggtcgttttgttgagtactcaggacaatttaagtaatttaaatctatttggtggtttctcagaaggttaataacttgccttctgactaatgcattctacattgtgatttaaaaataagagctcttgagagtctactttgtgataggagcacttcttaataagtctgtcctgtcccaacttaaatacatttttcatctccaaaaaagttttatgccccatgttggccaacacattacgtgattattttggtttatacatcagtatatgttgttgttgttttgagacagtgtctcaccttgtcacccaggaatgcaatagcacaaacatggctcactgcagccttgacctcccaggctcaagttatcctcttgcatcagccctgcaagtagctgggactacaggtgcaagccactacgcatcagctaacttttttgtattttttttgtagagatggggtttcgccgtgttgcccaggctggtctcaaagtcctgagctcaagcagtccgcctgcctcggcctcccatactgctaggattacaagcacgagccactgtgcctggccagtatatgcattttttagatagttccttcttgaggatagtttttatgcacagtaaataagatatttggacccctacttgtgatacttttttcttttcttctatgttgtttctcttttccttttctaaaattctctacccctctccaccacaccaaagtattcatagtctttttatttatttatttatttttttgagacagagtcttgctcttgttgcccaggctggagtgcagtgacgcaatcttggctcaccgcaacctccacctctcaggctcaagcagttctcctgcttcagcctctcgagtagttgagatgacaggcatgtgccaccacgcccggataattttatatttttaatagagacggggtttctccatgttggtcaggctggtctcaaactcccgacctcaggtgatccgccctcctcagcctcccaaagtgctaggattataggcgtgagccaccgcgcctggcctcattttcttcatagtttatttctatattttaccttctgcccttagtcacatggctgtgtaacaagaggctggtttggtgttgcctcgcttacttgggattacactgacactatgctggtgattgagctgctgatgtattgctgttccacatctgacacttttcagcataagaactttttaaaaattgtggtaaaatataaataacataaaatttgcacattttcatgtaaggaatacgttaatttaaaatattttatgtattttaaatgattttagatttacagaaaagttgcagagttaaaacagagtttctgtatactccttatccattttctgtattggtgaagtctaagtaaccaacatgggtatattattaatcagacaccaaactttattcaccagttttttctgctaatgtccttttcctgttccaggatccaataccacatagcatttagacaaaatttttttttttttttttgagacggagtttccctctgtcgcctggggtggagtgcaatggtgcgatctcggctcactgcaacctccgcctcccaggttcaagtgattctcctgcctcagcctcccgagtagtcgggattacaggcgcccaccactaggcccagccaatttttgtatttttactagatacggggtttcacgatgttggccaggctggtctcaaactcctgaccttgtgattcacctgtctcggcctcccaaagttctgggattacaagtgtgagtgagccaccacgcctggccagaaaacttttttttttttttttttttttccccgcccaggctggagtgcggtggcaggatctcagcctactgcaacctctgcctcccgggttcaagcaattctcctgcctcagcttcccgagttgctgggactacaggcgcacgccgccatgactggctaattttttatgtttttagtagagacagggttttactttgttgcccaggctggtcacaaactcctgagctcaggcagtctgcctgcctcagcctcctaaagtgctaggattacaggcgtgagctactagacccaacccaaacttttttttttttttttttttaagacagagtctcgctctgttgcccaggctggagtgcagtggcgccatctcagctcactgcaagctccgcctcctgggttcacgccattctcttgcctcagcctcccgagtagctgggactacaggtgcccgccaacacgacctaattttttgtatttttttttagtagagacagggtttcactgtgtcagccaggatggtcttgatctctggcccaagcttttaaaagtgaaaacggtggccaggcacggcagcacacacttgtaattctagcacttcaggaggccgagatagaaggatcactcgagcccaggaattcgagaccagccctgacgatataaatagggaaagagagagagagagagagagagcgcgtgcacgcgagggagaatgcctgcccctctccagcctggccaacagaaggagatcctgtctcaaagaaagtgaaaatgcttcagctagaattataggataatcctgtgtgagataatttacatagtgactggaagagttattaaatattgctttcttgttgctaagttctgtagttgggttagatatctaatgcgtaactattgtgaaagtcaagagattctaatttttccagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggtgagtacatatttgtggagttggtggtatttgggcaagatagggaaagaactatatatttttggatataaaaggaaagaagtgaattgtaaatttatactgcttttcccaccttttatgatttggtttctgaattaattagtggtgaagaatcgcatgtgtattaataattgagaaatgctggttgggcttagtggctcatgcttgtaatcctagcacttcgggaggccgaagtgggaggatcacttgagtccaggagtttgagaccagcctgagcaatatggctgagaccccatctctacctaatttaaaaaaaaaaaaaaaaaaggccgggcacggtggctcacgcagcactttgggaggccgaagtgggcggatcatgaggtcaagagatcgagaccagcctggccaacatggtgaaaccctgtctctactaagagtggtggcaggcgcctgtaatcccagctactcgggaggctgaggcaggagacttgcttgaagccgggaggcggaggttgcagtgagccgtgatcttgccactggactccaacagagcaagattctgtctcgggtgcgggggaagctgggtgcagtggctcacgccactcattattgaattttttgaatatgaatttttttaattgtgtgaaatgtaggagctggtgtagacagacaagccctgtttatattaaccatctcgaagattatagttttatatctataattatactaattaagtgacttatttatgttttgaatatttgttttatttctaggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtg

SEQ ID NO: 35707 - DNA, 33967 bp, Homo sapiens; identical to SEQ ID NO: 35706

SEQ ID NO: 35708 - DNA, 23075 bp, Homo sapiens
gctgcccgcccagttcctgttcccagactgaggcccagcccccttcgcccgtttccatcacgagtgccgccagcatgtctgacaaactgccctacaaagtcggtgagtcccaggacctgcagccggttgcggccgcccggcacccgcccggggcttgttcgtggcgggggctgcagggccgactcggggctctctggaccccctggaatcgcagcctcggcgcgtttctggccgcgcgaagccagctggaagttggagttctcgcgcggccatgagcgggccgttccgggtggccgtggactacaagtcccagcatgccccgcgacgccggggccgccgcgcggtctgcgagccgcaaactggcggcgtgctccgcgggagagcacacctggccacggcctgggacggctggcacctgccggaccctgctcggggggcctgcgcccggcctcctaggcctggaccggaccctgtccagctgggcggccccgacgagcgtccacccctctctgggcctcctacagggacggcgagggcaccccggagggtgtatgaggagaggcctggaaagcgagccccaggccggctccgatcctcctctcccctgggactttgggccagttacccaacctgtggggtcccccacccctccagcaggggcagccttgcagaaatctcgaagaaaatttggagtggtttgaaaaatcctgctgtcccaccgattgaagtgtaatacagggatagttaacgtttacttagtgtttcctgtgggatcggcactgccttctagctttattctagtctcatggctctatagggaaactgttctcattttatgatgagaatcctgaggcagaggtaacttgccctcagtcttacagctggtggtgatggagcaagattggaacgcaggccatctagatctctgagcgcaccctttcaccactgtgtgcaagcgaatacacgcggaacaatcctagtgaattttcagcaaaaaccagttcagtttggctggtagcttttcaagtaactttgacactattggaccgggtgtggtggctcacccctgtagtcccagcactttgagaggccgaggtgggcgaatcacttgaggtcaagagttcgagaccagcctggccaacgtggtgaaacgctatctctaccaaaaatacaaaaactagctgggcgtggtggcgggcgccttcattcccagctactcgggaggctgaggcaggaggactgtttgagccggggagacggaggttgcagtgagccgagattgcaccaccacgctccaacctgggcaacagagcaagaccctgtctcaaaaaaaaaaaacaaacaaaaaaagacactattaagtctggagaatgccatccacatttatggaaacacttgctgtatatctggtgatttacgtgtgtttacacaataatcttcatagaggtggacgtaatcccgttatatagagcatgaaactgaggcccttgggaggtgacttgcaaagattctgttgaagtagttcatcaagttgctaccagagtagactgtctccattgtgtggatgctgaaactgaacccagaaaggttatgtgaaggtcacatcaatagtagagctggaatgggggcttgtcatactgtggagagattagtgggtcaggattggggccattgggttgtgtgggtggagataaagctggatttggggatggggagcttagctgggtggggctggaggaaggaggccctgctgtatgccagatcttgatcatatggcattatctttacttaaggcgcatagcaagctagggatgattatccacactttacagatgaagaaactgatgtttacaggggctcttgctgttcctcttggcttgtcctggggacaggtgttcctgtgacttttgcaagtccttagctccagagattgcagcatctagcctctcctgtgcctttggagttgagggtcccagggaaaactgtggggctggcacagtgtcctcgagggcactgaaggagttatttttagctggagggacatgtggtggtggaggggtggagcttagcagcacagggcataacccattgtcccatacagccgggcccctcccaggaggggccttgagaggggcctctgctctagccctgcctggctgccagttctggttctgcggttaattggctatggaacctgcagcaaactcctctctgggtcctctctgggtcattagtaaatgctgggactcagactaggttcagatttgtgttgtttttctttgccacccttgtcacgtgccagcccctctcatggatctttcattcagttctgaggacagatatggtcggtaaacagttgctgaccccttctctgagccaggtcatgctggagacacaaaggtgacccagagacaggggtggcacagacatgcatacagataaagtagtattgtctccattttatgtgagcagatctgccacttgtctgtctccacggtcaccaccccagtctggtctctctccttgcaggtctccctggatctcttgctccgcagatccacacagcagccaatggggtcttttcaaaagacaaatctggtctctgaatgctggcccctgaaaactgtaggttccccacttcactgggactgaagtcccaactcatcttatgcctctatttgagtcaccctggtgcactcttggttcctctagcagggatatactaggttctttcctgtttccaggtttttttcagcacctactgtgtgccaggtactgtattaggtgcttgagaggagccttccaggccgagaactgcttgggttaaagccctgaggtggaaatgagtggagcttgcctgaagtcagtcaggaagcctgtgtgttgaacagctagtgagtggggaaagtggagagatggaggaggggcaggcagtcatgcagatagggcccgaagattgagggaagccattggagggtttgcttgtttagttttgtttactttagtagaatgatggaggtgatgtaacttaaatttttaagagcctccctcttctggctgctgtggggagaatggcatgttagagcatgggaccagtgaagagagtgtggcagtgtccaactgagaagtggcagtgtatttatttctttattgttttttttggagacagagtctccctctcacccaggttggagtgcagtggtgctattttagctcactgccacctccgcctcccaggttcaagcaattctcctgcctcagcctcctgagtaggtgggattataagtgcccaccaccacgcccaactaatttttgtatttttagtagagatgggatttcaccatgttggccaggctgctctcgaacttctgacctcgggtgatccgcccaccttggcctcccaaagtgctgggattacaggctgtgagccaccgcgcccagcctgagaagtgacagtttagatgaaggtggtgagatgcagttggattgcttatatatttcacttgttgagccaaaaacgtgctgattgaggtgaaagaggaaaagaggaatcaaatcttaagtttttgggcagagtagctggttgaatggtggtttcatttcctaaaatgggaagattgggagagtaaccggtagtgggggcaaaggagccatgaggactccaacatgacacataatagatccaactggacatccaagtggaggtgctgtggaggcagttggatcacatcgagtctcaagttcaggggagtagtttgggctggatataaatacgtgggagtcatccccgtagagaaggtatgtaaagccataagactggatgagcttaattggtaaacataagagaactgggagatgatggagccctgagggcccccaaaccctaaagtctgttagctaaagaggaaccaggaaggtaggtggaaaagcacaggacagtcacagaagccaagtaaagaaagggtttcaggaaggagggcaagtcattcatgcaatctgtgctgctggtagaaacatggtcttaggtaattttgcatcaggtatggagatcaggctggtctttggacggaagagcagttttagtggagtatggaagtccttaaggaggagaggggatatggaatcaggccccatggagcagggatagtgtagtgaccagccccatagggtcggtgggtctctccctgtgtgcggcgacgagagagtgtagaaataaagatacaagacaaagagacaagagaaaaggcagctgggcccgggggaccactaccatcaatgcgcggagaccggtagtggccccgaatgttgggctgcgctgttatttattgcatataaggcagaaggggcagggtaaagaatgtgagtcacctccaaggataggtaaggtcatgtgggtcacgtgtccactggacagggggcccttccctgcctggcagccgaggcagggagggagaggagacagagagaaagacagcttacgcaattatttctgcatatcagggactattagtatttttactaatttactactgctatctagaaggcatagccaggtgtacaggatggaacatgaaggcagactaggagtgtgaccactgaagcacagcatcacagggagatggttaggcctctggataactgtgggcgagcctggctgatgtcaggccctctacaagaggtggaggagcagagtcttttctaaactcccctggggaaagggagacacccccccccctcccgccgccgccacttcccagtctgctaagtagcgggtgttgttccttgacaccttttgctaccgctggaccacgatccgcctggtaacgggcgtcttcccagacgctggcgtcaccgctagaccaaggagccctctggtggccctgtccgggcataacagaaggctcgcactcttgtcttctggtcacacctcactatgtcccctcagctcctatctctgtatggcctggtttttcctaggctatgattatagagcaaggattatcataatattggaataaaaagtaattgctacaaactaatgattaatgatattcatatataatcatatataagatctatatctagtataactattcttgttttatattttattatactggaacagctcgtgtcctctgtctcttgcctcggtgcctgggtggcttgccgcccacaggacagctcatctattttattttatttttttgagaccgagtctcactctgtcacccaggctggagtgcagtggcatgatctcagctcattgcagcctctgcctcccaggttcaagtgattctcctgcctcagcctcctgagtagctgggattacaggcacccaccaccacacccggctaatttttgtatttttagtagagacggggtttcaccatgttggtcaggctggtcttgaactcctgacctcaagtgatctgcccaccttggcctcccaaagtgttgggattacaggtgtgagccaccgcgcccattcaactcatctgtggtaacaggaaagagtgcctggtctgaagctgtagatgactgctataggtgactagtggattccataggggaaaagtggcctggttctgaattcatctcagtgaattgggaagtgagattgtcattcaatggggaaaggtgttggagggttgaggagagtagaaaatgggagtaaatttactaggaaaatgtcataggattgctgcaatgtgctatgtgtcttttatggtcttaataaatatgatatcttggccaggtgtggtggctcacacctgtaatcccagcactttgggaggctgaagcaggtggatcacgaggccaggagttcaagatcagcctggccaacatggtgaaaccccgtctcctctaaaaatacaaaaattagctgggcatggtggcgagttcctgtaatcccagctattggggaggctgaggcaggagaattgcttgaaccgggacctgagaggtggaggttgcagtgggccgagatcgcgccactgcaccccagcctggtctacagagccagactatgtctctaaaataattaattaattaattaattaaatatgatgtcttggtggggttgtgattgtcctcctgctgggttcagtgggtccggtgcagtggagggtcgggtttaattgggctgagagttttgccaagtgagttctcaaagggaaagggggtagaagggacactagaaattggtaggatgaattgaatagaggttctcacctgacaggccacagccttgttggagcttggcctctggaaggagaaaaccagaaagatgaggcgtggctagagttgggtgcttgaagtccagatttccaaggagagctatcactggtgatggcctactagggtaggagggctggggtgggtggcttgagttgaggcacagccggagtggtctctcatgcgggaggcgtgtttcatctctgaaattgttaaaatgcactgtaggaagctgactgacagacaattttattgattattaaattcttagattattaaattctctacagagtcctttgcctcccaccgcctacctctttgggtgtttggcaggatctcagcttccctaaagataaaaatcaccaggagtcttagacctgctgaatcatattttccaggggagatttacaagcatgccagaggaacatcccttaccggggaagtctgcaaactttgacctagggactgacctagggtatgaccttggaagtggaccagtgtggtaggggagagtattgagatagtgagttagctcataataatatccttctttcctgcctgagaatttgaacaaattcgagacattttaggtggcagatagcacctgaaatactttttgttactagtaaccatgaagccagaggatgtagattagtattttaggtggcaacacctgaaatattaccttttattactaataacctcaaagccagaggatatagattaatatgaaatccaaatgatcctgcttattgaacccccagattcagcagttacccaatcagttgcaggcaaggtgggccagggtaggttggtctctggaaaagcagagaacaccagcttcctgcaagtgggcaggtgagtgcttgcttgcaaaaagaagggagagctaagctgagcacaccattttttcctctcagttttactggtcagacaagctcaccccacctcccctggggcagagaggccaagagcattcgttatacggatgagttcctccaggtggaaagaaacatcaggagtggggaagcatttttacatctaaaaggagatcaaggaactgtcaaatccaaaatgttagatagtatttataagtgttgaatcaccgagagtgatgactgagagaggaagatggagaaccagcagctaacatctttagggagtctttagggagtgaggagtggcctggaggttggtaggtgtcagcagaaaggcagggtagtgggaagtatcatgtgagctatttttcaaagggacgcttctttatgttgtaatttttgtgtccctgtgtgattaaatgtgttctcccacaagtcagaaaggtgcaggtaggcagggaccgtgtctttcttgagtactctggcttcataaatacttgttgcatgagtgagagaatgcggtgacagagtgctaagccctagtgtgttgagtccacacgtggatcggggtccatgcagtgaccgcccctcttggttggtgggatgaggggactcacggaactcccacctgtttcctcccgtagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgaggcccacagctgtatcaccccagagtccttgccctccctgggttcagccagggaagaagacgactgtgccagggtggggaccttccaggtgtggagctgaccgcgggcctggaggggttcctccctctcactcggtttcctccgtttcccagtgctgccaccccttgtggtgagtgttctgcagattttctccctggctgggaaggtcactgttggctaccctcaaggcatcctcctgatggatgctctggcaggaaaaattcaacacccatgtcctacttagtctcttaagggccagcttgccttggcccttcgggggtcacaggcctaccctggacccatcatggctgctggatgatggcagctctgattggttcagcctgggtcatgtgtgccaatgattaacagctctcctaaggtctcagagagtcaagaagcaagctggtttcccaaagcagggtagggcaatggagccaaaatccacagaggggctcagggctgagtccttggacctcttctttcttttcagcattcactcttggcggtctgattttatagctttagacactatctggtgatgactgtcacatttttgtactagcctggacttctcctggaactcaagactggcatatccaggagcgggggcgttgacgctccctggaggtctagtactcatctcaggcagaacgcgttcaaacagactcaggattttctgccccctcttcttcccaaagccttccccacctgagtaaatggaacctctgttccagccttctgggttctctcaattcacgaatctgggagtcatctcctcccctccctttcctccccactcccaactccctttactccaacaactcatccctctgcaaatcctgtcagtgcagccttcagagtagacccaggatgtgacaacttctcatcatctccactgctactgtcatatttcttgtctggagtcttctccaacagtctctgcagttgtccccttgcttccaccctttcccttccacacagcactggagtgaggttttaaaacctgagttggatctcgcccctgctctggctcccatctgcccacccagcatccccagcctgtgatcctagagcttgctgtgcctagatcccaagcctctccccactacccgaagctctcccttttcctcgcccagcgtccctggtgcttttgagccatcagtgaccaacagccttgttttgatggctcttctaggtgcagtggtccagctgcaacatcttctccacccaggaccatgcggcggctgccattgccaaggctggcattccgggtaagtcctgcttgcttctgagacgtggaatttgtgaagggattctgccctctttgcttcactgactgctagagcaacagacttccttacatatcagaaagggagaggagtcaccgccacaaaatcctagcccagcgaccccacaggaaagagctgctttgtcccatcatcatctaaaatcctgtggaagttgtttattgacccaggtcaagccgtgtaaccaggaagagcaagatcttatgattgggaactacatgatgaagcggaggggaagttcattaaaggaaggatgtggatctctttccaaagaactggggagggctacggggcagaaaaagaggttcactgcctagggtatggcggtctaaaggactgaggaaggaccaagtctaacgagaatggagttttcacaggctgggcacatgtctgcttggacttggggaggggagtggttagatctgacccagtgattaggacattcaagattgcttctaaccaaccacaggtggacaggagggggtggcacagcactccttcacagactgaccagggctgaatgggcatgatccccattcctcagccttggcaccgtggctttcttcttttttttttttctttttgagacagagtcttgccccgttgcccatactggagtgcagtggtgcgatcttggctcactgcaattcttaagactattgtctgctccagttgtgggtagaagcagctggctctgcttggccagcgtcctttgctcacaagaggctcctgggaaccccacacctgtgccctagtcatgccacatgggaggagtgtgggctggtggtcagtagccctcagttctggtgtctattctggaatttcatttagagtggcccaagtgcgtcttagctcctctctgggcatctgtaagtgatgataatggtcatggctgcctcacagggtttctatgaggaagaatgagatggggtatggaggatttagagtcatgtctggcagaaagcaagtaccccacacatggtagctgctcgtagtcattttttggccagactttgcctgagattcccccacacagaggctgctagtgctccagtcctttcagtgcagagcaaaccctggatcctgccgtgtggatcctgctgagggggaggcgttgtggggtatcaagccctggtcactcagggttgatgcctcagtccttggcgcccaggcagaaggggatgggaaaggaaagaatgatttcctgatatctatatctggggcggggggctgtacatggcttctgtctcacttaatccatactattgtgagccctatttacagaggagaagactgaggctcagagaggtgaagtgatttgcccaaggtcacacagctggcaagtggcagagccagggtttgaactcagatctatctggctccaagttgtgtcctgaccactgctgagttttcagaggggccggaggtggctggggatgggagttgggaaggaggtagttttggctctgccagagttgttccctggagcaggtaccagttgggaagtccaggccctgatgtgccactcaccctccagtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggtgagcagggcggggcaggtgggctgggtgctggtggcctgggtggggcctgtttgcccacatgatggccgcaggcctggcaggactcccatcacctcaagcagcaggatctggaagatgggaggatggcaggctctggcattcatgctggggcctcctgacttctgagggtgcgaggctagggcagctgagctgatggcccaagggcaggcacagacagggccatggttgggaatagctgggagggagccagctttgttcaaagcaggtacgcagagtgcagaggccctgaggcaggaatggctggagtgttcaggaaacagaaaagaggcccacaggatagcagtgagcaaagggagccttcactgcgggtatggtgtgaacttcgtgaagaccagatgtgtcagggcctaataggccaatagaaaagtgtttgacctgatttgcagagcaaggggaaataactggagggcgttgagaagatttctctgagaagatacatgttagaaatggctgctgcatggaggatgggttgtggtagggagactgggaagaagcgacagggtcacggactagagcagcggcagtgagaatagagaagctgggagttgttcggaggcagagtcactaggcctggtggtggcttccctgtaggagggcgttggggactcctccctcacgcgggtctgggtgattggggggcctgtgggatcagtcacagagatgggaacccagaaagaggaatggctttagggggtaaagatgaggaatttgcatgagcacaggtgtggcatctctgaggcttgtcctgtcccctcttgtttaggcatccgaggcatctctgaggagaccacgactggggtccacaacctctacaagatgatggccaatgggatcctcaaggtgcctgccatcaatgtcaatgactccgtcaccaaggtgagccgaggggcagtgacagctcccgctacagtggctgcagctcaggacgaggcctctgaagaagagtgcccaggaaggctgagattagggacatgaagccctcatttgagggggcaaaagcggttatagacaggctaatgagtgcgtttaaaaggggtgtcagagctgggtgttaggagctttatggctttgggaagaagagctttcaagttaagcaaggtctttgaccgggcaatctctcctagtaactgatgcctaggaaggctccacactggcagagaaagattagagagaagctctttgagccgatcggggtgaagggcttgtgggggcattgggtgctggaggggttcagcccaggccgggatgcttggtgggcccatgatgcctgggctcttcagaatactctgaggccaagttgtcctggccccagggccttgcctgcccctattgtctccttaccccctttcctttcagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggtaggatagggcaagggttggttgtcagccactggggccagagggaggggcaaggccaccgtagatgacccacagccactgtctctgcacaggctatgaggtgaccaccatggatgaggcctgtcaggagggcaacatctttgtcaccaccacaggctgtattgacatcatccttggccggtaggtgccagatggggggtcccggggagtgagggaggagggcagagttgggacagctttctgtccctgacaatctcccacggtcttgggctgcctgacaggcactttgagcagatgaaggatgatgccattgtgtgtaacattggacactttgacgtggagatcgatgtcaagtggctcaacgagaacgccgtggagaaggtgaacatcaagccgcaggtgagaagctcccgccttgccagtgggctgggcagatgggagtgcagaggagtgctggctgccagggaggagagctgaggagatggtggcaacctgtgcagggggatggggagaagagggcctagcatcagagccagccagacgtggcaaccttatcctgtgggcagccggcatccctgaaggtatcaggcaggtgagctgtatgtggtgaggctgtagttttagaaagatcactctagctactgtgtgcagaataaaagcaacaatggcgggtggtggggagagaggcttttagaggaggctcgtagaatccctgcaggggatgatggcagcctcagcttagggagtgctggggtggatggacggcatgtggggtcaggatggaggcagagtaacaaaggacacagctttggccgggcatggtggctcacacctgtaatcccagcactttggaaggccgagatgggcggatcacctgaggccaggagttcgagactagcctggccaacatggttgaaaccccgtctctactaaaaatacaaaaaaattagctgggccgggtgcggtagctcatgcctgtaatcccagcactttgggaggtcgaggcgggcggatcacatgaggtcaggggttcgagaccagcctgaccaatatgatgaaaccccatctctactaaaaatagaaaaattagccgggtgtggtggcgggcacctgtaatcccagctatttgggaggctgaggcaggagagaattgcttgaagctgggaggcggaggttgcagtgagccgagatcgcaccctcgcactcctgcctggttaataagagtgagactccatctcaaaaaaaaaaaaaaaaaaaaggccaggtacagtggctcatgcctgtaatcccagcactttgggaggcctaggtgggcagatcacgaggtcaggagtttgagaccagtctggccaacatagtgaaaccccgtctctactaaaaatacaagaagttagccgggtgtggtgatgtgcacctgcaatcccagctacttgggaggctgaggcaggagaatcacatgaacccgggagatggaggttgtagtgagccgagattgttccactgcactccagcctgggtgacagtgcgagactctgtctcaaaaacaaacaaacaaaaaaatcagctgggcatggtggtgggtgcctgtaatcccagctactcgggaggctgaggcatgagaatcgcttaaacgtggtaggcagaggttgcagtgagccgagattgcgccattgcactccagcctgggcaacagagcgagactccatctcaaaaacaaaactaaaaacaaaaaacaaaaagggacacagcttgaatcactgtgtgaggagcaggcccatgcactgagctgggaaagaacaggtttgcattgggcattggggcactgaaactggaagatgagttcttatagggggtgtgaagttttacttgagttgcaattattatgagtttatttttttctctgattataaaagtagtatgtttctggaagacattttggctttggatatcaagagctttaaagttaagcaacctctttgactgggcaatctctcctataattggtccttaggataattaaatatgtatgtagagatgttcatcattttttttttctttttttgagatgggctcactctgttacccaagctagagggcagtggcatgatcatggcacactgcagccttgacctcctgggctgaaggagctgatcctcctgcctcagccttccaagtacctgggactacagatgtgcactactacacctggctaactttttattttttgtagagacgaggccttgctgtgttccccaggctggtctcaaactcctgagcttaagttatctcccaaagtgctgggattataggcgtgagctgccacaccaggtccaccacattttttaaagggagaaaagcccacctatgtgaggttctttgagttggtgctgtgccgtgtttgagatatgataaggaagatacagacacagagttggccaaagccctgacacccacccagtcacagccacaccagaagcccaagtcccagagaggcagacaggcagctctatgaacccacatcccctacactgctcctcttgggtgctctgctcctgcgtgggagttctccttggctaggtcctgcactagtctagggtgtcagttcccggctaggcagagggcacctccatctctgcctagaaggcctggcactcatcacagtgtgggggtggccagggcgtgcttctgtggcagccacacccctgacagccatctgtctagacctcctttttgcaaaggcatcacaggtgaaacctgctacattggggtgatgggcacctttctgccaagctgccctccaaagctggactctatgcccaccctcaacatccttgacagtcttgccaaccttctgcccaacattatctcttgtccgtcctctcaagggcctctgtactcaggccataattgaccactccctgaatacccactgcagctcctacttctgctcatctgtccagacagctgcatttgtctggaacagaacacatgcccttctccttgttcatcttctcagcccagctcaagagacccccttctggccaggcacggtggcacacacctgtaattccagcactttgggaggccgaggcaggcggatcacttgaggtcaggagtttgagaccagcctggccaacatggtcaaaccctgtctctactaaaaatacaaaaaattagctgggcatggtggctcatgcgtatagtcccagctactctggaggctgaggcaggagaatcgcttgaacccaggaggtggaggttgcagtgagctgagatcacaccactgtactccagcctggatgacagagtaagactccgtctcagaaaaaaaaaaaaaaaaaaaattaataaaataaaaaagagacccccttcctggccagctcctctggcagaggcaatgcccacactcttagtacagacccctagtgcagcatccatcactggctttggtctctgaccccactgttgtaccaggagggtagagtccaggttgacgtgtccctgcaaggggcttagatgggtatcagtgagtgcttattgattgaagcatcaatcaatgcctgatgggcatcagagacctttccttggatcggtactaggcctctggagcagcttggaaacctgggcttttggggaaatgtttgggaggctgcctgagggtggagggatggcaagggaagagctgggagtggggagaaagcaagtttgtgtgttcagacagctgggacagacggaggactggggcactgaggctggggatttccatgtcacgttcactcactaaaccgggagttctcaaccttggcagtcacctgggagccacactgtgggccacaggaataggagtctctgggaatgaggccaaggtatctttttttttttttttttttttttttgagacggagtttcgctcttgttgcccaggctggagtgcaatggcgcgatcttggctcaccacaacctccgcttcccaggttcaagcgattcgcctggctcagccttcctgagtagctgggattacaggcatgtgctaccatgcctggctaattttgtgtttttagtagagacagggtttctccatgttgttcaggctggtcccgaactcccgacctcaggtgattccccccgccttggcctcccaaagtgctgggattacaggcatgagccaccgcgtctggcctgggtatcctcattttttaaagcttctgaggtgattccaatgtgagcgccacggcattcagcttttgctaagctgcattcaaaactatttcatggttattgagaacatgggatctgtcctcagaccgtccagactcaaattgcagcctcctcttagtgtgtggctctggacaagtgacctaacccttgtaaacttcagtttctgaatctgaaatggggatgacagcagtactgaaatcacagggttgtttctgggatgaaatgtggtagttacctgtaaaggacttagtacagggcacatgacagtgatcataacgataacattagctgctgcttactgagtgcctcatatgcgccaagcaagtgtgagcacgtgaagttctcacagcagaactgtgcagtctgcagctcagcatttctttgttgtttttttgttttttgttttttgagacagagtctcgctccgtcgcccaggctgcagtgcagtggtgcgatctcggctcgctgcaaactccacctcccaggttcacgccattctcctgcctcagcctcccgagtggctgggaccacaggcgcctgctaccacgcccggctaattttttgtattttttttttagtagagacgggctttcactgtgttggccaagataatctcgatctcctgacctcatgatccgcctgcctcggccttccaaagtgctgggattacaggcgtgagccaccgtgccccggccagctcaacatttcttaataaatattggctgttatttttgtgctaagccatgtgctggaggttgttttggagcagttcggactcctcatgggcactgttggaggcagagaggcctgccagatcagagggtgggctgtgggagcggggccctgcctgccttcactgttgccctgcctgcgtgtaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaaggtgggtttattcttctacctcaagccaagggtcacgtgtctaatcctgggatccccacacagggcttgccagagtttataaagtgcttgcctgtctgccctcttagaggccctcatggggtcctctacagtgcagaagtcattctccccattgacagaagaagaaactgagacccacagtagggagtggctccctggagcacagcagagcggcaggaccaggtggtgaggagagcctgggccttggagcgggacacaccccagtttgaatctcagccccaccacttacaggctgtgtaatccaggcaaattctttctctgtcttcattttctcatctgtgaaatgaaggtaatagcaacccccttcaggattgtgaggatttcctgagatcatgaacccacacacccacaggggctaggcaggtaaatgagtgatgccagctgaacaaggactggaagagctgaaggggtaaagggctggttgccacctaggaacccaggtccgtctgaccagggcttctaacctttcaggagagccagagataccaagatctctatacaaaatgattttcaaatacaggcaactcattaaaattttattttgattttgatttttttgagatagagtctcactctgttgcccaggctagagtgcagtgacgtgatctcggcttactgcaacctccacctgccgggttcaagcaatcctcccacctcagcctcttgagtagctaggattacaggcagatgccaccacacttggctaatttttttgtatttttagtagagacggggttttgccatattggccagactggtctcgaactcctgatttcaagtgatccacccgcctcggccactgcacctggcctcattataatttaaaaaataactgggtgggttaacttggacatgtgtataagctgagtgcagtctgcaggctgcacgttgtggccttgtaataagatgatacatccctggccaggcgcggtggctcacacctgtaatcccagcactttgggaggccgaggtgggcagatcatttgaggtcagaagttggagaccagcctggccaacatggtgaaaccccatctctactaaaaatacaaaaaaatgagctgggcatggtggcgcatgcctgtagtcccaggtacttgggaagctgaggcaggagaattgcttgaacccaggaggtggaggttgcagtgagacgagattgtgccactgcactccagcctggtgacagagtgagaccctgtctcaaaaaaaaaagatacatccctaagcatggcatctcactatggttgtatggtctgcatactcatgaagatgaagtcctctgacatgaaatccagtgctcaccctaacaccccatgcagtccacccttccctggggtcaggacagatgttttagtcctggcttttcttggcagttttacaggtgaactttgctttgtcccttaccctgtccaatcctcagtctccttatgagctaaatggtaagagtagctcttgctcttccagccttttgctgctggagaagctgtgatggggtctacataccatcccttcatcttttgaaaggctggttctaccaattgaggaagacgcaggaagaggcctggggcatctgcctccagggccagccaacaactaatctccctggagcaatgtcttgctggaccaaacattttactcataaggacctcaaggcataccttgttctgtgcagctggttgtggggttgaaagattctcacttgatccccatctaatcccagttgggagaaatatggctatgagtttggtgagaaattggtcaggcctttgaaatgagggcagggttggaagtgaaagaggcaaagctcccgcctcagcacctgaccctgtccttaccacttttcttcatcattgctaacatgtggcttggggacaggacactcttggcatcatgcctcacatgctgtatgcaggcaagggactaggtaccttggtcaacaatgacagagaaggcagccaccatttattaagtcacctactgcacgaatgactctgagtagcactgatctttgtaacagccttgagagatgagtgatccatccatcctgcgaatggggaaagtcaggtgtagagaccgacttgctctcacagatgttaagtatcaggccaggaatagaacctagctctgtctgtccaaggtgttgaccttaggacgtgacacacaccttctggttcagggtgctgggagaaggaaaagttctgggctagtccgggccaagcagaaggttgatttcaatgtgtactgtgggggttggaggccatcgttctacctctggaactgacgtggactcagttctaggctgggccctggtcctactgttgcccgcctctctgctgagcacatcaccttctgcaggctctttgcttcatctgaagatacaaggataaaccgcacccatcctacttcttaagggtgtttgggaggctctaatgaaacagtagatgtgaaaccacttgggaatgtaaaagctgtgggctgagctgtggtcagaggccgccatgccatcatgggacaggatggggtcccttaggggtagggagaggcctacctcatgagagagttagaggcttgcttgtatttaactcttgcctctgtcctcctcggtttctgcataatctcttcaaagctgctctagaggccataagctgggatgcttgagacacattttggggctttgaagccagatagacctgggttcaaatcctagctctgtcattcactagcttggtgaccgtggacacgtcatttcacgtttctgaaccttgatttcctcattttataaaaggaggatggcagtggattagaatccttttggtcacaagtgatagaaacactattcaaaccagtgtatcagttatcttgctgcataacaatctaacccccagacttactggcttcaaataataaatatttattatttcagtttctgtgggtcaagaatttgagatcagcttagctggctgcttctgactcaggctctttcatgaggttgcggtcaagatttctgccagggctgcaatcatctgaaggtttgactgggtctggaagatcctcttcacatcgctgttgacaggaggtctcaattcctcatgcatgggcctctccagagggctgcttatgcatcctcaggagatggcatctggcttcccccagagtaagtcatccagaggagagcaaggaggaagccacagggtctctatgaacttgtgtccaaagtcacacaccatcacttctgctttcttctattcattagaaaggaatcactcggtggggtggggggaggcggtggggattaggctctaattcttaaaggagtatcaaagaatttatagatacattttaatcaaaaaaagcaaccagtttaatccaaaaaagaactttattctcgaatctgccaggcacggtggctcacgcctgtaatcccagcactttgggaggctgaggcaggcagatcacctgaggtcaggagttcgacacctgaggtcaggagttcaagaacagccttaccaacatggtgaaaccccatctctactaaaaacagaaagttagctggacgtggtggtgcacgcctgtaatcccagctcctcgggaggctgaggcaggagaatcacttgaacctgggatgtagaagttgcagtgagccgagatcgtgccactgcactccagcgtgggcgtccgaatgagactctgtcacaaaaaaaagaactttattctcggatccaaacactggaaacctaggattccgtgtcatcatggctctgtccttctgtctctcggatctatcttcatttcacttgtaaaatagacttggaactggtgagctgagattgatagatacccttccctgtttaggaatcccagtggggttggagcaccttgtctctgcctgtcatggaaaatatgtcctgtgcatagatcaattccagagaagcattttggttagctgcttgagttgaagaatgaggaaggagatgtgattgatggtcctgtcaagccacatgtaggggagggtgtggcatggttcccttttgaggggggctgggcagccaaaacaacacattaactgaggctgggtgtgaggatagaaagagttaacatgagtaccacacatggcagaaaccctaacagaacacttctgcctctattggcagccagacgcgtgtaggggtcccagaaaatggcactgattcccggtcttcctttgtttctccccagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctgg

SEQ ID NO: 35709 - DNA, 3799 bp, Homo sapiens
ctcaggactcagaggctgggatcatggtagatggaaccctccttttactcctctcggaggccctggcccttacccagacctgggcgggtgagtgcggggtcgggatggaaacggcctctaccgggagtagagaggggccggcccggcgggggcgaaggactcggggagccgcgccgggaggagggtcgggccgatctcagcccctcctcgcccccaggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaatctgcggacgctgcgcggctactacaatcagagcgaggccggtgagtgaccccggccaggggagcaggtcacgacccctccccatcccccacggacggcgcgggtcccctcgaatcttcgggtcccagattcaccccaaggctgcggaacccgcccagaccctagaccggggagagtctcaggcgcctttacccggttctttttcagtttaggccaaaatgcccacagggtggtggcgacgggggcggggcttggtgggcgggactgactaaggggcggggccagggtctcacaccctgcagtggatgcatggctgcgagctggggcccgacgggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctgggtaagagggtccacagggctactctcccatctccttcttgggctaggactgtgcccacagctgacagacctcaaacagtagaagaaacagggatggaggccagaataccactcctcccttggatcaggagagggagctgtcacctgaggtacaggagatcctataccacagagtgactctcttaaagggccagacctctctcaggggcaattaaggaatctagtctcgctggagattccatccttcagatgaactgatgagcagttctctttgactcccagtattaggaatcacgggggagtttctctcgtgcctgattctcagccccacaccaagagtttttggaggtctgactccagcttttctcagtcactcagcatccacacaggccaggaccagaaatcccttttcaccttctaccctgggctagctcatcccgattctagaactttccaaggaataagaggctatcccagatccctaagtccaggctggtgtcaaggttttgtcctcttctcctactataattgtcctcttccttctcaggatggtcacatgggtgctgctggagtgtcccatgagagatacaaagtgcctgaattttctgactcttcccctcagagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggagtaaggagggggatgggaggtcatgtctcttctcagggaaagcgggagcccttctggagcccttccgcagggtcagggctgaggcctgggggtcagggccccttacgttcccctcttttcccagagccggcttcccagcccaccatccccatcgtgggcatcattgctggcctggttctccttggatctgtggtctctggagctgtggttgctgctgtgatatggaggaagaagagctcaggtggggaagggagaagggtggggtctgagttttcttgtcccactgggtgtttcaagccctaggtaaaagtgtgtcctgcctcgttactgggaagcaccatccacacacacgagcctacccagcctggggccctgtgtgccagcacctactctttttttttgagacggagtcttggctctgtcacccaggctggagtgcaatggcgtggtttcagctcactgcaacctccgcctcccaggttcaagcaattctcctgcctcagcctccctagtagctgggactacacatgcgtgccaccacacctggctaatttttttttttgtatttttagtggagatggggtttcactatgttggccaggctggtctcgaactcctgactttgtgatctgcctgcctcggcctcccaaagtgctgggattacagtcgtgagccaccgcacccagccgcacctactcttttgtaaagcacctgtgacaatgaaggacagatttatcaccttgacgattgtggtgatggggacctgatcccagcagtcacaggtcacaggggaaggtccctgctgaagacagacctcagaagggcagttgatccaggacccacacctgctttcttcacgtttcctgatcctgccctgggtctgcagtcacagttcaggaaacttctctgggatccaaaactaggaggttcctctaggaccttatggccctgcctcctccctggcccctcacaggacattttcttccaacaggtggaaaaggagggagctactctaaggctgagtgtaagtgcggggcgggagcgtggaggagctcgcccaccctataattcctcctgcaccacatctcctgtgggctctgaccaggtcttgtttttgttctaccccagggagcgacagtgcccaggggtctgagtctcacagcttgtaaaggtgagattctgggggtctgaagtgggtggagggtggggcagaggggacaggactgggttgtggggattttttgattcagaatttttgagtgtgtggtgggctgttcagagtgtcatcacttaccgtgactgacctgaatttgttcatgactattttcttctgtagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaatt

SEQ ID NO: 35710 - DNA, 431350 bp, Homo sapiens; identical to SEQ ID NO: 35705

SEQ ID NO: 35711 - DNA, 431350 bp, Homo sapiens; identical to SEQ ID NO: 35705

SEQ ID NO: 35712 - DNA, 29307 bp, Homo sapiens
agcgttttctgggcttctgtctggttctctctctccagaaggttctgccggttcccccagctctgggtacccggctctgcatcgcgtcgccatgatgggccatcgtccagtgctcgtgctcagtgagttctggggatgccaggaaatggacccccttttcgccctcttctgtccatacttttcagtgttgccccagctccgtcccccactgaccgggccactgagccttccaatcatcgtcttcattttggaagcccagtgtcccgctttcctctcttctcttaacctgttcgcttctctgcacaaactcaaactggccttattctcgccgagcctctttccttgacgtgtgctcgtcttgggaagctctttcccactccgcgttctgtccctcagcccccacgcttcccccgcccctgcgccctttctagcctgattgtcgctatgtagctgcacgaataacgtttttttttgtttttttttcagttaggtctagctttatattcttggcccatcccttagtagcggtaatttaaatgtttcaatctgtattacggagttaacagtatttcctagtagaattgtgagaattaaatgaggtaagtcggtagactgcttaaagagggtctggtaaataggtaatatccttggtcactttacgttacatttattttcagtaacagtctcttgaacagcaatcccttttcccgaagtaaccgtacttgcctcactgatcttagatgtaatcgttccctccgtgtccccggcgttgtactctttcccactaaccagttgggttttcccagatttctcgactggtcaccttttccttttggaagatcccttattttttttctttttatattttgagacaaagtctcgctctgtcacccaggctgggttgcagtggcgcgatctctgttcactgcaacctctgcctcccaggttcaagcgatcctcctgccttagcctcccgagtagctgggagtacaggcgcgcgccaccacgcacggctaatttttgtatttttggtagagacggagtttcaccatgttgaccaggctggtctccaactgctgatgagctcaggtgatccgcccacctcggcctcccaaagtgctgagattacaggcgtgagccaccgcgcccggtcccttatttttttctgatgagcaccacctccattgtcttcctttggtatgtttccattctgtgtgtaacttctgtacctcatctgcagagcctggctagccatctcccctcccttaccgtcttctgtatactgactgcctttcagagttattattcattatctctgtacctgggaaataacttttaaggaaaaaaataaaataaaaacgctattttgaaaaaaaaaagccgccttctttctgatggattgtaggtccatgcaggtttttggttacagctccctgagatagatgtaaatcctaagcattgtgggtgttttggtttgatgggactggattgaaagatttacagacttaaattgtaaaggaaggtaatttagagagaggaaggaaataaacattatgttggtttggttataaccactggcttgtctccactgacatggcctgggggtgagtggtgtatttgcaaagctcctttcaggtctgcattaatctctggcattagttggctgtgaccgattagcctcccagttaaagtatgtagtcagttcttagtgatggtaaatgggttactgaggccttcttattacatccaattatgaggtgactatataatttatcttgcaaactgttgagtgtgttctaaacagtatgctgtgggggcgctatcactaattatgctggacctgttagagtatgatccccctatccaagcagaaaaatgtgaatccccaaactctttccctgcttacgcaaagcaatgaatggtcatttcttagggtcaccagccctttgagaatctgataatagttgtggatcctctttccggaaaaaaaaaaaattgcagtatctctcattttctcacataatctcagggagttcgctatcccactaaggcccattcatagatctcaggttatgaatccctgctgtaaatataggaatatttggttagaagaaaagtattaaccaagattccaaagttatttcttaatataccaaggattgaaatacagaaggaagttaacagccataaggacatatgtttacagttttttgagatatggttgacatataataaactgcacttatttaaagtgtagagtttgataagctttgctctgtggatataccatgaaacctgcattcttatttttcaaagacggggaaataaatagcttgtgtacgatggggcagtcctgggctgttgacttgtgtttttgtctattttaggccagaacacaaagcgtgaatccggaagaaaagttcaatctggaaacatcaatgctgccaaggtcacaaatcttttaagtgtttatggtagtttgcctccagctatctttcctggtatttggtcatagccatgtgtcctgtgcatctagactttatagagtaggcaaataggcagaggaaaagttgacctctttcagaacattttcctgatgatgttaggggaaaggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcggtaaatgtcttttgaatgaaatagtgaaatagccttatatctgatttaggatggtgtagaggccaccgtcatggaaagaaatactaagacatggacttctagtaattaggactgctgggaaacaagctctgggagccatttcccccttattcttgtgaaaagtcatttctgtatccattctgaaagcattcccaaggggagaaaaacaacagagctagccacatcctatatctaaagtggcatgctatgtctaaagtgatggctaaccatgctttaggggtgtcattaaaaacactgactctggctgggcggaatggctcacgcctctaatcccaacactttgggaggctgaggcaggtggatcacttgggcccaggggtttgagaccagcccgagcaacatggtgagaccccatatctaaaaataaaataaaattaaaataaaataaaacactgactctgtgggttgttcatgccccttttccctattactccaacatttctcacactgtcctctgatttgtgcttgcgtattttatgttccctttccattagactattgcagatatcatccgaacatgtttgggacccaagtccatgatgaaggtaggcttatctcttcctaaaactcttaggctacaatttttttcttcctgttatctaggacactttaaatataacttttgctttcatcttagatgcttttggacccaatgggaggcattgtgatgaccaatgatggcaatgccattcttcgagaggtgtgttttgtttttggttttgtttttttgctttctgacagttctgtaaacataaaggacctgttaagatacaggctctgattagttttttagggctgctataacagattaccagaaactggttggcttcaacaacagaaatttattatcttatagaatgaagctagaagtctgaaataaaggcgtcagtagggccatgctccttctgaagtctctagggaagaactccgcttctcccttctgatggttgctggctttctttggcatgaacttggtctctgccttggtcttcatgttattccccttgtgtgtctcttacacaaggacaccggtgattggtcttcgagcccaccctaattcagaatgaccttatctaacttggttacatctgcaaaaaccctattttaaaataaagtaaaattcacaggttctgggagttatgacttcaacatatcttttttttttttttttttgagacggagtctcgctcttgtcacccaggctggagtacagtgatgtgatctcggctcactgcagcctccgcctcatgggttcaagcaattcttctgcctcagcctcctgattagctggaattacaagcgcatgccaccacacccggcttaatttttgtacttttagtagagacagggtttccccatgttggccaggctggtctcgaactcctgacctcaggcgatccacctgcctccgcctcccaaagtgctgagattacagatgtgagccaccatgcccagctggcttcaacgtatcttactgaagaacacaattcagccacaatagtgcttccagtaaataagctaaaagatatcgttctgtcctctggcagctttaatagttgagttcatgtaatacactttttcccaaaaaggatttggaaagtggtttacttaagctatttggggtgccaattttaatctttcaagatatggtaaaacattaaagggaaagtaagtacgtatagaagcaagaagcccaagagttagggccaagcttcatgagttcagaggtctttgaatagtgtgaattcactagtgatctacctttttagattcaagtccagcatccagcggccaagtccatgatcgaaattagccggacccaggatgaagaggttggagatgggaccacatcagtaattattcttggtaagaggagaataagaggttgataaggaaaaattagaagtaacacctgtgtcatattttaagaaggaaattctgttacagatccactaattacagatatttaaatagcttattggttattttctatgtattctctccagttgggtataaaacatttatatgaatagggtgagctatgcaaatctggctgataaactaatagttaattctctttattcactgtaagttataatattcttttttttttttttttttgagacagagtctcactctgtcaccatgctggagtgtggtggtgcgatcttggctcactgcaacctctgcctcccaggttcaagcgattctcctgcctcagcctcccaagtagctgggactatagtcacgtgccaccacgcccagctaatttttgtatttttagtagagacagggtttcaccatgttggccagatggtctcgatctcttaacctcgtgatccgccctccttggcctcccaaagtgctgggattacaggcgtgagccaccacgcctataaagtcaccacaaacactgaattggcaaataataaatcattgcttctataggaaatacagggttagatacctataagcctctggtcacactttcatcaactgataaatatataccttattgtatgtgtttgtcttcaagacacccatttaatatatatagttgatttattagcattgaactcatagcccatagcaatataactcatgcctggacaaagctcacctaacgtattttctctgtaaggcacatcacagccttcttgcacatagaagcattagctagcacttaagcactacacttgtgagccattataaataccgaaatcatcaagaaaaatgtgaaaaacataaccttaaatatactgcataaaggacacttttttttacagtgtgagagctaaaggccttgtttaacctcacctaggaatgtcattgggtgactcaaattttttgccattctgtgaatttccatgaatgactatgaaagtgtcatgaatgttgattttggggttacaaataataagaaatgaaatctttaggataatgaccctgggctatgtaagtttaaagactaatctttctacttcctataggatcataaagaattatttttcaaatcttggcctattgcctttattgtgtaaatgtcaagatgatagtaaaatttttatactagaaacactggttttaaaaaatctgattgcaaccaagtgtggtggctgacacctgtaatcccagcactttgggaggccaaggtgggcagatcacgaggtcaggagttcgagaccagcctgggcaacatggagagaccgcgtcactgtaaaaaataaaaatcggctggatgtggtggcacacacctgtagtcccagctactggggaggctgaggtcggtgaggcaggaggttgaggctgcagtgagccgtgtttgtgccactgcactccaacctgggcaacaaagcaagaccatgtctctttttttttttgagatggagtctcactcttgttgcccaggctggagtgcaatggcacaatctcggctcgccgcaacctccccctctcgggttcgagcgattctcctgccttagccttccaagtagctgggattacaggcatgggccaccatgcctggctaatttgtatttttagtagagacggcgtttcttcatgttggtcaggctggtgtcgaactcccgacctcaggtgatctgcccgcctctgcctcccaaagtgctgggataataggtgtaagccaccacgcctggcctgagagggactattttaaaataagggatgctaattttatttatttatttatttatttatttatgtttttgagacagagtcttgctctgtcgcccaggctgcagtgcattggcgcaatctcagttcactgcaacctccacctcccaggttcaagtgattctcctgcctcagcttccctagtagctgggattacaggcatgcgccaccacgcctggctgatttttgtgtttttagtagagacagggtttcaccatgttggccagactgatctcgaactcctgagctcaggtgatctgacaacctcggccttccaaagtactgggattacaggtgtgagccactgcgcccagccaagggatgctaatttatagtgttggcccacatacctaaaaataaagttcttaatcaaaattattattatttatttttcgtagagatggggtctcatgttgcccaggcttgcctcaaactcctgggctcaagcaatctcctgcctcagcctcccaaagtgtttttctttttgagatggagtcttgctgtgtcacccaggctagagtacagttgtgcaatctcagctcactgcagcctctgatcccgggttcaagcgattctcctgcctcagcctcctgagtagatgggattacagatgcccaccaccgcgcccggctaatttttatatttttaatagtgacgggatttcaccatattggccaggctggtcttgaactcctgacctcatgatccacctgcctcagcctcccaaagtgctgggattacaggctgtgagccaccgtgcctggctaagcctagctaatttttcaaattatatttatttatttatttatctttgagacagagtcgcccaggctggagtgcagtggcacagtcttggctcactgcagcctccacccctggggttcaagtgattctcctgtctcagcctttctgttagctgggattacaggtgcccgccactgtgcctggctaatttttagtagagatggggtttcaccatgttggccaggctggtctcaccacgcctggccttatttatttatttttatttttaaattttatttatttatttttgtgtgacagagtctcactctgtagcccaagctaaagtgcagtggcatcatcttggctcactgcaacctctgcctcctgggctcgtgattctcatgcctcagcctcctgagtagctgggattataggcgcatgccaccaagcccagctaatttttgtatttttagtagaggtgtggtttcaccatgttggccaggctggtgtcaaactctatcaacctcaggtcatccacccacctcagcctcccaaagtgctgggattacaggcgtgagccatagcgcctggccctattgtactgcattttaagaatggtgagttgaataaaaatgtccttgagagtcacagtcaactagtccatctttagatccagttcttttgaggattcagaacatagccagttatggacttttagggaaaacctggaaggatgaaagaggagggaggaaagatttcatactcttttttattttttattttttgtaatagaacatgagctttacatatcagagaaaattttctagctgataatttcagttgaatcatctagagatagtgggtagaataagtatccatgagtctaagtatcttagatgtagatggatttaagaatgtgaaaaagaacacttgaccagccctaaagaaatcttctgttacagttctaataatttcttaatagggtatatccttttctaagttatcttactcaggcttttgcttttttttttttcgagacagagtttcatactgtcgcccaggctggagtgcactggcgcgatcttggctcactgcagcctctgcctcccgggttccagcaattctcctgcctcagcctcccaagtagctggggttacaggcacccgccaccatgcccagctaatttttgtatttttagtagagacggggtttcaccatgttggtcaggctggtctcaaactcctgacttcaggtgatcctcccacctcagcctcccaaagtgctgggattacagacgtgagccaccatgcccagccactcagccatcttttaaaatgcaataatatgctgcttaatgatggggatatgggctgggcgcggtggcttacgcctgtaatcccagcactttgggaggccaaggtgggcagatcacgaggtctggaattcgagaccatcctgaccaacatggtgaaaccctgtctttgctaaaaatacaaaaaatgagctgggcatggtggcgcgtgcctgtagtcccagctactcgggaggctgagtcaggagtatcacttgaacctgagaggtggaggttgcagtgagcccagatcacaccactgcactccagcctggcaacagagcaagattccgtctcaaaaaaaaaaaaaaaaaaaaagatggggatacgttctgagacaaatgcgttattaggcagtctcattactatgcagacttcatggagtgtactttacaaacctgggtggtacggcctactatacacttaggctgtatggtatagcctattgcttctaggccacaaagctgtataacatgttactgtactgaatacagttataatacagtggtaagtatttgtataataagcatagctaaacatagaaaaggtacagtaaaaatatgatattataatcttatgggaccactgtcatatatgtggtccattgttggctgaaacattaaatggtacgtgactgtattttttgattatttttctttcaatatacatgattgacactttggaattgaaacaaaatatattgaattcaaacactggagcacatactaatgaataacatgtacattttttttttttatttttatttttattgatcattcttgggtgtttctcgcagagggggatttggcagggtcataggacaatagtggagggaaggtcagcagataaacaaatgaacaaaggtctctggttttcctgggcagaggaccctgctgccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctctctacacagacacggcaaccatccgatttctcaatcttttccccacctttcccgcctttctattccacaaaaccgccattgtcatcatggcccgttctcaatgagctgttgggtagacctcccagacagggtcgtggccgggcagaggggctcctcacttcccagtaggggcagccgggcagaagcgcccctcacctcccggatggggcggctggccgggccgggggctgacccccctacctccctcccggacggggggactgaccccccccacctccctcccggacggggcggctggctgggcagaggggctcctcacttcccagtaggggtggccaggcagaggcgcccctcacctcccggacggggcggctggctgggcggggggctgacccccccacctccctgccagatggggcggctggacccccacctccctcccggacggggtggctgccggacggaggggctcctcacttctcagacagggcggttgccaggcagagggtctcctcacctcccagacggggtcgcggctgggcagaggcgctcctcacatcccagacggggcggtggggcagaggtgctccccacatcccagacgatgggcggccgggcagagacgctcctcacttcctagatgggatggcggccgggcagagaagctcctcactttccagactgggcagccaggcagaggggctcctcacatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagcctgggcaccattgagcactgagtgaacgagactccgtctgcaatcccggcacctcgggaggccggggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagtagtacagtccagcttcagctcggcatcagagggagaccgtggaaagagagggagagggagaccgtggagagggagaggggagaggggagaggcgagaggctatgtacatttttaaaagcttattttacctgccagtaagcaggtagtacaagcaatttgtgcaaaaggcttttgacaaaaagaatatttacaatactctctttatactttttctagaaacaagcttttttgtgtgtgggtttgcatctatgtatatgttattttgtgtgtgtctattagaaagtaaagacaaattttatttgtttatttattttgagacagagtctcactctatcacccaggctggggtgcctgggcacagtctccactcactgcaacctctgcctctcaggttcaagcaattcttgtgcctcagcctcccaactagctgggattacagacacccaccaacacacctggctaatttttgtatttttggtagagacagtttcaccatgttgtccaggctagtctcaaaactcctggtctcaagcgatttgcctgcctcggcttcccaaagtgctgggattacaaggtgtgagccaccattcccagccagaaagtaaagacaaattttaaaagaaggagatgttttaccaataatcccttatccagagggtaaattgtgtacattttcttttttttttctttttctttttttttttttttttgagatggagtctcactctgtggcttaggctggagtgcaatggcacgatcttggctcaccacaacctccgcctccctggttcaagcgattctcctgcctcagcctcccgagtagctaggaatacaggcatgtgccatcatgcctggctaatttttgtatttttagtagagatggtttcaccatgttggccaggctggtcatgaactcctgacctcaggtaatccatctgccttggcctcccaaagtgctaggattacagatgtgagccaccacacccagccttaattgtgcacattttctaattttaattttttatttttttgaaacagaatcttgctctattgcccaggctggagtgcaatagtgtgatcacggctcactgcagccttgaccttctgggctcaatgagtcctcccagcccaggttcccaagtagctacaggcacatgccaccatacctggctaatttttgaattttttcgtagagacagggttttgctatgtttctcaggctggtctaaaaattccagagctcaggtgatctgctcaccctagcctcccaaagtgctgggattacaggtgtgagctaccgcatccagccctgaatattctttcagaggtagggttttgtgtgttttgtttttagttcaagcagtttgactacatcctaaggtataaaggtactaataaacaagtcagtttttcttttgtgcatttttctttattttagagccttcagggaaatttttttttagaaagatcaagagaaggccaggcgtggtagcttacgcctgtaatcccagcactttgggtggccgaggtggacagatcacctgaggtcacgagttcgagaccagcctggccaaccaacatagtaaaacccgtctctactaataaagtacaaaagttagctgggtgtggtgatgcatgcatgtaatcccagctacttgggaggccgaggtgggaaaatcgcttgaatctgggaggcggaggttgcagtgagcagagattgcgccaccgcactccagcctgggcgacacagcgagactgcttctcaaaaaaaaaaaaaaaaaatcaaaagaataagtaagccctagaatcagtctttcatcattttattttttgagatagggtctcactctgtcacccagattggagtgcaatggtgcggtcatggctcattgcaccctcaacctcctgggctcaagtgatcctcttaacctcagcctcctgagtagctgggactgcaggctcataccaccacactaagctaaattttaaatttttttgtaaagacagggtctcactgtgttgcccaggctgatcttgaatttctgggattacaggtatgagccaccatgcctagcctgggcaacaaggatgttttctgtataaattgccgtcttatacaatgtgtagaatttggaatagtatgaatggccaaatgtcataccttttgggagagtctgatttaggagagtattttttggaagaataattaagttacttgccttgatatccagatgctttaaatattactatggtgcttgtatctttttcagcaggggaaatgctgtctgtagctgagcacttcctggagcagcagatgcacccaacagtggtgatcagtgcttaccgcaaggcattggatgatatgatcagcaccctaaagaaaataaggtatcttgggggcaagaaataggtagtatcaaatatgagaggcctggctagacgtggtggctcatggctgtcatcccagcactttgggaggcctaggcgggtggatcttgaggtcaggagatggaaaccatcctggccaacatggtgaaacctcgtctgtactaaaaatacaaaaaattagttgggcatggtggcgcatgcgtgtcgtcccagctacttgggaggctgaggcaggagaattgcctgaaccagggagtcagaggttgcagtgagctgagatggccccactgtgctccagcctggtgacagagcaagactccgtctcaaaaaaaatcagctgggtatggtggcgcacacctgtaatgccagctactcaggaggatgaggcagaaaaattgcttgaaaccagggggcggagattgcagtgagccaagatctctccactgcactccaacctgagcaacaagagcgaaactcccatctcagaagaaaaaaaagaaaagcatatattacctctagcttcagggaattttagttaaggtttaacatcacgtagagtcatgtagagcagtgtcttgaataaaaatttttgtttaaaaagtaaaacctggcagggctcggtggctcacgcctgtaatcccatcactttggcccaggtgggtggatcacgaggtcaggagttagagaccagcctggccaacatggtgaaacctcgtctctactaaaagtacagaaaattagctgggcatggtggcaggcgcctgtaatcccagctattcaggaggctgaggcaggagaatcgcttggacccgggaggcgaaggtttcagtgagccgagattgtgccactgcactccagcctgggtgacagagtgagactctgtctcaaaaaaataaaaagtaagacttgggctgggcatggtggctcacacctgtaatcctagcactttgggaggccaaggcgggtggatcacctgaggtcaggagttcaagaccagcctggccaagatggtgaaacctcatttctactaaaaatgcaaaaattagccaggtgtggttgcatgcgcctgtaatcccagctactcggggggctgaagcaggagaatcacttgaacccgggaggcggagtttgtggtgagccaggatcgcaccattgcactccagcctgggcgaacaacaaaactccatctcaaaaaaaataaaaatagggctgggtgcggtggctcacgtctgtaatcccagcactttgggaggcggaggcgggcggatcacgaggtcaggagattgagaccatcctggctaacatggtgaaaccccatctctactaaaaatacaaaaaaataagccgggcgtggtggcaggtgcctatagtcccagctacttgggaggctgaggcaggagaatggcatgaacccgggaggcagagcttgcagtgagcagagattgcaccactgcactccaggctgggcgacagagcgagactccatctcaaaaataaataaataaaaataaaaatgtatattttttccacgcccaactggaaatagttttttttttctttatttaaatattctactcatatggttgagtcactagatgcataagtgtttagtaatttggtgaggtttatattatactgcctgctcttttttttttttcttgagacggagtttttgtacttgttgcccagtctggagtgcaatgaatggcgcgatctcggctcactgcaacctccacctcccaggttcaagtgattatcctgcctcagactctcgagtagctgggattacaggcatgtgcatccacatccggctaattttgtatttttagtagagacagggtttctccatgttggtcaggctggtctcaaactttcaacctcaggtgatccacccaccttgacctcccgaagtgctgggattacaggcgtgagccaccgcgcctggccatatactgcctgctcttaaacaagttgtacattaatatctttgtctggcacacttaagaatgaggtgtttgatctaattatttttatgcagtaagctctgtgagaatgtagaggtacccaaaggttttattgtgtggagcttcacgcttagaaagccttttttttgagacggagtttcactcttgttgctcaggctggaatgcaatagctggatctcagctcactacaacctctgctccctggcttcaagcagttttcctgcctcagcctcccgagtagctgggattataggcatgtgccactacgcctggctaattttgtatttttagtagagacggagtttttctccacattggtcaggctggtctcaaactcccgacctcaggtgatccgcctgcctcggcctcccaaggtgctgggattacaggcgtgagccaccgtgcctggcctgaaatattttttttttttaatcaagtaataactgcctacctagaacactttaatcttattaaaaaaatttttttggggtggcggggggtctcgctctgttttccaggctggagtgtgcagtggcatgatctcggctcactgcaacctccgcctcttcggttcaagcaattctgtctcagcctcccaagtagctgggactacaggcgcataccaccacacctagctaattttggtatttttagtagagatggggtttcaccatattggtgaagctggtctcaaactcctgacctcaggtgatcctaccacctcggcctcccaaaaaaattattttttagagatatggtctcactctgttgcctaagctggagtgcggtggtgcagtcacagcttactgcagcttccagctcctgggctcaagcaatcctgccccagcttcccaagtagctaggactataggtatgtccaccacgccctgctaaatttttcatagagatgaggttttgctatgttgcccaggttggtttttaactctgggcttccagctatcctcagtcttccaaagtgttgggtttacaggcgtgaagcatggcacccagccccctttatcttagataccatttttggagtcattgcttcttcccaaaagtccataattcaaccatttaataattggtatattatgtgcctttcactgttaaaagagggattttgtttattttggggtttttttgagacggaatctcactctgtcacccaggctgtcgtgcagtgacatgatctcaggtcactgcaacctctgcctctggagtaactgggactacaggcacatgccaccactcctggctaatttttgtatttttaatagagatggggtttcaccatattggccaggctggtctcgaactcctgacctcaagtgatctgcccgccttggcctcccaaagtgctgggattacaggcgtgagccaccgtgcacagccaaaaaagagattttagcattatgtgaaaatatcttgtgaggagtgaaagtaatataaaaatggtaaatacataaaatgtgtttacagtaacataaaaacacaaagatgaccagttggtggtcatctttgaccactgtgacacaccatgagctaaaaataaaatttgctgttcaaatgaatgatttgataaaactcttaaagttggctagttatgggataaagtttcataaaaaaaaatgtgtcttgacctgagttgtaaaagttgaaaagtttacttggttgaagcagaagataaggaacaaattattttactataatctttgtatgtaagtgtaaagggttgctcagggaattaaggcaccgtctacagatgagttgtaatcttgctgaaaggcagaggaatggacaaaggttacctcctaatgtccttttagtttcctccaaaggaacaaatccccttgttctgcctcttggtccattattatagtcactgaggtatagataaggcacatctctacatatctaacatgccttcttcacatatcgtctggttttcttttctctagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaaggtaaactttcaaagtgtatacattgggtcaaattatatgttagcatgagtcatctcacttgtgaggaaatagtctgtttttcatgccgttgttttgttttgtttttgagacagagtctcaccttgttgcctaggctggagtatagtggcacagtcacagcccactgcagcctcaaactcctggcctcaagcaaatcctctgatttgctaggactacaggcacatgccactgtgcccagcaaattttttttctttttgtagagatgagggtctcatgttgcccaggctggtcttgaactcctggcctcaagtgatcttcccacctcaggctctcaaagtgctgggattataggcataagccatcataccctacttgaatgaaatagttttaaatcagagcaaggtatgttttttgtttgtttgtttttttgagatggagtcttgctctgtcgcgcagaggctagagtgcagtggtgcgatctcggctcactgtagcctccacctcccgggttcgagtgatctcctgcctcagcctttaaaatagttgggattacagatgcctgccaccacgcccagctaatttctttttgtattttaagtagagacggggtttcaccatgttagccaggatggtctcgaactcctgacctcagtgatctgcccacctttgcctcacaaagtgctgggattatagggtgagccactgcgcctgaccaaagcaaggtatctttagttagaactaggaagaactatacttgctgcctggaaacaaaaacctataagaggctaccaagtaggaatttcttcaaatagttttgttgttaccttcactgctatccctacacaaggtttatgaggacaagggacaggcttattggtgtctccatgtttgtgtatttgcatacatcagtcatttggtcaggatataagcttaacaagggctctattatgtagtgctattaaaatagtaagccccagaaagctttctctcctgtccactaaatttcattaagatccaaaagtttagtagtatagcttgtggccagtagatggagccccaagcctaaaattctctggcaatatatttatttttttaattggagagacctaagcccttatttatttatttaaatagcaattgggtctcaatgtgttgcccaggctggtctcgaactcccggcctcaagggatcctcctgcctgagcctcttgagtagctgggattttaggtgtgaaccactgtgcctggctcataagcccctctaagtcttttgtcaagtcattgaatttcagtgagtctcagcagaccttcaagttgagtgtcatggtctaaaattggtgtatttcctaatgggaaaaaaatgtgattccaataatatttttgagcttcatcaaagaaaggtactttagaaacctgaaacactgggccgggcgtggtggctcatgcctgtaatcccagcactttgggaggccgaggcgggcggatcacgaggtcaggagatcgagaccatcctggctaacatggtgaaaccccatctctagtaaaatacaaaaaaaaaaattagccgggtgtggtggcgggcgcctgtagtcccagctacttgggagtctgaggcaggagaatggcgtgaacccgggaggcggagcttgcagtgagccgagattgcaccactgcactccagcctgagcgacagagcgagactccatctcaaaaaaaaaaaaaaacctgaaacactagctgtttgggaaagatgaacatctgggaaggaaattaagaaattgtctcttgattgtggattaaagtgcagttgtcttttgttcagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggtaaggttcttggccttgttccttaaagtagatgcaagaatctgactgcaaatatgaacaacagaaataaaacgtatgtttattgcatgccttctgggtgcatagtgtacactgactcttagaacaatcctttagaatagttggtattgatttcattttacagatgagggatctgaagctcaaacaagttaggttaattgcttgaggaatacagctagtattggccaaaatcaagatttgaacctggttgtgtttggcttgttttatacgatcatgctgcctttcctaatgcaccaggggaacataaggtaggagttaattcagctttgaagtactaaaggagaatttcagcttaatgcagtggctcacacctataattctagcactttgggaggctaaggcaggtggatggctcgagcccaggagttcaagaccagcctaggcaacatgtcgaatactgtctttatttaaaaaaaattaattgggcgtggtggcatgtgcctgtagtccccactacttgggaggctgaggtgagaggattgcttgaacccagaaggtcaagggtgcaaggagctgtgatcacgccactgaactccagcctgagcaacagtgagaccctgtctcaaaaaaaaaaaaaaaaaaattctagagggcaggaggctcacaaggctccatcacatttggaaagaataagaatcaattagtgggaagaattaagacccaggattttcctgcacactgccaggacagatgtaggattggactgggtggtcagagaccttagaaaggccaaactcaacactaattactgtgtgactttcagttctggttgttttataatgatataactggagctggccgggcgtggtggctcacgcctgtaatcccagcactttgggaggcagaggcgggcggatcacgaagtcagaagatcgagaccatcctggctaacgtggtgaaaccccgtctctactaaaaatacaaaaaaaaagttagctgggggtggtggcaggcacctgtagtcccagctactcgggaggctgaggcaggagaatcgcttgaacccaggaggcagagcttgcagtgagccaagatcgcgccattacactccagcctgggtgacagagcaagattccgtctcaaaaaaaaaaaaaagcaaaactaaagctaaattggcttacagaggtgttgaggtcatggctttaacataattctgactctgagatacgtgggagaggtgggtggaaggagtataatatgacccttagagcttcaccagtccagggattttaaaatcagtgtcttttctttaccacacagactgacattgagattacacgagaggaggacttcacccgaattctccagatggaggaagagtacatccagcagctctgtgaggacattatccaactgaagcccgatgtggtcatcactgaaaagggcatctcaggtgggactttgttactttttccagcctacctttgaggtagacgagggtgggtgatttgttttctcccctcatgtttggcaggggcgtaatagtgtcatggttaagagtactttgattataaaaccagttcagaacccagcttgacatctctactcttggatttgtagatttagctcagcactaccttatgcgggccaatatcacagccatccgcagagtccggaagacagacaataatcgcattgctaggtgagtaggccaggtaaaaacaagacttttcttcccgtgtgtttcctttttgtagttgcgtaacagtcatcattacctgaaaaggtttaataaaggatatagtaacaggtagaaataaccttggcttagctgcctgccctcttcagaagtcctctagtccaacagttatttactgcgtgagtctcatctgtactgcccctaaccattagtgagcagcttgtgcttagacatttgtaattgctaccttggtgggtgtccgttacatttctaaataactgcctatctaagaggttttctttaatgtcattatgatgatttttgaatgaacatttccagagtatcctaagtggcctggattatagcagaaccatcagtttcctcagctacatccttagctgcgatttatgcgattctagattgcattcactacttctgcactgatgtctgtgctcatagaccattctttttaatagacaaggtcttgctgtgttacctaggcctgtctcaaactcctgggctcaagcagtcatcctgttgtcagcctttccagtacctgaaactattggcatgcgccaccatgcccagcaaagttcattcatttttaatttatcaaaaagctgacaaatctaccccaacataatatatcacagatccaaatcatattttatacttttataccccaaagggtattaacatgcatacacatagttgacttcacatggccatgagttggagggagtgacaagcaattagtcctacattcattaaacttcggtcagacgtatgcagtcatcccttgatatccacagggcattggttctaggatccccgcccccttgaatactaaagtttgtggatgcttaacccttatataaaatggtatggtatttgtgtataacctatacacatccttctatacactttaaatcacctttagattgcttataatgcctaatatagcataaatgctatataaatagttgctatactatattgtctttaaaatttatattattttttgccgttgtattattgtccatccccccaccccaccccccctgccatgttatcagtgcatggttggtggaatctggatgcgggacctgcggatatagagggccaactctacttacatgtttattcgccttcctccttgcttgacctttgcatctttggtacagtctttattattcgcctggagactcaactgggcagtacaggatgggttatatctagaagttaccattatatagtatagacatgttaatttttttcttttatctttcttttttgcaggttctaattctctagttgaaatatgtacatgttagatatgcatgagaactaatttgtccagattttagtaaccacaaagtatattttgaattcaactatatctggttatagtagtgatgactagttgccttaagtgtacagttgacccttgaacaacttgggggttaggggaatcagtccccaaggagttgaaaatccatgtataattttttgactcccccactcctaatagctgaccgttgacccgaacccttaccaataacacaattaactatcacatattttgtatatcatatgtgttatatactgtattcccttaaataaagtaagctagagaaaatgttattaagaaaatcataagggcagggcacggtggctcatgcctgtaatcccagcactttgggaggccaaggcaggtggatcacctgaggtgaggagttcaagaccagcctggccaacatggtgaaaccccatctctaataataatacaaaaattagctaggtgtggtggtgcatgcctgtaatcccagctactcgggaggctgaggcaggagaattgcttgaaccaaggaggcggaggttgcagtaagctgagatggtgccattgcactccaacctgggcgacaagagtgaaagtccgtctccaaaaaaagaaaatcataaggaagagataacacatttactatgccttaagtggaagtagatcatcaaaaaggtcatcatcatcttcatgttgaataggctgtggaggaagaacgggctggtctttctgtcttgggtgtcagaggcagaagagtggtagaaggggaggcaggatgggcaggaggcacactcagtgtaactcaatggaaatacatcgtgatttgtctgacttctgcttttttgtttctctaaaaatatttctgtatagtaccagtccctcttccactgcttcagtttcagtgcctctatcatagaagggtccatatcataaaagaagtcaaaagcagtcttgaataatcagaagccttctgccagattgtctaatgtcagtttgttttctggcactgctgcttctacatcatcttcctcatcgtctggcactgctttggaagcagtcgtctccatcaagtcatcttctgtttggttttttttgtttttattttttatttttttgagatggagtttcgctcttgtcgcccacgctggagtgcagtggcacaatcttggctcaccacaacctccgcctcctgggttcaaacgattctcctgtctcagcctcccgagtagctgggattacaggcgtgagccaccaagcccagctaattttgtatttttagtagagacggggtttctccatgttggtcaggctggtcttgaactcccgacctcaggtgatccacccacctcagcctcccaaagtgctgggattacaggcgtgagccactgcacctggcctgtcatcttgtgttaattcctctgatgtaatgtctgttagctcttgagtttctccaagattcatatcttgaaacccttcaccaccgctatgccagtttttttagccacatccacagtctctttcatgatttccttgattggctctgtcataaatcctacgaagtcatgtacaacatctggacacagtttgctcctgcagaaatctattgttttgggcttgatggctttcataagctttatctataacaactgtggcatcttcagtaatgtaatcctttcatattttcatcatgttctctttgttggggttctctttcataatgttgacttttttttttttttttttggagacagagtctcgctctgttgccaggctggagtgcagtggtgtgatcttggctcactgcaccctccgcctcctggttcaagcgattctcctgcctcagcctcccgagtagctgggactacaggtgcgcaccaccatgcccagctaatttttgtatttttaggaaagacgggttttcaccatgttggccaggatggtctcaatctcttgacctcgtgatccgcccgccttggcctcccaaagtgctgggattacaggcatgagccaccgtgcccagccgacggttctttacatgaagtaccatgtgtaataagccttacaggtccttctctgactgtgtggtctagagtatttgaatgtcttcagtgttgaactcatggggctctgggtagccaggggcattgtccaatatcagaagcactttaaaaggcagtccctttctggaaaagtacttcctgacttcaaggacaaagcatcgatggaagtaatccagaaaaagtattcttgttgtccaggcctggttgtacactacaagacataaacttgactgcccaagggacaggctaactcctttgcacaaaatcctggtgctcccttctctttcttactaataaatgtcatttgtggcataatcttcctgattaggtcgctttcatatacattaaaattgtatttaggcagataccatttctcctcaatgatttctctctctctctctctctctttttttttttttctttttttttttgagacagaatcttactctgtcacccaggctggagtgcagtggtgaaatctcagctcgctgcaacctctgcttcctgggttcaagtgattctcctgcctcaggctcccaagtagctgggagtacaggcgtgtgccatgacacctggctaattttttcttgtatttttagtagaggcggggtttcaccaggctggtctcgaactcctgacctcaagtcatccacccacctcggccttccaaagtgttaggattacaggcgtaagccaccaagcccagccctcaatcattttcttaatggtatctgggaacatgtctgctgtttcttggtcagcagaagctgtttcctgctatcttgacattttaaaagccaaacaaacctctttctaaaattatcaaaccatcctttgctggcattaaattctccagctttagatctttcaccttccttttctgatgaggtatcataatgatttcacattttttcaaatcatattagtgtatataggtatgctgttcttacctatataaaacctgcattttcaatatgagattaataggtatatttctcaaaaagcacagggttttcacagctgctggcatagctgcagtgctgctgtaactgcaatgatggcttcagttttttttgttgttgttttttggggtttttgtgtttgtttttttttagatagggtcccactctgttatctaggctggagtgcagtggcatggtcacagctcactgcatccttgatatcatggtttcaagggatccctcacctcaccctcctgagtagctggagctacaggtatgcatcactgtgcccagctagttttttattttttgtagagacagagtcttgttatgttgcccgggctggtctcaaacttctgggctcaagcaatccttttgcctggcctcccaaagtactgggattacaagtgtgagccactgtgcctggccccctgaaaatctttttcaccggacaggcaagacctcttaagtgatgtttccaacaatccacttttgcccttatccctagctacagaccctagagactagggaaatgggtacaagtatctgaaatcatctgattctccccacctcttccgtccattagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggtgagtcagccttggatgtatgaccagatgaagtagatcactgaacttcttgagagtttcccaaagggcctaaaataattctgtggtccatttatagctatttaatttggacctatagccacaaattccttttctgcttcctttttttaattaaataatttaaaattttaaaaattgtagtaagcataaaatttaccatcttaatcattttaattgtacagttcagtaatgttaagtatattcatgttattgtgcaagagatcttcagaactttttcatcttgcagaactgagactctgtacccatcaaacaagatatctcatctcctactccctagcaacaactgttttcttattttttacgttgaagttataaatattacttttttttcctcattgaggctaagtaactttcccaaaggcacatagctagtaagtaggagagtgtacaacaccatgcaacctcctaaaagatacaactaggaaggggtggaataggttatggctcttatctatcaagatacatgctgtttatttccatataactggcaagggatgaaataggttattgctcttaatctagcataatggacaaagacctaactttatggttgggtgacacccccaaaccctttgcagataccactccccgccatcctatattatagtcgtgtgttatatattctcaggtaaataatctgccctgcccagtaggggttccaaggaccttttctagttgccctccttggtggtttactaactttggcagttaggaagtccttttggtgcctccgattttatgagtcatcaagctttggcttcatactgtctgtttgcttctccaaggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggtgagttcctctccaagcttttctcttgatggagcagggaaagctgtgtttgccctgaggggaagattcttatctggctatccaaattctctttatagtctattccttgaaatctttctctccttttagtctttgacttgtttgctgtcattgccatttttccctgtcccttccatactggtccattgttttttacttcatttcttacctgatgtttcctgttaacttattttcccctttacttcttgcttcaattgcaggccaagcacacccaggagaactgtgagacctggggtgtaaatggtgagacgggtactttggtggacatgaaggaactgggcatatgggagccattggctgtgaagctgcagacttataagacagcagtggaggtaaggcaccctaagatatgtacacgctgttttaattaatttatttatttatctatttatttatttttgagacgcagtctcagtcacccaggctggagtgcagtggtgtgatctcggctcactgcaatctccgcctcccgggttcaagcaattcttgtgcctcaacctcccaagtagctggggctacaggcatgcaccaccactcccagctaatttttgtattttttagtagagatagggtttcactatgttgttcaggctggtctcgaactcctgacctcagatgatctacccaccttggcctcccaaagtgctggagttacaggcatgagccaccatgcccagcctggtctagtcttgaagggaggggtaaagaaggcagaatattcctctaaggtattccaaggcattctatctctttaattatctttagctcgtactaaaagcaagataatatagcacaatctgtatcacttgcttagggagaagtgcatttttttttttttttttttttttttttgaaacagactatcgctccgttgcccaggctggagtgcagtggcatggtctccgctcactgcagcctccacctcccaggttcaagtgattctcctgcctcagcctcccaagtagctgggattacaggtgcctgccaccacacccggctaattttttctatttttagtagagacggggttttaccatgttggccgggctggtctcgaactcctgaccttgtgatccacctgccttgaccaaccaaagtgctaggattacaggtgtgagccaccacacctggctgagaactgcattttacattcaggactgaaaaggccgggcatggtgggtcacgcctgtaatcccagcactttgggaggctaaggcaggtggatcacgtgaggtcaggagttcaagaccagcctgaccaacatgaggaaaccccatctctactaaaaatacaaaattagccaggcatggtggtgcaggcctgtaatcccagctgcttgggaggctgaggtagtagaatcgcttgaacccgggaggcggaggttgcagtgaaccgacatcatgctactgcactctagcctgggtgataagagggaaactgcgtctcaaaaaaaaataaaagactgaaaagatagatttcagacaaaatggcagttccatagtagcatctaggtgatagatctaaaggaaagaaaagtgtcctttccttctctgctgacctctttgcatctgtggtttttctcctagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttg

SEQ ID NO: 35713 - DNA, 95789 bp, Homo sapiens
tcctcccgccccaccgcctccccgcccagggtctgggcacagccgcccgccgcccagcacaggagggtgcagccccggccccaagttctgcgccatgggaggctcccactctcagaccccgaggggccgggaacccgccggggagaggcacccgagacccacggagaccgcgtgagtcccagagccctctccaagggccgcctttgggggtttgcgtgccagcccgggatggagcgcgctggggcccgtcccagaaaggctgggaaggtggggttcccgctggcggcagcggggcacgagcgctcggcagcggggcacgagagtttggccagcagggccccaggggcgtccggctgggagcgtcctgccaggaccccaccgcgaccggatcgcgtccgggcgtgaccgtggtcctgccccagtacacgctgtactggggagacaaggggaccccggcctcgtccaagcagaaaacgcacgtgtcctaaagagctctgaaacattcacaagacagagttatttgtagggaggtgaaactatgagagaggcactcaagtctcaaaacgcaattggcgttggccctcggggtccaggaattttgacgcagtgcttgctgcttgcaagaactccctctcttgtttgctccaagggtttcatgatgatctcagaaaaaaagggcagtattgtagcagcagcaattaggcttttgttctgggacagcaacaattggggacaccaagtactgtaatgaaagctgtgaagggaaagttttagagaaagtgattaggagcaagtcctacggtttgaaagatggccaatgcttattgacagagaggggataacaatttatttggaaaccaaatagtctttaaatatttatttatttatttattggaatgcatgcgtgttttggaattgcagcagtgtcagggaatccatactctttattttaattcagcccatgtcgaagctatttagtttgagaaagatacacttaaccatcacaaaagcagcctggaccgcgggagggcttttgaatcatcttttcaaggcaaaatagctttcggaatatccaaatggctaattttgtccctaatgttaccgatgttcacaaatataaacttacttcaggcagcttattaataagaatagctgacgccgggcgtggttggctcacgcctgtaatcccagcactttgggaggccgaggggggcagatcccctgaggtcaggagttcgtagaccagcttgaccaacatggtgaaaccccgtctctactaaaaatacaaaaattagcctagcatggcggtgcgagcctgtagttccagctacttgggaggctgaggcaggagaatcacttgaacccagaaggcggaggttgtggtgagccaagatcgggccactgcactccagcctgggcgacagagggagactccatctcaaaaaaaaaaaaaaaaaaaaaaaaaagctgagatttactgagcacatgacatgtgcaaaacacttctaaatgccccacatgttatttaacccccaagagccattgaattactatagttcttgttactgtcttcattttactggtgagggaactgaagcacagaacgatcaagtaacctctccaaggtcacacagctagaaagtggtggaccccagagctcatgccgcagccgcctcccacccaagagttggaactatcctaggaaacaatcaaaacttgtctcaactggcagagcacaccatcctttttcctttaattttgtttgaataaggagtaaatctgcaatagcaatgcttaatagctaattagacaaaattgccaaagtcgatttaactttcaaaaaacaaacaggagaggcaatataacattgagatgaagttaagagtttgggaggcaaagagccatgggttgaatttctaggtgctgctccttaatgctggagatcttttatctgttccttaactcctctgtgtctgtttccttatgtgtgaaacaggaatgataacaatatctacttcacaggctattctgaggttgacataaaatcagtatatatgaataataagttatagtttatctctgagcaatatactattttagctgaggatgaaagttgactattttttgtaaatgtgtggccaagtttactgtgtaacttgaaagtaaataatggagtctttcactgactgtatgctgaagaaatgaactcaggatgtgaggtagggttcagttgttagggtgttaaattatccagtggcttggcagcctacttgttttacccgtataatataaacatgcataaaggatctctctcttcattgaggctctgcatgcaccttgaatattttacaatgcttgcctaaaagcaatcaacatgaaagcccatccttggtctttgcctaggaatacagtccctccctactcaagtgaatacatgaagcacataaacacatgcagtcagtactgggattactggcctcatctgtatgtgtagactctgctcagtgaggcagcctcacaaatcatttggcatgtccaggtgaaagactctagaaatgcaagattccaaactgtaatatacatgaaaagcaaaaaggatgctttttatccaagttctgccttgttcagatgtacaagcgacaagtctctccaggatacaagaaagtaggaggttcattgttaatgttacccggctacagacttcctgccgaacatatggctgtcatggataacgctgacctcaaggaagttctcctactgaggctgtagccttttcaaaatctattgttctttttttaaaaaaaaaaaatacatgaaagtcatatgaataatacatcaatgctggcatttgtcttttgagggagaaagtatgtttcacaatgttcacaatttgtatttcagaataatctaatcaggtactaaaagtaactagattaaatctctcttacaagagctctattgtgaaatataaacaagcatagatgtacatgaaaagaaatgtctgattttaagatacaattcattattattgagaattgtagctgctaaccttctccaaacccaagaagccaatgagccagctttggtaaaagctagtggaaatttcacttcatttattcaaggaggccgtacaggaaggtgattaagagcagaaattgtggagtcaggcagacctgggttgtaatcccagctagatcacttaggaggttagtttaggaaacattggaaatacagttatttaactcttcagttaggcaaatttctgcatctgtaaaatggcaataataatcagacctaattgttttttttttgagatggagtctcactctgttgcccaggctggagtgcagtggcacatctcggctcactgcaaccttcaggttcaagtgagtctcctgcctcagcctcctgagtagctaggattacaggcgcataccaccatgcccggctagtttttatttttagtagagatgggattttgccatgttggccaggctggtctcgaactcctgacctcaaatgatccacccacctcaccctcccaaagtgctgggattacaggcgtgagccactgcgcctggcctcagacctaatttttgaagtggtgtatattagtaacacaatggccagcacttagtgagtgtgcaatacgtagttattatgaacacatttgcacatgtatgtacccatgaaccagatgccatgctgggctctttggaaggtatattcatgagtaaggcagggtctcttctgcagggaagtttgatttgtgtgctaattctacaaggcctctgagaaaagcaaggcaataacttttttgagttaattttttcctcatttttcacttccattttccagaaagttgtactaccaagaggatggaaatgcatttgggaatatgatagtttgatgaaatgtttgaaatcactcattccttagttgtgtatttttggcgatgtggccaaggtaggttttctacgagtagtggggaatttgtggagagatttgaagtatgagacaaagcagaacctgtgattcattggggaatatcatctggtgtttgttgtttagcttctctgcctggaatgtaagatctacacctgttgtcaattcttactagttaagtttccagaccaatcgtttgcatttggaatttagcataaggtcagtagcaaagtcaggaggagtttctgacgtcttcattgattttgccatgtgaatttctgatcaattaggtgctggctatgtgatattctagtgaactgcaaagtcagcaacagctagggtgaagtgccttttaatgagcacatcactgtgggacacatgtccctgacaccaagagggaggtgctggcttggaggttttagacacaagaaaacatgaattaaaataactaaacttagggagcaacatttgtaaattcattgctttcaaatttataatattgtttaccaccttctcaacacaaaatatttgttgtcattaaaagcatgtcagttcccatttgctatagaagttttttaaatgtccatgtgaaaatgtcttagtataaaattaagagagagatttagagcaagtttgtggagaagacccagagcaaccagccctgtgatgaaaaggtaaaagaattatagtatttaacttggagaagggacccaagacatgtggaaatatgtaatttttaggagatgttggctggctctatctcccgtgaagccaatcccgaaggaaatgatttgaattgcatgacaagggaattatttgtatctactgaatttagatattgcaacttctagactatgagggtagttgaaatagaaaaaagagttaataatgggaagaaaaatccctctctgcaaagcattaaaaagtaagatagatactctatcaagagtgcaactctgagggaattcaggcacagtttttaagtatacaactccgtggcattaagtacattggacaaccatcaccaccacccatttccagaactttttcagcatcccaaacagaaattctgtacccattaaacaataacttttcactcctccttcccccagcccccggcacccaccatcctattttccgtctctacacatttgactactgtaggtacctcatgtaagtggaaatgtacagtatttgtcttttcatgactggtttatttcccttagcataatgtcctcaaggtgtgtccatgtcgtagcatgtatcagaatttctttatggctgaacagtattccattgtgtatatataccacattttgtttattcattcatctgtgagtgaatacttgagttgtctccaccttttggcttttttttttgttttttttggggggacagagtctcactctgccactgatgctggagtacagtggcgtgatcttggctcattgcaacctccacctcccaaattcaagcgattcttctgcctcagcctccctagtagctgagattacaggcatgcgtcaccaggcccggctaaattttttatttttagcagagtcaaagttttgccatgttggccaggctgatctcaaactcctgacctgaggtgatccacccgcctcggcctcccaaagtgctgggattacaggcatgagcccggccccaccttttggctcttgtgagcaattctgctttaagcatcgttatacaagtacgtgtgagtccctgcttgcagctctttggagtataaacctaggagctggattgctggatcatgtgataacccacttcactttttgaggaaccacaaaactgtcttccatagtggctgcaccatttgtcattcccaccaacaaatgcatgagggctctaattttttcacattctaacacttgttattttctgttgttgtttttaaataggcatcccaatgggtgcgaagtggtatctcatttgttgttgttgttgttgttgttgttttagacaagagtctagctctgtcacccaggctggaatacagtggcacaaacatagcacactgaagccttgaactcctgggctgaaacaatcctcacaccatagcctctcgagtagctggaccacaggtgcacaccaacatccctagctatttgtttaaaaaaaaaaattgtggaaatggggctcttgctatattgcccaggatatagtctcaaactcccggcctcaaataattctcccccctcagcctcccagagtgctaagattacaggtgtgagccaccatgcccggcctcattttgttttagcataaacaagacatcactttggagatctaaggattttaggagttgcatgccaggaaatggagtcagaaaccaaatacagtatttacaatatcacaattgtaaagaaaataaactacccataatctcatcatctggagataattgttaacatgctgggacattttttatagtctctttttgtccaccaagtatatttttcaaaaatggggttctgctatgtcttctgtattctcatgttttacttaacattataaacatttctctatattactttactgaattcaaaaatattgttttaatgcttgcttaatggttcattatctgtatataccataattcatttttttctacatgtttgatatttaggttggttatcatttttgctcatataaacaacacagttaataaacatccttgtaattctttgtacatttctgagtaataacttaggatacattcctagaacttcaattacagggtcaaataatgtatagcaagattctaaaagttgctacatattactatatattgccaaatttccctcctccccacaattaataccaagttagaatcctcccaacacttcatgacagtgactgctcagcatccttttcttttcttttttgagactgaatctcactctgtcacccaggctggagtgcaatggtgcaatctcagctcactgcaacctccaccttcctggttcaagcaattctcctgcctcagcctcctgagtagctgggattacaggcgcccaccaccatgcccagctaatttttgtatttttagtagagacagggtttcaccaagttggccaggctggtcttgaactcctgacctcaggtgattcaccctcctcagcctcccaaagtgctgggattacaggcatgagccactgcgcctggcccagagcatccttttcaatgctgggcactatcattttaaatcaatttggtaaaaaaaaaaaaaaaaaaagcaatcctgttttaattttttaattcattagtaagggttatgtttaattcattagtaagagaatgttatgtttattagccattttgaattccttaatttcttgttatttctccttgcctgttatggactggtatattaatttttccatatttatttgtaagagttctttatctttatatggtgaggccagctagcatttattgagcacttaccacgtgctaggaaaatgctaaggtcttggccgtgcgcagtggctcatgcctgtaatcctagcactttgggaggccgaggagggcaggtcacctgaggtcaggggtttgataccagcctggccaacaactttgaaataccatttaaaaaatttagtatcaggctgggcacggtggctaacacctgtaatcccagcactttgggaggccaaggcgggtggatcacctgaggtcaggagtttgagaccagcctggccgacgttgcgaaaccctgtctgtactaaaaatacaaaaattagccaggcatggtggcaggagcctataatcccagctactcaagaggctgaggcaggataatcgcttgaaccggggggatggaggttgcagtaagccgagatcacaccactacactctagcctggttgacaaagtgaaactccgtctcaaaaaaaaaaaattccgtatcataacctctctttctttctgtttaactcttgatggctttgtttctttttttttttaatgtgtaattttatttctgcctcattaaacctcctcttggtctaggccaacaagagtttcttcctcctccaagcacacatgtattgggcacttgattatgagaaaatcctcagattattggaacttggtatggagtacatacctgtccctcccctccaacctgtgtgctaattatcttatggaaaataacctttttcttgcctttttctcccaagaaagccttgagtctcatccagaagtcagataagtgctggatctcttctctttgcttgagtgacaagttgtttttttctgattctaaagaaggagattgctgtccacacatgaatatccacaaggctaacactgcccctttattattcaggaagatatttggttttcagctttcccttgatggtttttgtctttttattcccattcattgaacaaatgttaattttttcttttcactctctttcattcaacaagtattaattgactgccttcttatgttcaggcactgtgaacattattatgtatgtgggaatttacatgagcagaagaaagcatttctaaatgcatgaaatctgaatatttgtttataatactgcggacgggacatatgccgaaaagtcaaacaagaggaaatgaccttgtgaatggagggggatgtgtggagctgaaaaaaaataggacatctataactgagcttttctcatagattttttttttaccagcctagccaattttcagtccatcttaaggttgcattttaagcattttcgcttcctctgctgaaatagtggcaccttcaaatgctctcggtcatcagtaagctttgtcaggcatacatttttcagggacagtctttagagtttattttttgtaataataggacataaagcacaaacagatttaatataaggaatggcaaatgatgaaccactgttctctgctcttcctttatcttccagctcctttacttttatttgtggagacttggtacccttgatgagtgactatccacaaggatcccttactttgacattgcttcattcccagaacacttactgttacagatactttggatgtaattttttcattgtttgtacaattgtacaatagtacagttttatctttatcaatcttatatgtctgctacatatgatattaatgacacttctaggcaaaatacattatatttagcctccttaaatttgggaatgttacacagaaactttagagtcctgtctatttttggaggtagagtagttccatttctgagaaaacccatcctgtttatctgtcttatactctgcatgttctcataaaaacctgacggcatagaatgtcactggtaaagatgggagctcccagaaaccttacaaagatgctttgctgtacagcaatagttctgaaaactgttcagagatcccttgataatatgatcgaacttttagggatctttccctgtgaaaatacacatatacacaatatgtgaaatgaggactgtcagagaccctgaaatctgtgcattatcccatttaatcctttcatggatcccatgaaatagacattattatctgcattttacagatgaagaaactgaggcctggaaaagttgagaaactaaggccacagagctaggtttcagtcctgatgaacctggctgaagcagaggacacaaattaccagtcaattccagagtgtttctgccacccaggcaactcattaaccagtggaggcttctgtttatctactagaaaaggagtttttatggctatttcctactgataagatagtttcagggaagtaaatgtttgagaaaacatcgcccagcccattctgtagctaaatagctatagagaaatcctgtattgcatttacacagagccgacagaagacctctgtgtaaatttcctgggtttctgtgctgaagtatttttgtctatgagtcttgctttcctaacaacggcaaaatgttatgtttctatggctacatcagaattgttcttaaataggggtttgagaaaacaaaactaggaaggcttgggcaagatacgaaggtaggaagatgactgacgtttcctctgccttttcacacctgtgtatccattggcctcagaaggcccttgaacctcttgatgatattcaggctgtggcacttctgggcagatgtgtgtgaagccatgattcctaataagtgccccgtgggccatagtaatggcacttgggaccacaggtcaagtccttataacctgggccctttacagttgatacccaaagcagagattggcaggttctcttgaggacaagactagaaccaagagatgtgtgcaaatttcaggaatagctggcaataatggggaagaagagagacagagagagtagagtctagagtgggcttcttttacctgttttccatctccttcctgcttcttgccaggtggagggctctatcctcccaccaggggatgccagccaccatccactaagtttttggcttggggttggcctggtggggagcaagagtttcttcaatcaactcctttgctgggtggaataaaatgagagggccattcagatactaatttatagtacccgtaggataaaagaaaatagattaggggccgggcacagtggctcacgtctgtaatcccaacactttgggagtctgaggtgggaggatcatttgagcccaggagtttgggaccagtctgggcaacatagcaagactctatctgtacaaataatttttttaaaaattagccagatgtgttgtcggcgcctgtggtcccagctacttgggaggcggaggcgggaggatctcttgagcccaggaactcgaggctgcagtgagatgagattgtgccactgcactccagcctgggtgacagagtgagacgctgtcttgaaggaaggaaggaaggaaggaaggaaggaaggaaggaaggaaggaaggaaggtaggggaagggaagggagggaggaagggaaagaaaataaaggaggacaaaattgactttttgacaccccattccttctgctggtcgggatcctgcctctcaggggtgtgtcttcaaatcctgtgattcacagagaactttctgtagcttctgagaagttgggagtctcccttctgcagtcgttcagtgcttgttcatttgtatctgctggttaaactgcagtataaacaccctgcattggatgcagaggggactcattgtgactttttgtatttatagaagtacaaatgttgaagaaattctcttcacacacaaatgtgttgatggacggtgtgatggaacgttctagtgccctctggtggctactgcggcttccggctggtgaagctgcacagcagaaggaacgggagtgtcaaaagttcaattttttcctcctccatccttgataattgtgtgtcttgtttgatcgattccatacccctgtatgaatggtccaggggctgagcaagaagctgtgtcttaggactgaagtgcttgaggagtgtgtgtgtgtgtgtgtcagacagagagagactttgaggggtatatgtgcaatgtgtgtgtgtcaccatatatatatgtgaaactgtgtgtgggaggtatgtgtgtgactgtgggcttatgtgagagttgggggtaggtgtggtgtgtgtggttatatgtgtaccagagactcaatgtgtgggtgggggtgtgtggtgtgtgtgagactgtgtatgtaagactgtcgggggaggtgtgtgtgtgactgtgtgtggtgtgtgtgactatgtgtgtggggtgtatatgtgtacatgagactgtggggatgggagtgtgtgatatgtgtggtgtgtgtgagactgcgtggtgcgtggatatgaggctgtgggggtggaggtgtatggtgtgtgtgtgagactgttgtggggaggtttgtgtgactgtgtggtgtgtgtgtgtgtgagagactgtatgggtgggggtgtgtgtggtatatgtgtgactaggtgtgtggtgtgtgtgtgtatgagactgtgtatgggagggtgtgtgtggtgtgtgtgattgtgtggtgtgtgtatgtgtatgagactgtgtatgggttgggggtgtggtgtgtgtgactacatgtgtagtgtgtatatgtgtatgtaagactgtgtatggtggggggtgtgtgtggtatgtgtgtaactaggtgtgtggtgtatgtgatactgcatgggtgggggtgtgtggtgtgtgattatatgtgtggtgtgtgtatgtatatgagactgtatgaggtgggggggtgtggtgtgtatgtgactgtgtgtggtgtgtgtgtgtgagactgggtatgggtgagggtatgtggtgtgtgtgtgtggtgtgtgtatgtatatgtgagactgtgtatgggttgggggtgggagtgtggtgtgtgtatgactgtgtgtggtgtatgtatatgtatgtgaggctgtatgggtcaggaatgtggtgtgtgtgactacgtggggtgtgtgtgtgtgagagagagactgggtatgggtgagggtgtgtggtgtgtgtgattgtgtgtgtggtgtgtgtgtgagactgggtatgggtgaaggtgtgtggtgtgtgtatgtgtatgcgagactgtgtatgggttgggggtgtggtgtgtatatgactgtgtgtggtgtgtgtatgtatgtgaggctgtatgggttaggggtgtggtgtgtgtgactatgtggtgtgtgtgtgagactgggtatgggtgagggtgtgtggtgtgtgtgtgattgtgtggtgtgtgtgactgtgtgtatggtgtgtgtgtgtgagagagagtgggtatgggtgggggtgtatgatgtgggtgtgagactgctgggggaggtgcatgtgtgactgtgcatgcgtgtggtgtgtgtgtatacatgagaccctgtgtggtgtggcgtgtgtatgtgaacatgcgtgctccctgcgctgccggctctggctctcccccatccttcctcacagagcagcgcaggtttggccacagatgtcaggagcccgcggcttccctgctgagctaagagccctcttcaggccttgtggtgtcactatagctgacagtgtcaagtctcacgccctttacgaagcagagaggggttttgatgccgcattgtttagcagtatgcagacctctccctaggggctgtagatttcctgccttctgaacaatctcgaggggagcgtggatttccgtcccggcggcaccctcgggttttccctcccctgccccctccgccgcgctctcccccttcgcacattcggaaaccctcttgggagctgaatcatgttctcgccttttttggtcctagttgagctctcttccactttcatcaccagaggcttgagatctgtgaaagaatcagttcctcgcaggctgcggtctgcgccgcgcctcctttgtatgtcacgctcagagaggagcagtgcccttggagtgccctgctcttgctgagagccgcacgatagatgtctttgaatgactgactttaattaaagtgtggcgggctggagataaaatgattctgaatatcttatttggggggaaaaaaaagccagcttctttcttaagggagaaaaaaaggactccagcgccaggagtctcttcggtatccctgagagtcgggggaactctttaaatgcggcccttgatggtgttgtggagggagagtgaattctgggaatctctcagcagctttttgccaaacagatgggccaggagccgcggaaccaggctgaggaatgttgcctcacgatctcacatatccattcctggcacccaccagcccagggaatgcctctaccagttgtcagcgagaggcttacacagcatcttaaataaaagggattattgaaccaagaggccagggactgatggaaatgcccaccttgctggctcattgaaaaagtttggcaaggttgtcaggagacatgaattagatgggcttgggtcttgtgccctttgctaaaccaagtgctgtattgggaaagagacggggagagaagtgttggagatgctctttagtcaggcctgagtcacttgcccaaccctggagttggagttggggatggagccaggatctccaaaccacatgcccctagagtttcagggaaaatatggattgtgaattgaagatggggggtgatgtaaggcagacaaggacagaaaatccctcttccagctgtgatttggctgtgagtttggcgctcgagacaccatacgctcctgaggtttgttaaggggtttcaggatattgtggacaaaagggaatagcaaacgatgttcagtccataagtaccatttggaggaggaaataattgaaattgctgctgatcaaaaagctttttgtctccagtttggatgttggagacaggtttctgtgtaagagagtgagggtgtacaacatgactgagaaagaaaacaatgagttaaggcacataagtgcgcatgggtgtcacctggaggccttcttataacacagatggtcaggcccaccccaagtttctcatgcagtagaggtggagctcaagaatttgcatttctattttactttatttatttgctttatttatgtttgagacagggccttgctctgttgcatgggctgtagtacagtggtgcaatcatagctcactgcagcctccaactcctgggctcaagtgatcctcccaactcagcctccctcccaagtagtgaggactacaatcacacgccaccatgcctggctgtataatttgcacttctaaggtgttcccaggtgatgctgatgttgctggcccagggaccacacattcagtactgctgttaaggcaaaagacttaaacactccatatatgaaagaaagaaaaagagagagagagagagagagagagagaggaaggaaggaaggcaggcaagcaggcaatgcttcaataaatccattaaaacacattcaaacttcagaaataaacgtgttcaaataagaccagcagtccttggtggtggcttatcatttcacccatttgacagttttaaaagattgaccgaactcagtattgattaaggtttaggggaaaggctgtctcatatactgtgtttacaaatgtgaatgagtacagcctttccagagggcagtttggctatgtgtatcaaaatataaaatgtgtttgttttgacactacaatctcacttctagaattttactctaagaaaagataagtgtgtgaaaagaaatttaagtgtgtgaaaagatgcatatgcatgggattgctcatcacggtttcatttataatgaggaacagcaaacccgttaaatatccctccatggggagcaagtcaggcaaattctgtacagacacacaaaggcatgttatgcagtgaagagaaggaggcacatgtgggttctgcagagaggcagatcccaatgaggggtcaggacgggtcttggctgcacatcctggtttcctcttcatccatggggagcagcaccttatgaagaaaacaagcggcataatgaataaatactcacctctagcaaaagataatatgtataattaaatcaataaatattaatttgttaaatgttaataaatgtaaataaatattcatatatattaacgtgttgatttaaatattactattcattaatataaacaataaattgatacttgttaacattaaatatcaataaattttatgtattaatataaataaacactaataaaacaaatatttaaacatgcataaagtactcacctctattgattaaggtttgtattaaggtttataatattaaggtttaataattaaggtttattgttgtattaatacttaacctgaataagtactcacctctagcaaaagacaaaacgtatacttaataaacactaggcccggcgcggtggctcacgcctgtaatcctagcactttgggaggccgaggcaggtggatcacaaggtcaggagtttgagaccagcctgaccaacatggtgaaaccccatctctattaattatacaaaaattagcctggcgtggtggcgggcacccgtaattctagctactcaggaagctgaggcaggagaattgcttgaaattggaaagtggagttgtggcgagccgagatcatgccactgcactctagcctgaatgaaagagtaaaactccgtctcaaaaaaaaattcattattttaaatattgacataaatattaatatgcatatcaaataaattaaaatattaatataatataaatttttatatttaaatattaatatttatattaaataaatactaatataatataaacattaatatttacactggtaaatattaataaaatcaataaatatttaaacatacatattgtcttttgccaaaagtacttattcactatttgtgtaaaagtatctatctatctagctagctatctatctagctatctatctatctagctatctatctagctatctatctgttgttccatttgtccaaataagtacatgcttgtgtatatgtaagagagagatttgcaatctttattcagtcatcaaatattgagcagaagaaacaagataggtaaggtactctgtgttcatggagcttatgtctagtagggaaagacagattataaatattaatagaaaaacataaatatttcaattccagatgtaaaaagtactttgaaaaagagggaaaaaagggtatatctagctcaccaacattttaacagtggctatttatgaaagacaatactatgggcaggtttttctttcttctttgaactgcctatgtagtcaaaaattcactttttcagagacaaggatgcttaacatggtcttctaggctgtcatgccttgtgcctctcccacttcaccagcctaagcccctctcctccctccagcagctgctcttcaaccacgcttactcaaaactggaggctgcttctgtccttagtgtcttgatgaaggaacgctgttaccctacacttcacccaggcagcttctgcctatccctgaggcttcagtctgtcactccttcagagcaacctcccttgacatctccaccgatgccgtccaccagccattctcagagccccctgcagttcttatatttcatacatgacaatttatatattacatatttatttgttggcttactaagctcactaatatgcaagttctatgagggcaggaactgggtctcttttgttcaacacagtgttcagcagaggctggcaaagcttggtcatttgtcaaatttgtggaatgaatgaatgaatgaatgaatgaatgaacatatgtattattttgccttaaacactaaaggtatttaaaaatacattttttattattgttttgagacagagtctcactctatagcccaggctgaagtgcagtggtagcatcacagctcactgcaaccttgaattcctgggctcaaatgatcctcccatcttggcctcccaagtagctaggactacaggtgtgcattgccacaccaggctaatttttttttgtttttgtttttgaagggatggggtctcactatgttgcctaggctataaaaatatttttaaaggccagccacggtggctcacgcctgtaatcccagcactttgggaggccgaggcgggcggatcacgaggtcaggagttcgagaccagcctgtccaacatggtgaaaccccctctctactaaaaatacaaaaattagctgggcatggtggcacatgcatgtaatcccagctactcgggaggctgaagcaggagaatcgcttgaaccccagaggcagaggttgcagtgagcgaagatcgcaccactgcactccagcctgggtgacacggtgagactccgtctcaaaaaaaaaaaaaaaaaaatgaaaaccaaaaacttttaaaacaaagtacaagactatttgtatgtatttgctttataaaacaatttacagtgccttttaaaatgaggtgaattttggggagaagtcatatctctattatacataccaagtgggcatatcttttggggctggggggaaactccagaattcataccttcataccttccttgcaagggttatgaatcctagttgtgcactttggtgcctgagtaaaccttcttccaaaaagaatgatattcgacccagtgatctttggcaaaggtcctttccagctaaaaatttctgtggttctatgagatctgagatggatgcttaggttaggagtcagtgattatcttagtctgttaaggctactataaggatataattgcctgggtggtttataaaccagtcatttatttctggaagttctggaggatggaggtccccatgattaagggaccagcagattccacatctggtgaaggctgacctcctggatgtcttctccctgtgtcctcatttggcagaagaagggagagggagctgtctggggtctcttttataagggcgctgaccccaggaagaaccctcatgacctaatcacctcccaaaggccccacttcttaatattctcacattggagtttaggttttaacctatgaattttggggggatataaacagtcagtctgtagcagtgatttatcatttgttcagaaaataatgtaaaacaaatatattctgctcagtgtctatgccttggccaaaggaaacagaaaacacataagatattcctatatcatacatgatgaggtacagggaagaccggtaaggataaactcgctcttgcttgtcatagttctataaaataatacaacaaaataacttgactaattgagcccataagaaaacaatttctaaaaatattttgtgtgtgtgctagaaatcgtcactagcaccagttagtgttgaagccaaagaacaatgattaattcacttataggatttgggtcagttattatttattattgttattatttatccttagaattgggcaaatattggagttatacaatcatattatttcaaggaaatctccccaaagaaaataataaccttcatcaatatgtaaatccattctacttggcctttgtgaaatctaaatattgactccctccttcttcaacgtttttgtccacatcagtcatctttaaaaatgcaactgcctaatttctagaaagtcagtatcacagctcaagtcattacggcagaaggaagggtagtctcagtcctgtttttaggataattaggacatcatccacggggcaggcttgagtcttttggttcgggaattttctgccctgagaaaagacatcattgagatacaggtagagtgttccttatccaaaatgcttaggaccagaagtgtttcagattttagattttggaatatttgcatatacataatgagatagcttggggatgggacccaagtctaaacatgagattcattatgtttcatatacaccttctacacatagcctgaaggtaattttaaacagcagttgtaataattttgtgcatgaaacaaagttttgactgtgttttgactgtgactggccacatgaaattaggtgtggaattttccactgtggtgtcatgttgacaagcaaaacgttttggattttagattgttggattagggatgctcaacctgtgtagatttatcatttttaaaaatgcttccatctttgaaggaactttcatgtaatcctgttcagaagaatgtagaacgaaatttaaggcaggttcttcccataccttcatctaaggaagcttagatgctgaaatcccccagaggaggttgtaatgtgagggtggagatgaggctgctgttacaaaggggcccagtgacacagtctgataaagaagatagacttttaggctgggcacggtggctcacgcctgtaattccagcactttgggaggctgaggcaggcggaccacctgaggtcaggagttcgataccagcctggccaacatggtgaaaccccatgtctactaaaaatacaaaaatcagctgggtgtggtggcacgagcctgtaatcccagccactctggaggctgagacaggagaattgcttgaacccgggaggcagaggttgcagtgagccgagatcacgccactgcacttcagcctgggcaacagagtgagactccatctcaaaaaaaaaaaaaaaagagaagatagacttttctctctcatggaacagtcctcaggcagcaattagtctagggccgcaggctgctctgctccccagtcagcctggtgcgggttctgtctgttctgtggctctatcctgtccagagtgtggtcctcacacagcagaagttgtgacacgcagttcacaacttttcggccgggagaggctggacatgcagttttctttttaaagacattggcccaggggccaggcacaatagctcatgtctataatcccactgcttctgtaggccaaggggtgagaattgcttgagtccaggaatttgagaccagcctgggcaacacagcaagaccctgtttctacaaacaaaacaaaacaaaacaaaaaacattagctggacatggtggtgtgcacctggatttccagctactcaagaggctgaggtgggaggattgctagagcccaggagctcgaggctatagtgagatatgattacactactgcatttcagcctggacaatagagcaaaactctgtctctaaaagagaaaaaaaagacactgccccaaatttgcacttaccccttgtgctcacatcccatgggtgagaactgagtcacaggccacacctagttgtagagaaggaaacgtggcctcttgctgtgtgaccatgtgctcagcaaaaattcagagggttcttttgctagaagaaataaggaaatgatggatacagatggatacaggatgtggggtgagggaattaggctctaccatggtgatcttgtggaaattcaaagagtagaggtgcatagacacacaatgttaaagaagcattatagtttttcttttttatctttgtgtgtgtgcatgtgtgtagagatgggctctcactgtgtggtccaggctggtctcaaactcctgggctcaagcgatcctcctgccttcgtctcccaaagtgttgggattacaatcatgagccaccacacctggccttttgcttttttatcttaataattaaaattgtgtgtgtgtgtgtgtgtgtgtatgtgtgtgtttacaatgggtacagaaggaacagagccatgaattatgtttcacaatctgtgtaggagatatcttttgacagttttatccagtttccaacagttaaatatttttgtttcctctaagaagacagaggtcagtgtgaccccctcgctccataaatggacatttcacttactgagttgaggccagctgaaccactcctgagccacaggcaggaatctcttttgttctctgggcagagctgaatttactatgaagctgaggaagcctaagcttcagtcccctcccttgcatgggccccttcatactagtgtggccctagcactgtgttcatggggtcctttagcatttttcttaaagagtgcttccccagtttttaggcttcctgcttcacaaaatcaggccttggcaacctgtttgatgcctcctttctttgctgagccttgctactttttcccagatggggagaggctcctgggtgtcatttccctcatcaacatagtttcttggaagaaaccaccctaaaaggaagtatagcgaaagagcatcccaaagaaagagatgttaaaattaatccttttgcacctcccacataaagtatgccttttatgctctggcccaattttttgtgcctttgaggattctcatttgtatcagtaggggtccttgggttttttttttttttttcttttctttttagacaaggtctcgctctgtcacccaatctggaatgcaatgccacaatcacggcttacttcagccttgaccttctgggctcaagcgatcctcctgggctcaagattagctgggactacaggcgaacaccaccacgcctggctactttttaatttttttatagagatggggttttgctatgttgctcaggctggtctcaaagtcctgggctcaagttatcctcctgcctcagcctccaaaagtgctgggattataggaagatgccactatgcctggctgaaatgctctttttttatggtactttggctcaactggcaaatgccttcttgaaatgagcatttcacactttggtcaccacacagtcacttagatgaaacccacaggctgcccagtaacatgggctcccactgggcatttggggaagggcacaccctgcctggagtggtgagcactgctaggcctgctctccgcccttttccaccctccgggtgtcttcaaagctggctgttttctacactaacttctggcaggtctggattttccgtataagggcttttttggccagtacttccttatactgaagaattttatattagttccctttcagattcgaaaatcaatctttagtcaacctaaaacattattcctggagtggggcttgactgtatgtggggaagaggagagggagagactgatgcaaatatgcacacacacatactttttgcatacaatttcagggaggccaggaccttctgaaacccttccttgctaagcctctgctgtagagggtgaaatgcagccaagttaacttgttaacaacaacaaaaaggccgtaacaatactttcctcctgagattgtaggagtaagtgggggagattaaatgagacgattcatgtaaagtgtagtgtctaacacatagtaagcagttataattgttcacttttcttttggggcttaaatgatcttacttgttttcacgagttccttaggtaataacaatactaacagcctttgtttttccatggcctgttgtttgccttttaacttgaaggcacacagtcagaagcttcatttttttaaatgtaaccaaatctatctttattttgtgtctgatttcattaattacttgtaagttggatcctcatccttcctacagagctctgatagattctgttgcttgtagactgttttctcccaatggttcgatttttattatttagtcatctaatccatctggaatttatcctggtatatgctctgaggtaagggtttaacttgatcttttttcccattgccagccaactatgctccaatcataaatcttccttctccttacatattgtaacatgttctttatatttttgttgtttgttctttttttttgagatagagtctcgctctgttgcccaggctggagtgcagtggcacgatcttggctcactgcaacctccgcctcccgggttcaagccatcttttttggtatataataaattcctgtatcttgtaagatcttttcctgggctttctgttctgtgttacagaacaaagatctggctatttttgcataaatgtgtctcaatgtcttgtaggactagtctattcttcactcttcttgttggtgttgtttttttttgttttttttttacaaaatctaaaatatgttcaccagtttatttttccagataaacttttaaacattattgacgaattctaagaaaaatcccctcggaattttgattgaaatcaaattagccctgtaagttaactgggtggtattgccatcttagcaacagtgttttaccaacttggagtttcaggaccaaaatacagtaatcaaaattttactccaaagagataaaagctggagtttacaggatgctgtgtatcatgtcacagagttggctgcttattttcccatctttttatttcttagaaatacaggaagattattggtcacaaacacatgagttactgtaatgaaattcccccaaatccctagactaaggaattaagttggagttggtgtcacagttatttttgaaagctttttgtgattttattcttttcttctgggtggaccttttctccccacatcctcctagcagtgaatctgcttttgcctttcactgccccttccaaccaccatcccaatctgttaccttgtaacttcttagtgacaagaagacgtatggtctcctgaagattcacaatatatttatgaggatagtgagtagaatattttatattagggtgatctcaaaacatttgggctatatgattaatgttctactaatccataaggatgcattgtttaggacatttattttattttggaggtggggaaaagaagaaggaataaaatggctgtaggagaagaaatattcttctttttttttttttttgaggcggagacttgttctgtcccccaggctggagtgcagtgatgcaatcctggctcactgcaacttctgcctcctgggttcaagcgattctcttgtgtcagccgtctgagtagctaggatgacaggtgcgtgccacatgcccagctaatttttgtatctttagtagagacggggtttcgccgtgttggccaggctggtctcgaactcctgacctcaggtgatccacctgcctcggcctcccaaagtgttgggattactgatgtgagccactgcgcctggccaggaatattattctacttaaatgtcctgaattccttcagcctctttaattcaagtcttaaattccaccctccccacaaacaggtaagtgtagtaaagcagatatctcaaatttgaagtaatgtcctttactagaatcttaaatttataaacaacatagaggaagtttcagatggttttcttgtctgagctctaggtataaaactctcagacttggagttggacttggacagccctcttttttattttttattttaattttatttatttatttattttttacattcttgtaaatctttattttttttattttttattatttttttttgcagatttctttttttttcttttattattatactttaagttttagggtacatgtgcacattgtgcaggttagttacatatgtatacatgtgccatgctggtgcgctgcacccactaactcgtcatctagcattaggtatatctcccagtgctatccctcacccatccccccaccccacaacagtccccagagtgtgatgttccccttcctgtgtccatgtgatctcactgttcaattcccacctatgagtgagaatatgcggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttaggtatatacccagtaatgggacggctgggtcaaatgccctcttttttaatgcctagtctgctcgaaaggaatctgagttcaacagaaggaaacaaaatgtgctaaatcagtaagagtaatcctccaagatgatattcctgtttaacaggctctgtaaatacaatagtgttgtttagcaggaaagaccaaacatatctattggaatagaagatatttctaaatttaaagatagttcactgctttaagtggagctttgtgtttgtttttggtttgcttgttttcaactttggatttgtggtggttggtgggaagaattagggataatgttggggttatttttcttcacttagaataaacaggctgacctaattctgtttatatcttttgcactcaacaactgcttctttaatatgtttacatcacagagtagagaactaaagtgaactttcttataaagtcaataaacatatagtcatgaatatttgatgggaatgagagaatctcacagaactggctcttcaatgacactagtgtagtgtaaatatctatctatctatctatctatctatctatctatctatctatatatatatatatatatatatatatgtccccccagcttctctgaaagctgacacagtgtaactcttctgtgtggcagttctgctataggtttgacctgtgacctaggttgaatggtatacttcctggggaaagcaaacttttcttctgtgatacagaagaaaacagatcaatgggtggatatgacaagagttgttcaccagagcaaagtctgggcaagggtctttcagcagaccccaggtggggggctcagccaagtctttaataaatgcagtttggatctttgttaatcttcctggaactctgaaagagtattttcttttttttttttttgagatggagtctcactctgttgcccaggctgaagtacagtggcatgatctcggctcaccgcaatctctgcctccccggttcaagtgattctcctgcctcagcctcccgagtagctggaattacaggcgcctgccaccacacctggctatttttatattcttagtagagatggagtttcaccatgttggccaggctggtctcatactcctgaccttaagtgatctgcctgccttggcctcccaaagtgtgggattgcaggcatgagccaccgcacccagcctgaaagagtattagctatgaacataccctgacacctctcttttaaaaaattagaaaggagcttctctttataattttctgtataaatgcattgtacacagtcctgatttcggtgtttgggtagtggagggaagattgtaattctatagatgtttgtagtctacaggtaaaggataattaggtaaatatctgatcttgcaaggttaagactgtcatgttaacatatttgaatgcggtcagatgctgttattggcaatgttgtcttgattagacatcatcatgcccttgcctggttagactgaggtagggcagaaaagcagatagggtggccacagcctcctgttggcaatggcacgtcttcactgacagggctagagtgttcctagttgtgactttgcaacctgtaccaggtaagaacgaagccaggactaggagcagcagactgagaggagtggtccagctaatggactcatattcattactgcttacactaagttcaagaacttgcagaggagtgattttcagaaaccttaggcatttatttgctagtccagtctcaagaagttgctgcaggccgggtgcggtggctcacacctataatcccagaactttggaagtgggtggatcacctgaggtcaggagttcaagaccagcctggccaacatgatgaaaccccgtctctactaaaaaataaaaaaattagctgggcatggtggcaggaacctgtaatcccagctacttgggaggctgaggcagggagaatcgcttgaacccaggaggcggaggttgcagtcagctgagactgcaccaccgtgctccagcctgggtgacagagtgagactccatctcaaaaaaaaaaaaaagtaaattgctgcataggtgaggcttaatcttactggggccatcacttggtcctgggttctgttattttctggcccagaaactagatttccccagggggagtcaggctttaggaatttatgtcaccttagccaaactcacaaggactatttgtaaactagaatgtttgttttttcttacatatatattgaacacctactgagtgtgtggttctgtcctaatttctggaggaagtcccaaaggggggtaaagtccctttagaagcttgtgggacagatatgtaaataaatatgttatatatggtgtgctaagtgtagaatggccttacatcctggtcttctggagacagtcctggtttatgcctatagtccctgtgtaactattaagaatgctgtctttcactttcagatctaaggccacaggaagtgttctttatggatgttcggggtatagaaatgatagaaaggaaggacaatgagcctgcttccccctgtagacacttgagctaagtgctgaaggacgttcgagcagctgaagcctgggaacttggggtgggctggggtgggggaggaggtgtgttccaggaattcgcaaagctccctctgcaggcaaagggagactgttcccgaagcagtaagcagttggttcaagctaggcactgtttcccaaatttaccctgtgataacagttccccaggacacttagtgaacacacagatttccagactctgctggcaatttggatttttttaagaaggctggcggatgattcttgggcatattaaagattgacaacgagttctctactcactgtggctaggaatacaaaaggatgggcatagaggggaatgggaaccgaaagattagagcacgagtcactgatcagccaggcaggggtgacctcaggcaagaaaaccttcagaggtaaaaccaggtgggagttatttacagtagatcatgaaagatggggagtgcgggaactatgtcagtcaccacagggatgcaaaggaatgaaaagataagagaactattcaggaggaagaacaggtcctagtgtatgctagttactgatttgctggggtaatattatttcccagaaacagaaccctgtgtcaaatccaggagcctgggggactgtagaacctgaagttttactgggtaagcataaacctaaaactacaacagttggataagtggtgtgatatatttcacatggacctcctgcctagttcacttctttatagtcgctagaacactcatgacaatttatttctgggaagaagccaggatgaattcgaaagcatcctgacaccccacccctttcttttctctagacttcaggttaactcctgcccttcggttttggtaaaactaccctgccaagccttatcttgtattttgctcctgtttttgttatcaaatgtgtaaaacagtcacgatgaatatacatgccaactgctttcagaggcaacggttagtctcttgcaagtttcaacgtgcacattttggagctgctgtctctgtgggaacctgcaggcacctcatggatgcaccacaactcggaaattacagtaccacctggaacaccttatccaggcaaggagatcattaagcctggtgtttgaggcaatcgattcacttggaagaaggtgctttggtggttttgagaggaacaatccctacatgaaatccctccatgggaaatggagaacatcagctatttcccattgccttcaaacctaaagatgtcgccaggcctcttggcttgttactgaagcagcgaaataagtcagaaatcaaagacttagaagttacgaaaagaaaatctcaaaaaggagaatggggtcaggcgcggtgtcaggcctggaatcctagcattttgggaggcagaggcgggaggatcgcttgtggccaagagttcaagaccagcctgggcaacatatcgagacgcctgtctgtattttaaataaataaatatggagaatgggaaacccatcaggctgtaatctcacagggaatttagtaccctttacctaagacaagacctgggcacttgggaagcctccccgagtgcggtttggggagggggagggcatcttaaattccagtcctcggtcactcttgtggctttgccaagggattttcaaatcccgggaatgccagggatggagatgaacaggctgaaatcccccacgctgccagggttagggaggggaaaacaacagtccacagcggccgcgaaggtttgtatttttttttttttggtaacaaggggcttgtgtgcagtccaatatcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggcaagtacacggcgtccccgctgagatgcagacgcgcttgcctccatccatctgcgactccctctgtgtgcgtgtgtgtggtcgccacccgcgaaaccgtcctcacggccgtgccgcgtccctgcccggagccgggtccccgtgtgcgtccgaaagttcaggatcttctgtcctcccgtggggtttctggcccccgtttcgctaggagagttccgcacccaacccagaatctgcagtctctccgcatccccgctggcctcggtcactttctctaagcttcgacccccagcccccgcccctccacactggagcaacgtcactgatctaacccagtgcaacttagggcccccccgtggggaagaagtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaaggcaggtgacaccattcttagcctcgggcccagggagttccagcaggtagaggcctaccgagcaaagaggaatgcctagcatcggcctaactcgggggtgggaccagtattaattgttaaagcctctgggaaagggctcttgtgacaaaaggagtctgttggaaaagcgcatttttcaggtgtctgagggaaggatgacctcgaaaataaatggtgctggagaaaagctccagggaatggaggagctttcagagagacaggatgccagcctgagaaacccaaggagggcactgctcagagaccgcagttgcctcccgcaggtcagaccctgctgaggaccggttggttgtgaagttagacaaaagtgctggacttttagcctctgtgaatatgtagatttcaaagggtgtcggaaataccgttgaaagtggtaattcctcatttttcctccttggcagctcggattctgaaggtaattttgagactcctgaagctgaaaccccgatccgatcacctttcaaggagtcctgtgatccatcactcggattggcaggacctggggccaaaagccaaggtaaagaaaaacttgcatttttcctgcctgttttgtttcaaaagttttgaaaaatatcaatgaaggaaggaaaaaagtgtaaatttaggaccatttaagagagtttgactaagaaagagctgtttgaaacctcctggcttatgtatttttaggggtgtggtgatcgaggctttctcctctgagtagagtttgtgcatttgcagtataagattatcattatcaaacattcctactaggcctttctcctcagcccctaaaaaaatatgtatagtaatgaagtaggaagatcatgtttatatttgacttcacaaattcctcaggctaagttgctttctactggggtgtggctggagacaaaaattacaggtaagacttgacttaatttttgatagggaggttcttaagaggctttttcggaatcactcacctcgcccacttccatgcagggatgtggtgagagcccttcagtctacttaggaaaacctggcacatggattccctcccagcccctcagagcccagcccttcatctgcaggagcttccgttgtctcacttaattagtagaaaccttttttgtcacacagccagttcagaataaaatttcacctatcccaacagaattcatatgcttatttactaaatagagtgcactgtgattcagcagtgaagtcctgctctctcgagctaacattgtggagggagaacctgtgaagggttaagcaaaatatctatgtcagcttgtgtgaagcactgtggagaaaaataaagcaggggaagagaatagggaatatggagtggggatagggaaggctgaaggggagttagtgggggcattcatgattaggtgacttgaacagagacctgaaggcagattgagggagcaggccttggaggttcctgaggtgggaacccttccagcagaaggagtggcatctgcaaaggtctgacagcaccagcctgctgcagggaggccgtaaggtggagggttcatggtacagtttgaggaccagccaggaggtcagtgtggactgactactcagagagcaggaggagctgaagtcagcgtggtcagaggaggtccagatgctgctgcagtgaggatttggttttcagtaaggtggaaagccactggagggcatatgcatttccaagggctgccataacagagtaacttagcggcttacaataacagaaattattctctcacagtcctggataattgaaatcagaaccagaagtctcaagtcaaggtgttggcagggccttgctcttctgaaggctccaggaagtctgtccttgcctcttctagcctctgctgggtgtctgcaatcctttgtgttctttggcttgtggcagcagaactccagtctctgtctcaacacatggccatcttctccctatgtatctgtcttaccgtgcccttcctgtgaggacaccagtcgttgaagttagggcccaccctaatccagtttgacctcatcttaacttggtaacatcttcagagatactatttctagataaggtcacattcataggtactaggagttgggactttaacatatcattttgagagacataattcagcccacaacagagagctttgaacagagggattgtgattcagcttcttttgtaaaaggctccctgggctgctgtgtggagaagggactctaggatggaagtcctttttatgtggtttctctgttccagtatctggcactgtcaccctgaagtggcagcgccagctttcagttatctagctacctaaactttgtgctgattgtgactttctcctctccctaataagtatttttattgcttagcaacttcttcgtaggttgcctagggaagtcaagttactctggtaatagactgcatgatggagctggaattattggtaaaatgacatcagcaaaaagctgatttggttttgctttaaattgatagctccatgctgtgcttacccagctgagaattcagcaataccctcaacttgccctaggctgcattttgccattgttctaggcagggacaacatgggaataggcaagcttatatactggagaatttgtgtgcgacgcatagctgtgtagcactctcagtgatgaagataacacttattcctcatagcttcccttttcttccgtaaagattggcagatcagaagggagattttgaagcttgaaagaactatttggtggcctttccatcaaatttaaataaagctcataagacacatgttaaggagctgtttgaaagcctttttgaattgccatcagcttgggcggcccttcctcatcgttttgtcagctgctagactgattcatcccgccagattctttgccaattgaatagaggcctggatgacctaggcccccaaaaccacagagacccaattgtttggtccttcctgtaccagtgactctcacatttttttcattctctctaaaaggaaaacttttaaatgtttatggatcatgaaggctctatggggtagttcatgaatgcagactgtaattgtaggggtagaggagtgtccagtccaggaaacaaccctgcatattatgaaggctttcagtttagggtctttaaacaataggatgattgctcatcaacctggtcgtaccctgacttccagggtccttgggtgcaacatccggagctagtccagagtaccgccaatggccttgtcacacatacacagcaaatgtgcaaagacagccagagcacaggtctgcctggagaggatttcagtgggcagaaagcccttcagagtcatttcatattgaagtttaatttctgggactggataagttccctttctcccaaaattattgattgttttgttcctggtaaagatagtctttcatacttttgtggttccaagacatggttggaccgcagttataaattatataagactaaatcattctggaagaatgatttacgaggagttagtcaggagttggagttgaaatatgtaaacattctggcttcctggtacataatggccctcaaacgtgtgggctacatttaccatacccatggctcctgtgctgacttctgtatagttctttgaactcagggaaacatctaagactattttgaaatgacttttcttatactggaactgctttaggaacttgcagtatctaaactctataatgactcttcctaagagttgtatgccaggagttaagtggcggataaggttgtagattttttttgaagccacatatagaagcaggttttaggcttactggtaaaataaaactctagctaaagatatttcctggaaataaccagactggtagctgtaaagcttgggctggtctgtatttgctatctgtctgttttctcccactaaagttgtttaatgctgctgctgttgtggtggtctttctctttgctgggaaatatattggtgaagaaacatcctctaggaatggacttttgaggaggtacaatctcaagttcatcctctgttttgttttgctttgagacaggatctatgtctagactggagtgcagtagtatgatcatagcttactgcagcctccaactcctgggctcagatgatcctcctgcctcagcctcctgagtagctgggactataggcacacactaccatgcctggctaattttttgttttgttttgttttttgagatagagtctcgctctgttgccctggctgaaatgcagtggtgcgatctcggctcactgcaagctccgcctcctgggttcacgccattcttctgcctcagcctcccaagtagctaggaccacaggcgcccaccactacgcccagctaattttttgtatttttagtagagacggggtttcaccgtgttagccaggatggtctcgatctcctgacctcgtgatccgcccgccttggcctcccaaagtgctgggattacaggcgtgagccaccacgcctggccagtttttttattttttgtagagatagggtcttgctatgttgcctaggctgatctcgaactcctggcctaaagggattctcctgcctcaccctcccaaagtcctgggattacaggcgtgagctaccatgcctggcttttgtgtttgcatgtgtgtttatggaggacttaggggttgtggctttgtgtagctgtttcagtcacaaaaactgcagtgggtgccctctgccccttgagtttctccttcaccaacatagccccccttccccaaacacacacacctttatctacagattgttacctctctctgagaaagagaatcttaattagtgtagaagctctcacatcacccttggaacaactcgttaaacctctccagtttgatgtgttaattaaatgcctaggtatttcaaacacaaactgtagttctctggacttttccccagaatagaagaaaagagataaatgggatctgtgcacagatatttactgcctcaggcctgtgagggaatgccaagttgtttgttgacacaattttggtagtctcgatcagaatcagcaaactgtgactcatagaccaagccctgcctgtcctgtttttttgcatggccctgaacagaagaatgagttttacattttttgatggtttaatggtgatgtgtgaaaataatgtgaaatccaaatttcagggcccatcaatggtcacacgattatgtgaatttactaaaaaccattgcatcatatattttaaagggtggactgtatggtttgtgaattatatctcaataaagtagttcttaaaaaaaaacaaaacaaaatttcagggcccatcaagttatatatatatgaaatatatattttggtagatatggggtcttgctatgttgcccaggctgatcttgagctccagggctcaagtaagtgatcctcccacctcagcctcccaaaatgctgggatttcaggtttgaaccaccactgtcatccccataaataaagttattggaatacagccatactcattcattcatgtattgtctatggctgcttttgctctacaatagctgggttgagtacttggaacagagaccaaatgtctggcaaaagtctaacatatttactatcttgtacagaaaaaaaatgtcaacctacatctatacttattacaatttcagtaaaaatacagagtttaagtaatttgggaaaatggctttaagaatgaaaaggtgcaaggttatacctgctgaacaaatgaactgtgggcgtgaggtgccattagtctaggcctgcatgttcagggaaggcccaggggagagcctgatgtggcctggctatttgtcatatttgcaaaggggaagtgatgtaattggtctgcaatgaacttgattttcaattgactcaaagatctaaggaggaataaaaattatttaaaaaggaaattagggaagaatggggagaatattggaatcatttaatagaagtacaaacacatagacttttaacttttgcccattaaattttttttaacattttattttcttaaattttttttaaaaaaatagtgatggggtttcactgtgttgcccaggctggtctcgaactcctgggctcaagtgatcctcccaccttggcctcccaaagtgttggggttacaggcatgagccagcctcacccaacccattaaatgtctttaatgtaacttcgggtgtatgagaatttgtaagttgactgtgcagatctcttaaaaggttgatatggtgtatttttagaatgttttagactgcacgtgtgtgtgtgtttgtttgtgtgtgtgtgtgtgtgcgtgctatagaaaacacagcatggaaaccttgttaaaatcagaggctttgattttttattctaaagctttgagttatatgtttaatcagatactatgtgaaaaattttcattaggtacatattgaagtgttccattcaagtctacaagtatatcctcctaaggatttagtttaacatcctttccctgctccaacaagggaatgctttattagagtttcctagaaataatgggactaattaggacctttcatattacctagtccagcagtccaacccatgtggctccttcaacagcatcgcagcctaatgcttttaatttaattttaaatttttaatgttttgctgtgattgcctcttccacagtttgatttttttgtactgtataattccatgttaaggtatttaaagcttgaaaatcttagcatgatatagctactttgttttttcatgtatttttagctctgaagttggagattccaaccagctaataaatgagatcagagtcatgtgtttttttgttgttgttgctctatcacaatgtaaatgtgcccctaggaagcacctgcttctatatggtgccttacccaagggagtgtcttcctggggaaaaaagtgtagtttttccagcagaaacttgtgagagtgcagaaccacagaggagcaacagtgtctgaataaaaaattccagggcagggaagcaaagtctacctgcagaaaggaaagattttagtaactatcaaatcacaatttttcttttaagatgagtgacaaaatcaagaccttgcactcccccattttgggcttacccaagcatcgaataaagcagtagaacttactttggtacttgcgggtggcagagacactttctacctgtgtatgtgttttgggagccggcagtccttctaaaattatattgctgccatgtaatgtcccacctacaaaatggatgtggcctaaagccatttaaacatttaaatgaaagagcagttgcagtgtctttttcaggttaccagttatactgcccagaggaaatcttggagggtataaaccattttgtcacactctcctaaatccagagtagcgatgggagataatggtttatccacccaaaacaaccctctcagtggagatttcataaccaaggttgctaaattgcctggtgactattaaatctgggcttagaaaggctttgctacttgtgagttcaagatctcaccctcacctttgcatgtacatgacctaattttatgagttcaaacaaacatgattagatccccagggtttagattgatgatggccagactcacaagggaataataataatggcatggagtattttattaattcacaaatgaaaaatgtatcttgacagtttggcagatgcagatactctcctagccagtcgaggaccctctttcttatatcatagctggaaatatgacaataaatgattgatctccagctttcccattacaatattcccacctagcagatcaccagctatctgtttcagccgtatttatttattagatgtgttgggaacaagtaatctttgtttgcagcatcttgtttgatttttatgaccatgattctgcgagataggacacaagtgatttccatttcacagattgggaaattgaggccagagcctttactgctagtagtggacctgggttttgaattcagcttttaagattgcagatccagagctctttggaacatattatacagcttttctctccaggaaatttgtgaatccctctctgttgttcactatctgaagagaagacatatcagaggaaataaagggtcttaaaatgttgccagagcagggtgtgtgatgggggaaagcatcgtcttaagtatcctgtcatgtgatagtagtttaaaaaatcaaaaaatacatcttccacatgtgtgaacttggcacatattattctgaagtatgaaatgtattttaggaagttgaaacatcagaagtttggaagcttgcagcatgatttagatataaattaatagtcaagcaaaaatcatcactggataagtgcagtgggattgaaaacattttgcttcctcaatgcctagcttcagctcatcagtgaaaaataaagaaggagtagacaaattcagtactagcctttgcattctgtctccacctgagtcatgcatggttgagaagaggcaggtgtgtggaggtgtgtgcggctgccaggggctctgcgcctgttttatggtagatagaggagtttttaagaggcctttgttggtgatctctggctgcataacaaattactccaaaactgaaaacaacgaacatctcacatagtctttgtagttgggaaatttgggagctgggtggtgtggctcaggtcacttttgagaatgctgtcaagatgtcggctgggactgcagttgtttaaagacttgactgaggctcaagaatcctctcctaaggcggcttactcatttgcctgggctgtgagtgctggctgttggtgggaggctgcagtcctcaccatgtggaccactgctgggttgcttgagtatcctcacagcatggcagctggctgccccagagtgagtgatccaagagcaagcaagatagaaactgcagagtcttctgtgacttagcctcaaaagtcacacttatttccacagtatccttttggttacacaggtcagtccaagggcatgtgtaccaggaggtgagacatataggggccgtcttggaggctggctaccacaaagcccttttccactttttaaaaaacttgcatgaaaggatatacaagggtatacattcttagatggcaaagcttttcccattgctttcttcctttggcgtctcttcactatgcccttcctaaccccactccttcttgctgccctctttcttaaacaggagcagaactggctgaagaaattatatagccgcctattggcttgtggtcctgccatggatgtgtctcatgcacccagcatgctggctgagattgctctgtctggaggcccctctcttgctgaacattcctccctcttcttctttatccagcatcagcttctcagctccatgtgggtggttgctactttgtgagagaggcagttggtattttgaattttccagtaattatttctgaagagatgcacattatggttgtttggcagcaacagattgaagttacacaatcccagatctctgcacaggagccccatctgttagcacgtgctctttccccccttgctcttcctgccagaataggttggggatgggggagaagttttgtggggagggccttctatgatttctgtctgtggaaggggatttctactctgtctaaaatataacctcaaacaaatccagatggttccagaacccatgggcatctcatgagtgagaagagaagacacattcattgctggattggcttctctggaggaggctttggcttcctggtgggtggacacttcctgataagcaagtcccatcctcttaccttataatcttggcctttagagatacggtttgggtctctttttatttttcttccttttttttttttagagacagggtcttgctgtgttgcccaggctggagtgtggtggtacaatcatagctcactgcagcctcaactcccagtcttaagggatcctcctgactcagccttccgagtagctgggactacaggcgtgtaccactacacctggcttgggtgtctttttaaataaaatagcataaagtgctgttttggaaatttgaagtgctttcttcatccttagtacaaacttttttcagtttaccaagtggttttccagattattctttacctgtagagtcttaggttttagggggagcctctctcaggagttagaggcttatctcaggagaacagcagtgtagctggtgccctgtctcttaaaaaagcaatgaaatttgccctaccgtgacttctgggtaatgtttttgtttgggggttttttggaggttaggaaggggtttaaacaggtagtttgttgtctgggttctgcgtgtgtgtgtgtgtgtgtgtgtgtgtgtgtgtgtatgtgtatttttctgctttggttggtgagacagcttaaaactatgatgtacctaagaggatggtctgccttgactcacccactcagaatcccgctgacccacccctctcccatgcttccggggatcctgggccccagcagttgttggggaaatgtgagctatgcagcccatacccttagattgtatcccgcattcctggaaaagggcctattgtacggttgttccaaccctggacaataaattgtgtacttctccattttaaggctgatgactaagtgagaacgaacatatataaaatacacttcaactttggaggaatcagagagactgggaacccaaagacatgaaactgggggaaaaaaacactcaaattttggacttttagcattaatgctaatatacatctgattaacagtctcctcagggcagaccacttgagcagaaagggttggtgccagaatcacgcttgtttccctcctgaagcccttgattcagtgtgggggaggagagctgggagggcaagaccaaggcacggaaaggaggagtgggaccttcagggcaaagggccaagggaagagctatgccaagccatcccccagccgttagcctagagctgagctgcggcatcactgaacaattagctaggccttctcagtatgcgacagatgaggtgaggaggagtcctttatgtatcagacacttgccctgcagtgggcactgattgagcatcagctctgtcttggacgctcagtttctgctcccagggatacaaagagtaaggcccctgtggggctccgagtctggagggagctagccctgtcctgtttcccagacctcttggccgccttggcatcccaagaagttttagcagcaaaagatagggaatttgtgagggaagaaattcccccgcaaatctggaggtcaaatgttaaaaggaagaaggcaaatgttaaaagttagaattttaaaaatccccctgcccacaaagtaaaaaaagccttttgggcttgacaattataactctaggatgtttcatataccatacttggctacatctgttgtggaaaagagggatgatgtcatttttttcacctctttctgtaaatagaatttatgtagcacatgtgggcttcctcaagagaaatttaaaaccccaaattgatgggatggtgagacctaccacctctctcaagcatgtgtctctccaagtgacacacataagacactatttaaagcatgtactttggatgtgtgtgctggctcactcctgtaatcccagcactttgggaggccaaagcaggaggattgcttgagaccagcctgggcaacaaaatgagaccccgactctaccaaaaacaaacaaacaaaaaattagcagggcatgatggcttgtgcctttagtcccagctgctcagaaggctaaggtgggaggatcacttgagcttgggaggttgaggctccagtgagccgtaatcgccccactgtactccagcctggacaacagagcaaatctgtgtggtatagttgaacattttactagaaatcacaggacattcctcctgctccatttccctcgggtctgagcctccatgttcttttttaaaaatagttttattgagatatagtttacctgccatacaattcaccatttaaaagctttatgatagtttttaatttatcgacagagttgtacaactattatctcaatttaatttttagaacattttatcacccccaaaggaaaccctatacccattaggtgtcacactccattcctcttccttcccaccaccagtcctaggtaactgatgatctagtttgtgtctcaatagatttgattatctaaacgtttcatgtaagtggagtagtagaatatgtagtcttgtatgactgaatcagttcactaaccatgttttcaaggttcagctatgttgtagcaagtatcgggactttattccttttttattgttgaacaataccccattttattgatatactatattttatttacccgtttattggttgacggacatttgggttatttacacttttggctatgatgaataatgctgctatgaacattcacatcatggatttatgttttcatttctcgggtatataactaggagtagaattgctaggccatatggtaacttcatgtcaaacattttgaggtactgccaaactttttcaaactggctgcactattttacatttctgccagtagtatttgagcgtttcaatttctccatatcctctccaacacttcttattgtctgtctgtttggttatagccatgccagtaggtgtggagtagttttgatttgcatttggttttcatttgcatttccctaatggctgatgatattgagcaacttttcatgtagctattgggtatttgtatatattctttagagaaatgtctattcagattctttccccactttttaattaggttatttatcttttttatcactaagttatatattctagatgcaaattccttattagatatgtgactaaatattttcttccattgtcttttcatttcttgatggtgtcatttgaagtgcaaaagttcttaattttgataacgttcagtttacttgttttgtctcttatgccttgatgtcatgtataagaagattttgcctaacccacaatcacaaagatttacttctttgtcttaacagttttatagtttgagctcttacatttagatttgtgatccattttgagtcagtttctgcatatggtgtaagggagtagtctagcttcattcttttgcatgtggatatccagttgtcccagcaccatttgtcaaaaagactattcttttccctatacaattaactttgcacccttgtcaaaaatcagttggccataggtacaagtattgatttgtaaactcttaattttgtttctctgatctatatgtctctcgttatgctggtaccaccacactgtcttgattactatagctttgtagtaagttttgaaatcaagaagtatgaggcctccaaatttgttcattttttcaagattgttttagctattctgagtccattgcatttctatatgaattttagaatcagtctgttaatttttgcaaagaaggcagctgggattttgatatggattgtattcaatctgtaaataaatttgggaagtattgctgtcttaacaatattaaatcttccaattcatgaacatggggtgtcttccatttatttaggttttctttaattgcttcaagcaatgttttttgttgttgttgtttgtttgttttttgagacatggtcttgctgtgtcacccaagctggattgcagtgatgcaagcatggctcactgcagcctcaacctcccaggcttagacagtcctgcccagcctctctagtagctggaatcacaggcgcatgccaccacgaccgggtaatttttaaattatttgtagagagagggtttccctatggtgcccaggctggtttccaactcctgagcttaagtcatcctcctgtctgctgctcccaaagtgctaagattacaggtgtgagccactgctcctggccttgcagtttttatagtataagttgtctcagtccgttttgtattgctgtaaagcaggggtccccaacccctgggcctattaggaatgggccacacagcaggaggtgagcagcagggtgaacgagcattactgcctgagctccacctcctctcagatcagcgatggcattagattctcataggagtgcgaaccctgttgtgaaaggcacataccggggatctaggttttgcactccttgtgagaatctaatgcctgatgatctgagctggaacagttttatcccaaaaccatacccctacctcccatctccccggtccatggaaaaattgtcttccatgaaaccggtccctggtgccaaaaaggttggggaccactgctgtaaaggaatacctgaggctgggtaattctaaagaaaaaaggtttatttggctcacaattctataggctgtagtagaagcatggcacaggcatctgtttctggtgagggcatcagggagcttccaattatggcagaaggcaaaggtggagcaggtgtgtcacatggtgagagacgagaaggagaaagagagaaagagaaaaggaggcgctgggctctttaataatcagatctgaggagagctaatagaatgagaactcactcattaccttcaggacagcaacaagccgttcatgagggatccacccccgtgacccagacacctcccactaggcctcacctacaacactgggaatcaaattttaacatgagatttgcaggggacaaatatccgaactacatcaacatcttatatttcttttgttaaattatttcctaaatattttattttttgatactgttataaatggaattgttttcttaattttttttggaattttcattgcaagtgtgtagaaatacaattgatttttacacattgatcttgcatcctatagccttgttggtttcatttatagttttttggtggattccgtaggactttctatatgaaagattatgtcatctgcaaatagagatagttttacttcctttccaatagggataccttttatttcttttcttgccagttaccttggttaaaacttctagaacagtgttgagtagaagtcgcaagagctgacatttttgtctcgttcttgaccttagggtgaaaacattcagtcttttatcattaagtatgacgtcagctgtgagtttttcataaatgccctttattgaggaagttctcttctagtcctagtttgcttagtgtttttatcataaaagagtgttggattttgtcaaatgctttttctgtgtgtattgagatgatcatgtgtgttttgtcctctgttctgttgattgttgtgtattatattaattgattttcagatgttaaagcaaccttgcattcctgggatagatcctgtttgtttgtggtgtataatcctttttatgtgttgctggatttggtttactagtattctgttgaggatttttgcatctatattcaataaaagatgctggtctgtagtttttttttcccccttgtgattcctttgtttggttttggcaccagagtaatattggcatgatggagtgagttggaaagtgcttcttccctcggtattttttggaaaagtttacaagcaattggtattaattctttaaatgtttggtagaattcatcagtctggtccaggtcttttctttggaggaagttttaaatttaccagtttaatctctgcctgttttagattcattcagattttctgtttcctcttgagttggtttcagtagtttgtgtctttcttggaattgatctattttatcgaaattgtctaatttgttagcttacagttacttatagtattttttcttattttttaatggcattaataagccctactgtgccttttacacagggttgatttgaggatcaagttaggtaatgtttatggaagtgctttgaaggctatataagtatgaagtattttatttgttctaaatttttaattataggaaaacagttgttctagaacaaattttcattaaatttctttgcatttttcacactcaatgtcaagagtagcccactgttagcactgttgcaatttttttttttctttttgggatggaatttcgctcttgtcacccaggctgagttcagtggcgccatcttggctcactgcaaccctccgcctcccgggttcaagcaattatcctgcctcagcctcccaagtagctgggattacaggcacctgccaccatgcctggctaattttttgtatttttagtagagatggggttttgccatgttggccagcctggtctcaaactcctgacctcaggtgatccaccaacctcggcctcccaaagtgctgggattacaggcgtgagccactgtgcccggcctgttgcaattttttatttttcagatgggttctcactctttttcccagcctggagtgcagtggcactatcacagctcactgcaacctcaacctcctaggcttaagcgatcctcctgcctcagcctcctgagtagctaggactgcaggcaaacaccactgtactcagctaatttttaatttttttgtagaatcagggtctccctgtgttgtccaggctggtctcaaactcctgggcccaagtgatcccccctacttagcctcccaactgtctacagtttatgaagttaacatttgtgatttgctcctcttttgtgagttgcacttgaggggagagattattgcccttgttaccaaaggaatatgaactaagattgagttgaaagggcaattaaagtgatttttggacctatttccctatttcttgagagatagcagaacatagatcctatagtatcaggctcaaagggcatcagtgccccattagaaagtcatctttgggctctgacccatttgttcctggctagcattgagagcagctgtttcctttcctccctgaggaatcactgagcgtggtctattctttggcttcctaacctctctcatagcacataccttagatgaattatctgcattcccacctcttcccagcttacttctaagtcaataataaaggtcctttaaaaacacaaatcagttggctttcaaaaataaagcatcattttttctagagctttcttcttttgctgaatacgaaaacaaatgtaaaaaggaagtaactcattgagaaagggaagctggtgacacaggaaatgactcctttaaaagcagaagtccagctgcagggttttctgtgcaaatgtgttgtgggccttgaggtggcagtcctatgaggcggtggtagggctttcccctgattcagtactcagctggtcccaaggggctttgagtgtggcttttgcctccttaactggatgctgaataggctccttgcacttattttgggactccgttgtgcctgtgcccagcacagggtgtgctgctggtggtaaggacctgtgcttggttggttggttgcttggttggttggttggttggttggtgatctgagaagataactctgtggttcaattttagggcttcaggtcctggcaaaactgccagtttaaatgaattacagagtgccgacattgaacatctggtttggatctttattagaatttcttaatactatggcttacagtcaattgcttttatatgtttgtaaaatttcaccattagtgctgagccttccaaatttgtggcatcctttgtgtgtcttatgtggcccttagtggcagagatgcacacttggggcttggattcagcaatctaggccactgccttggtaaccagggcttctattctctagttgtcagaggcttgcttagtataagacatattgcaacctgggcagttgtgtgaagctgtgaggtcacctccactaatgaggacagagtagaggagcgaggggataattctatctgtttgagatacctggccccagtgtggtcgtgtgggttccctgtctgacttctgggtgctcagaagcatggccccgggggtctgtagagacatgccatctgcttccatcctggctccatgcctgcctgctctcagtggtgtgacagtacagagcaatgaccttgactccgtcatgccatcagcaggaaccctggagcccttccctggtttatggtccacttgggttttctcaggttcatcctgtgaatgaagagaaattggatgaacgaagatagctctagaattaattgagggggggctctctagcatgattgagtcatggtctgcctgtgtgtgtgtgtatgtgtgtgtgtgtgagagagagagaaagagagagagggagagagagagaaaataaattccatccctctgtcttgggaggagaaagagggatggggctggctaggttgaggatggggtcctgtgatgaaatggaagcagaggagaagtgggtagaaggggacttggttttgggtaagaagatatttttgtgcttgctaagaaggattctaggcctgtttcttactgctcagtagactgtgttcatgtatcagtggctaacctgtacttgtggaatatgcggttctcttctataccagttctctgattctccagccccagctgggttttcaaaaactcagttctattctgatacttactttctcgagttagcctcagactccacaggcttaagggctcaatctcacaaaactgctctcgcttcagatgctaattgcaagtcccagatcccagtcatctgcacttgtgtctgacttggctacaaattttggagttttcataccctcgcccaggtttgataattcattagaataactccgagaattcaggaaaatgctaaagtttactggtttgttataaaggatacaactcagaaatagccacatggaagagctgggtgtaaggagtgtgcagagcttccatgccctctctgggaatgccattctccatgcacatctaagcgtttgccagcccacaagctctctgaagctcatacttccgagagtttttataacttggtcttcagcccccttcccttccccagagatggaggtggagagggctgaaaattcccatcttctaatcatgcatttggtctttctggtcgtcagcccccatcctgaagccacttggatatgagatattgtttatgtgttttgaggtcagaaagagagccagcgtgtgtatgtgagaatacaggagacttgtccaaattctggcagctttctcaattatatgtcagctgtctagaaacccgtaaaaagggctgtctatctaaaggagaggaagtggtggacgaatctgaaaggagctcttagacaatgttttgccatacagttaaaatctgggagggaaaagtcaagcatagctgagaataatgccaaatctgaagtgttaatgcacattgttttccaagtggttgctgttttatctcttcttaaatgagattctacatgtaaaagcagctaaccagttgattctcagtatgttagctgaatacatttctctgaagtttcaaaaatattttgtgataacatttcccctcttctaagactttcaagttttttcatagatttgaattttaacccagtatattttcaacataacagggtacaaactagaatattaagctgtttccctcaatccttaaaattttgcattccataccttttcttttaaaaatacagagagggagagaactctttttactgcaaatagtctttatcctgaataagcataaaaagcatctactgtttaagatcacccgtgggcgattcacacaaccttttagatttagggaaggctgactattgaaaggaagagtttcattaacagcaacaaatgggccagaagtggaaattttggtctatttgtggatttcctctgtgtttgcttttaattcatctactgatctaatctctgtctgtattcaccaagccgccaggcaatgctgtgcttgtcagaatcaaactcatcaaactccttctagagagagagcctttcagtgccctggaagaaggtttttagggaacacaggatttctgtaaaaatggaaaggcacatgaaggtaggttagttacataacagtgctttcagatgaaaagcaaggcctgacagctgtggcccaaactcttcattatgggagattgggacctggagcctactgaggatctgggtatgtaacttcttataaaagtgacttgtggtgtgatacttgaagtttaggttctttcctttcctttttcttttcatttcccagggacttgctctgttgtccaggctggagtgcagtggtgtgatcatagattaccgcagcctccaacttctggactcaagtggtcctcccatctcagcctcctgaatagctggaactacaagcatgtgccaccacacttggctaatttacttttattttttgtagagatggggtttcaccatgtttcccaggttgatcttgaactcctgggctcaaggaacaccccctactttggcctcccaaagtgttgggattacaggcgtgagctgctggtcctggcctagtgttttagggcagcactaggtatatggggttagctggtactgagacacttgctgatagtgtaaatgcaaatagaatcttacccaaacataccttttcaagttatgtggttagtttgtttttctctttttttttattctcagggctccccaaactggtttaagtaaatgagcattcttctcccacccaccgcctctgcttgtttggaccttctcttggtgactgaagatgccagactgagatatggggtctgcagtgacttggtatagggctgggcaagtttatttacctggcacctgccccgagctggccaagaaatgactgggccgggggtgtattttcagtggagttccttcagccctctgcccagcctggggactgagcggggtggtgtttgttttccttctgcattccaccatgacagggccatgcgttttacaatgtagcagataaggctccctatcactgatgctaactttgcataaatctcttgattcccagctgcttgactgatgtaggaacacaagtaccagtgagaggagcatgtgggggtgaagccatctcatacagtactacccttcctaggtgtagagtgaggagatgtgccacggctgttgacccttcttaaactgcagagcgtttgatgtccagggacagttgttggggcagggtcagacttagagcttttgtcttgtgctgagatgtgctcctttttctttcctcccccttccctagctcttggacggctttgccccatcactgattggtgcacacccccttttgagaatctcagggactcagtttggtaaaagcagctggtggagatgatggagagaggaggaagactcttaaaggagtgggtatatgtggaagaatgagggaaaggccctgtccttgtgttatggagattagggtagaaatagaaagctaggagagagtttggcaaaaggtgattctcatagactcctttctttgggggctgtgggactgatggtgaaggagtctgggtaacaggaaaaaaaagaaccccaagaggtggatgagtgtgggacctacagaaggaggggaaaagggcttctcagctcctgacagctgagtgttggtagcgctttacttcccttccctttaacccttaggttttctggaagctgtagggaaagaacacatagccctggatattctggctctgggatcctatgaaggagaatggtagtaaatgtttaggagtccatgacaaaaagagtgggagagaaattatgtaactgtaaaaaaactttaaaaaactaggatccgcttccaacactacatacaaaagtagaacttctatttccattgcccagataaaggactatcaagattttgccatacttgcttccaccatcctctttttctttttttcttttttttcattttgttacttaggtatttttaaaagcaaattccagatatcatgtcatgataccacctatgatcatgtcattatacctgtgatgtaattatcaataatattactcttttaatttaaaaatatatttaaaattcaggttttatcttacattagattcatattttttaggtaaacttttttttaaataaacttctggctgggtgcagtggctgacacctgtagtcttagcattttgggaagctaaggcagaaagatcagttgaggccaggagtttgagaccagcgtggacaacataataagaccccatttctacaaattcttttttttaattagctgggcacactggctgtatgcctgttgtctcagtttctcaggagggtgaggcaggaggattgtctgagcataggaggttgaggctgcagtgacctacgagtgctccgttgtactctagcctgggtgacagagcaagaccctgtctccaaaaaataaataaatatttaaaatttaaaattaggatttaaaatatgttaaagctcaaagatgaaagtgtagaatggatatcacttattattatgtagtattcagtgtgaattacgatgatcacatctatatccatggctctggtgatgtcaaatattattcccagcccagatttcttctctgaacatacttctacttattcaacatctctgcttcaaaatcccaaaacaggccaggcatggtggctcacacctgtaatactatccctctgggagactgaagtaggaggatgatgtgggcccaggagtttgagactagcctaggcaacgtagtgcgaccccgccatctgtacatacaaattaaaaactagctgggtgtggtggtgtgcctgtagtcccagctacttgggaggctgaggagggaggaaaagttgagcccaggaggtcgagattggagtgagccgggatcacgctacagtattcaagcctgggtgacagagtgagaccctgtctctaaaataaataaagtataacaatgtatttaagctatgtttaaaatttttttgaaatgaaatatggaatgattaaaaaaaaaaaaacctgaaacagatctcaacatgtccaaggctaaacccatggccccactccaactagtccccaagcattcactagtatttcctgaatctcactgaatggcactagtcttctagtttcaaaggctaaaacttacaaatcatctttgctacctcctcctacttcagtcctgtatccagcttatcacccagccttatcagtctcacctcatttcctctctagagcataacttctcctcctgttgtgggaagtcagggaccctgaacggagggactggaagaacataaatcgtgaagatttcatggatatttatcagttcccaaaattaatacttttataatttcttatgcctgtctttactgcaatctctgaacataaattgtgaagatttcatggacatttatcagttcccaaataatactcttataatttcttatgcctgtcttactttaatctcttaatcctgttatcttcgtaagctgaggatgtatatcacgtcaggaccactattgtacaaattgattgtgaagcatgtgtgtttaaacaatatgaaatcagtgcaccttgaaaaagaacagaataacagcgattttccgggaacaagggaagacaaccataaggtctgactgcctgtggggtcgggcagaatagagccatatttttcttcttgcagagagcctataaacggacatgcaagtaggagagagattgctgaattcttttcccagcaaggaatattaataattaataccctggggaaagaatgcattcctggggggaggtctataaatggccgctctgggagtctctgtcttatgcggttgagataaggactgaaatacgctgtggtctcctgcagtaccctcaggcttactaggattgggaaattccagcctggtaaattttggtcagaccggttctctgctctcgaaccctgttttctgttaagatgtttatcaagacaatatgtgcatagctgaacatagactctcatcagtaattctaattttgccgtttgccttgtgatctttgctttgccccttgccttgtgatctttattggcctcagaagcatgtgatctttgtgacctactccctgttcgtacaccccctccccttttgaaatccttaataaaaacatgctggttttgcagctcaggggacatcatggacctaccgatatgtgatgtcacccccggcggcggcccagctgtaaaattcctctctttatactctttttatatctcagactggccgacacttaggaaaaatagaaagaacctacgttgaaatattgggggtggattcccccaatacttcctattcattagcatcacccttgtcaaagcccctagaataaaatactagcagtttcacatgttccatttttacactctttaatccttttccacattgcaactggggtctgttcaaaatataaacctgagtatattctctgctgcttaaaaactcatggcttcctgttgctcttagaatagaaccagattcttgacaaggcctgcaaggctctgtgagcatggtgcctttctatttcccatcctcatttttccccttcattctttcagtattatttaatcaatatctctctttcctgctagtctctaaactgcatgagaacagagccctcctcttttttgcttgctgttacgtccccagtgccaagcacagagcccagtacataaaaatacttaggtatttgttgaatgactgagtgaacatgtgagtgaaatggaggggtgaaccattcctgatggatagggagctggcttctctttgcactcattgcatgattgtttgttttctcttatattgagttgaaatccactttcctcttaatagttgtgcatatgatccaaattttttccctttacctcaaacgcccttaaaatttttgtagactctatcatgtttcttagttttctagactaaatatcttagactaattgtttacagatacaccaccttgatccacattcctctaaggacgtccatttttgttcacaatttttttaagatgaggagctcagaactgaattcagaatctaactgaattcacaatctcagatgttatgtgatcaaggagactacaagaaactgttatggccatgaagagatgaatttaacatatggtttagcacccaggccttagagtttcgacagatttggtaaaatctgtcattagtggtaaagactgatgtcttggttcaataagatagtcccggtgagctcttagtagcccattgcctagtccatccaaaccctcagtgcattttactcaatcctgttgtcattgatgtttctgtttatctgttaataggatctgagattgcatatgctttgtgctcagttatgccaccatgggttgtattgagttgcaatcacatgttaactccaatcacatgttagaaaatgttgactggttgctcaggtaggtctctcatcctgtacttatatgcaggttttctcttcacctctgggctccttgaagacattgcataggacatggttgtaatgcccatcctttcatatcagaagggtttatgtgtttgtctctcgttaggtgacatcagttgatctcagaatcttgggacttgagttctctgtgcactttagtttgaatacatttggtctcggcagaaatccactcacactagctcaaatatgtatacatcattgagaaaggggcgtttcatagaaattaagctggggcagtgtaggtaggcctttgtgggcattgaaaagtcctcaggtacctccattctctatcacttgtccactgggataggatggtcttctgtctttattttatcctgacctcagcctcctacagatctacttactgtcttaattcagattcttgagagagagaatctgttatttgtgtcacttggataatcaaatagaacttatttaggaaaagactaagtagaacaagggtctactgcagtatatctgatgtgatattaatattctgtaggtccagaggagccattggacatcaacagcttaaatgttagggatgcaaatgggtactgagttcccaggcacagtctgatagtttcagggtcagaattttatgcagtgatcagatttgaatgtttggaagttaaaaatacagtcattcaccatataatgatgttttgatcaacgactgactgcatatatgatgtgatcatgtaagattataataccatatttttactgtaccttttctgtgtttagatacacaaatacttagcattgtgttaccattgcctacagtattcagtacggtaacatgctgttcaggtttgtagcctaggagcaataggctataccataggtatgtagtaaatataccatctaggtttgtgtcaggtacactctataatgatcacacagtgacccgcacaatgatgaaatcacctaatgacagatttctcagaatccgttgttaagcaacacataactgtattccctattccacagaacagggtttaaataatcagactgtttcaaaaataaatggaaaacctctcatgtctggcctagaatcacctctctatagacagaagtactaaaagaaccaaataaaaaatccattggaaaacaaacccacagcaaatgaaaggaggtagttcttgtcctaacatttaatataggctaattagtttatgggtaaatacagtttataaattgtacacaagaaaatacacatgtaataccaatattttagaagtagaatttttatttttagcaaatccatcatgatttacttaggtaacaagttcttccagtatatcagtttgatttatagtaaaatgtagtgtaaaatagttttctagatggagaaacagtggctccggaccatttcttgcttgtcagcatatggaaagggtggctctcccaccatgccacaccatccactcctgctgggcgcaccaggataaagatgttaaaatacaacctcttgtatagggttttcaagatctgttacttagagtgggatcatctgtggtacaactgagagatgctgaagttctccttaaaaggtcacgtgtattaagttcctagaacgcctgttcatctccacttatttccatatcaccatttttagagatgcacttcccactttaaccatagttttcaaaatcttaaggcagtggaaccttttcctcaaaaaacaaaaattatgtggactctaacatataatagattttttgtttgtttgtttgtttttgagacagagtttcactcttgttgcccagactggagtgcagtggtgcgatctcggctcactgcaacctctgcctcccaggttcaagcgattctcctgtttcagcctcccaagaaactgagattacaggcatgcgccaccatgcccagctaattttgtatttttagtagagatggggtttcaccatgttggccaggctggtttcgaacccctgaccacaggtgatctgcccgcctcggcctcccaaagtgctgggattacaggtgtgagtcaccgtgcccggcaatgtataatagattttaaggtgatatatattatagttgtaaagattaaaaacattagttttaaaaacagtgggatttgtgagattgaaacatgcaaaataactaaatcagagtctaattaaaaactaagccggatgtggtggcatgcacctgtaatcccagctactcaggaggctgaggcgggaggatgacttgagcccaggagttcaagatcagcctaggcaacgtagtgagaccatgtttaaaaaaaaaaaaaaaaaagaataaaatttatttcagtagtgtttggattacatgttattgaaagaaccttgatttatgcaggtcagtagttgcagataagtttttaaataattcagcttagtacctgagagcgtgccttaattaaactattccaaaagtctgtaagaggagcagaggggaatttgtgtttcagatttgagttattaacaatatctaacaattcatccaatttattaattttatagatgtaaattttagaaatagtacataaagtggttcctcatgagtttaaatctttttggtagaaaatacaaaactaagatatttagaagtatcattttaaaaaaatctcagataatttagtgctgtgtctgttaaatagtcactgttaaaaggcacatttcctgttctggatgttctcagattctccagcaccaactgggtttccaaaaattcagttcatttcttaaactatctgtccttagtgcagaccccacaagttaaggtctcagtcccacgagactgccgccacttcagataccagtcacaagtctcagtgcttctgagcaactggctataaatttggggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtaggtgtgattgattaaattattggccttggtgattgagctcattttccaccctttctcccctccctggaaggagtggggacggtgctgaaagttgcaaccctctaatcttggcttggtctttctggtgaccagcccattcccgcagctgtcaagggacccccagcacccagtcattcattaacacacaaaagacactctgaccagtcaggaggttccaggggttgtaggagctctgtgccaggaactgaggacaaagacaaaatacgtatttttattataccacctgtgttgaatctaaaaagctgacaataagcaccaaaacttaaaaggagtgataactatctaaaccttgatataatcaagactcattgttgtacaactggcctgtcttttaactgagccagttgtacatggaaacacatggatatttgcagccttagggtgctgatggcttgtttttagttgtctgcctccgcatcatcagcacaaagaaacaataacacatttataacagttcacatacatggacagagataatagactctgtacacataagtgaaattgtcagtacagtttaaaatgttcttgttaaaattttgtgtgtattgcagttgagtttttaaactttttatttatgaaaagtttcacaactgtatgacagagaaaatagtacaatgaaaactcccatatacctattcctggacaacagttaccaagattttgccatacttactatctcttttttaaaaaatccttttgaaatatgttaaaccaaattctgattatgaagcactgagacgttttaacacattttagtattaataatagttaaacatatatttaaaagaaaaattttaattggacatttgtagaatatctgaagtatgtttgtgaagtataatttgtaaaccagtacccaataataatcatagaagattcatgagaaaggtgtgtgaatgctttaaaaaagctattccaaatcccagctacttgggcagctgagatgggagaattgcttgagccccagagtttgaggctgcagtgagctgtgatcacaccactgcactccagcctgggcaacagagtgagagacccctaaaaaaaaaaaaaaaaaaaaaaaaaaaacaggctggacgcagtggcttatacctgtgaccccagtgctttgggagaccaaggcaggcagattgcttgagcccagtgagaccagcctgggcaacttggctgtcctgtctctacataaaaaataaattaaaataaaaattagccaagcttagtggctcatgactgtggtcccggttacttgggaggctgaggtgggaggatcacttgagcctggggaagtcaaggctgcagtgagccatgatcaggccactgcactccagcctgggtaacagagacactgtgtcaagaaaaacaaaaataaaaactatagctatgatattccagtggtacttgactctgatcctggattaggattaggaagtaggattagagggtcatcttttaatttcctttaaaatcatgagatattataaccaattcactgagtttttctgtgctactcttgtttcagatatctacgttaggaaatcactttttgctttaacgaaattacctcattcacaccttcctaatatttgcagcacttatcctagtaagaccacaattaaaaaggatttttatttttcacaagtgatttagagaattcctggtccgacttagagacagaggttctaaagaaaaaataactttattgttttacaatttgtgtcttagtaaaataagggctatttgttttaaagccatttccatatctggtttttcaaattagctttcttatttggttcttttagtttttaggtctacagagagatgattctgagctggtcacagtagattttttaaatttatttttgaaacagtctttttaaattctgttctgtggatacatggctttttttttttcttcttttttttttctttgagacagagtctaggctggaatgcagtggcgcaatctcggctcactgcagcctccatctcccgggttcaagtgattctcctgcctcagcctcctgagtgactgggactacaggcgtgtgccaccatgtctagctaatttttgtatttttagtagagatggggtttcaccatgttggccaggatggtctcaatctcttgacctcatgatgtgcccgtcttggcctcccaagatacttatgtttttaacattcaaagattcagatctgttcactgcataaagttctgaccctgaagctgtcaggctgtgcttaggaactgtctcagcaccaatctgcctccctgcaccatagctgttggtttctaaatactcctccagaccagttttaccctacagaatgttaacatcacataataatacattgcagcagactcttgctctatttatcctttttctaaatagctcttttggtgtacttactattcgtatcacttggataatgcacatacacaacttgggataggaaaattcattttagggtgttgtgccagctcttctctttcaggctgtgctgccatccttcctgaactttagagatgcttaataaaagcaaagagggaagaacttgctatttgtttatatgaattcaggtaagagaggatacttaccagtgacagataattctttaatagatggtttttgtgtttcattttagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgtgagtgacagtgggcgctgggtgtcgtgctctgtgtcttgtctgttgagtttggcagccagctacttttggctttggtgaactgaatttacctttgaggtgcaccgaggttcatacaaagcttataatgttatcctgcagtcttcactgtttggcttaactgttgtgtggaatcagaaataccagaggtttccttttcagattgttgtcttttttctgaatccttagcttaatcagctaagctcttttcccttgaccctagagacttttttatgtttaaaaaaaatagaccagtcacggtggctcacacctgtaatcccagcactttgggaggccgaggcaggtggatcacttgaggtccagagtttgagaccagtctgaccaacatggtgaaacctgtctctactaaaaatgcaaaaattagctgggcgtggtggtgcacacctgtagtcccagccacccgggaggctgagacatgagaattgcttgaacccaggaggcagaggttgcagtgagccgagatcacgccgctgctctccagcctgggtgacagcaagactccatctcaaaaaaaaaaaaagaatggcatgagatagacaggtagagatttgatggttttcagaaatcctggctggactgttaggagtcgtgttatagacaattcaaatgtcactgctggccaccgtcttcatactctatggataaaacagaaattccagtcctgtaacttacctctgtagcgtcaataacgtgggaaatgatccaaaagggtcttgtagaaagaagactttttacataaacagaaagctgtgatttttgtgggaaacaaacctaccactaaaattgatgagaattcttgtctccatgtgtaatttctggctcatcagccaggaggtaaaatttcaataagaatcaagaatattttaaatgatcagttaaaactgagtaaattagttggtttagtcaatcccccatctctcctgggaaattatctgacttttgcaaggtccttggtgttttcagtgtaattacctaaggtcctattccatatcaagtttcagtttaactttgctacaggattactttatcacaaaacttgagtagatgataatacaatcatacatcacttagccacagggtaagccacagggaaatgcatccttaggtgattttgttgtgtgaacatcgtcaagtgaacttactcaaacctaggtggtgaaacctactacacacctaggctatatggtacagcctgttactcctaggctacaaccctgtacagcacattattgtactgaataggtgctaggtgtggtggcttacacctgtaatcccaacactttgggaggccaaggtgggaggatcccttgaggccaggagttcaagaccagcctgggcaacatagtgagacacccccccacacacaccgattccctgtctcttaaaaaaattttttttaattagctgggagtggtggtgcatgcctgtagacccagctactcaggaggttgaggcaggaggattgcttgagcccaggaggttgaggttgctgtgagccatgattatgccattgtactccagcctggctggcagagcaagaccctgtctttaaaaaaaaaaaaaaaaaaaaactactataggcagtgtaacacaatggtaagtatttgtgtatctaaacatatctaagcatagaaaaggtacagtaaaaatatagtataaaagataaaaaataatacacctgtatagggcccttaccatgaatggagcttgcagaactggaagttgctctgagtgagtcagtgagtggtgagtgaatgagaaggccttggacattactgtacactactgtagcttctataaacacggtacacttcagctatgctaaatttatttaagtttttttccttcaataatagattaagtttagcttactgtaacttttactttatcaacttttaaattttttaagaagttttgactcttgtaataaaacttagcttaaaacacaaacacatggtacagctatacaaaaatattttctttatatacctattccataagttttctttgtgtaaaattatttatttgtttactttttaaaatttttgttaaaaactaagacacagacacacacattacctaggcctacccattacctaggcctactcaggatcgtcaggacatcactagacaatagtttttcagttccattataaccctacgggaccaccatcgtatgcatgactgaaatgtcattacatggcacctgactgtatatccttttgtggccctaaaaagggccacattttactaaaaagtttgagtaaaatgtagatataaagaaggaccaatgagatgcaggatgaaatatgggagtatgagaagcactgtgtttgtacttgtcactgtagatcagttggggaaatgcttctcagcattgctatgacttaaagaaaaactccagatatcatggtgacttacagcagaaaggaagacgcccagaggtttaaagagcagaaggatcaacttcagtaccaagaaagtagagagatataggaaccagttcctcagcagccccggaatggctaaggggagtgaaatgtcattagtagctctcgatctgttctttgattatatataagcagttaaatggttgttggaaaatattattgattgggtgccctcttttgtggcttttaaggttggttactcctctctagacagcacttagggtatgtactgggcacgtcactgcctaggtacttcctcccctaaatgtgggatgcttctgcatactgaagttgataaggagtcatttgtgagtctttgagttgcatgcaaccaatgcattaaataagatgaaatctgggccaaagaaagggtaatttattctacactttatattcggcagcaagaagcaccgtctctcgagtcctgccaccctcacccagtagcctttttcccctattctgtttttgttgaatgaacttcttgatctaatacacttaatagggctttttttaaggccttatgcaatcaaaaatcttgtcgtcttgttctttttagaagaaaggagtgctagacctcttggaagtttatttttcatctgtaaatttgaatttgtggcatttctgagtgtttctaccagtctcctttgtagttgaggtctgttcatcattcactcactggtgataacattcatgaatacgacatttttaatttgtatctcacctcatagaaagaattgtgcagcttttacatctgccagactagagttgaatattccagtctttacatgatttttttctccatctgtctgtctctttcctgtctctaattttgttggtgcatcaggactactgaacaagtgaaatttctctgttttctgttgtaagtactcctgctgtttctttagtccctgggaccgttggcagtttcctctctcccctcccccagccatctctccatagcatgtttgcttctaattctgagtttgatcttctgatgatttttttgcatttcatcagtcacttcatgagtcagcttagccttgcagttgtccatacctaagggagtggggcttggcctttacaccttaggtgctagagcttgcactccctggcttggcaggtgtcacgtggcgctttgacaataccaaaagctggcttggccccaagatcatcacagcagtggtttgagggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaacttatgtgcttgtctttgtattttttctcacaaaagaaaaaaagttgcaaataattttttctctttttttggtcacagtggtgtttttcctggaaattctaagtttattagaacagaatctgaattagtcctgtgatcacaagttgtgtgctaatctacaaataacagatggttcaagcttccccagtttcaggctttgtgcagcgtgtgacattcatcttccatcttactacttaataggaatggtaacagtttactcacatatttttacttttatactttttattgatgacagttcttctctgtgagcacacaagtctaactggaactgttttatgagacgtctatggcttttagtgcaataaagaatttttaaagaatttggtccagcgtgatgatttttctaatgaatgtcaaagccaagcgagtgaggctcagaggaactgaatgtctccagctgctaaggctctactgtctgcaaagcttttggtggcgtgtaattaaaaaccatagacatcagagtgctactgtttgacaactcatagaagcaagctgagggggtcttttcagagaatgagccccgcttgtaggtctttgcttaccccgtctctctggagaaaactcagaggcataaaaggtgtccctgcctctctcctgcggcgatgtatgatttgtgtggtgctgtatgctttggcttctatccgcacacactgctgtctgctccatttcataccttgacaattgtcagtgtgattgcaaactggcttgtttgtgtttcttctctttccaggagtggctgtaaggtgaagaagcatgaaactcagtctctcgccctggatgcatgttctcgggtgagtctgtgcccatctccagaatgtctctgagaccaggggtcctccagtgggagtttgcatccccctggcgggtggttcaaaaggactttccaatgggtacctgagtactcagctttaagaagccaatttccagatccttactgtccctgaagagaaggcccctgaagacaagggaaccctttcacaatgactcttttttttttttggtaaaattcccactttaaatgctacaaagatgcatcaccacagggtgtgaaagtctccagggcaccgaagggaagatctgaaatactggtgtaggttctaataagataattgactctaataactggatggtatttttcttaagtcagatggttttctaattcattgctttcaacaatagaggaaaacctgagttgtcagctgataggtctaaaaataatgtttgatggtagatttttttgggcacataacttggaaaggggttcaaagaattgaaaggcacttatgttacagaactactttctgtttcatctattgtttatataaataaggtttcttaatgattatattgataaaaatagaaaccaggaataaaattgatgttgacctttgttacattctagcaataaataatatccatccatgaccgtataaactaattgcaaaacaaagcgaagcccaggcccatctgattgcaatgagatccttttgttctttttaaaactttctcagtatacttattacagaaatacattcattggttaatagagttcaatttaacataacttttcctctacaatttggatcagaaacttggtatatggtgtaagatgtaaaaaaggggtgtgatgggggaaatttacaatctgagttatttttcatctgttaacaaatgtgtaacattctccctcagattttgctaaagtaggcagcaagaactatgagaaatttatctttggttttctttaaaaaacaaaaacaaaaacccaaaacccatatatttagtgcactgtaaaagtttttaagaattagtgcaataaaacattttgtaattgatataacaacttacttttgtgtctgataatacttatcaaaacttgcaatattttgaaaataagttgtgcattaataaatgtgataagtctccagcagaaaaaattttaagacttaaagaaaaaagtttcacagagacattggatagagacttttaaaaagactttcaaccatgcagatgtttttcatttggatagtttcttgatggaagtgggatggaaatacagatttagagaggaaaaggaataacataaatttctgacttattcaggaacttgttcatttaaatttacatatggtatcaaatcactaaggtaactagatagcattaagtaaattcaatatttagaatattccagatattacattctttgcaattatttaaacttatgccaaaaagtttttagatgtcacttgaaaatgcaatgggggacatagattttcaaaaaaaaattaggtatatgagcaaaaaaattgaaaaccattgtcttaaaccactgaaactgcttgcttataaacttaacctagagaagatcattttttaaaacctcagactcaagttacagaaactaggttctataaaacagcatctcacaattgaaagactccaacttcctccttgctttgtacccaggtctgtggttaacctctcacatatctgtatggagttgtgtctactttgttccattcatgggatgtcacttttccccattgcttgccctcctaaagggtagcatcttctctgttgtgtttctcaggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggtatggaagcatatcttcatctttctaatgtacataagcatggaaatgcctgaaagcctaataaagcaggaggagccttacagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgttgctgtaaaggaatacctgagaatggctaatttataggaaaaagaggtttatttggttcatggttctgcagactgtagaataagcatggcaccagtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatcaaatggcctataaatatgtcatatgtttgacttttttgtgattgttatactcattgtttaacttagagaaataacaactgacatgtatggtgccttaccatgtacaggcattgttttaagtgctttgcatatactcattcatagcaaggtgttacccttttctcacttcttcagagaaacaaagtaagtcaaagaagttaagtgacttgattaaagtcacttggctagggtaggacagaaaagtggtatctttttcctcaccacaaggttcatggctgagacatctctaacaaaagatcaacaagagaaaagtgtacaaatatatttaatataagttttacatgacattagagcctccagaaatgaagacccaaaggaacagggaaaactgtacttttatagatagttgtgcagaagtataattggaggacagaagggtgtgatctgtggtaataaaccaggggaacttagcaagtcctgtttgttccaattcctcttggtgtctgtgtctttcaggataaggacattgtttttctctgtgtacagggaggacccctcttgtaatgaggtcttatgaactattttcaggggaaggtctgaggggttgctttatggcctgcttcaggaaagggggcaggagaggggccgagagacctccctgcttctgctgtgtcctcaaatgcgaaggcaccatattttggtgaagtgtgttctgaacctcatcattagtaaatggtagaactacatttgactctaagcagtctggttccatggtcttttcgccacaatgccaaagtatgaagagattattttcatgatactaggctactgtaaattttcctggtacagatgtggtaagttgagattgaccagtgcactgtaaaatctttcttaacatgccaatgaggaacctgggctaaccagggtggaagcctcttattgatggactcatcagatcattctagagctaagcccctctttcttgggaccccagttacatccttggccttaaactttacttatgaaaagtttagaaccatgttcctgactacattaaacattattaaaaactcagatcttcttaacataattttattcatgggcttttatgtatagaattttaaaagtcatgatctgccattaagccagggaagcagatggaaagtcaggacttggagcaatttattccccctggcctccttctcatcccaggcctcagtctctcatctataaaataatatgccaggcattgttcctgatttcttccaatactgtcttctgccctgacatctttcccaaagatattgttcaccattcccccagtttcttggggttaatcctgagtattcttaacacctgccttggtttttttccatctgaagtgtcttcctttgctgcctcttacacagatctgcacatcccttcaggtctctccagcatgcttttgctcccacatttcctttcccccttcctgttccacagtacctagcgcagtgtgttaattacaggaaggtaatattataaacttactgaggttagagactaccactcatctttgagtcacctttgacacagtacatggtaaacatttattgaattatattcttcctcactagaggaaattccttcaataaaaatttatgtagagagctggggccctgtacatacagtgctgtcttcaaagttagcaaacagcaaggggaacatatttaaacaagtggttacattgtaactgatcagccgcatcacaagcaagtggaggctgcggtcctgggtgtgggaatggctacaggccctgttaggtgaatcctgactgtgtcctggtgagtgtccccttgaagctgggtcctgatggatacttactagatgttctccaggaaatgagattttcacacagccatgggaagaaagctgccacgttggtaaaaggcctggttgctttctgtaagtatctggccaagtgggaaacaaggtcataccgtggaatctgggcttgatcctataggtagggagggggaggttgaaggtttttgaataagggagtgatggtcacatttgtgttttaaataattagctattgacaacaatagtagttagtgattgccatgtggaggattgtaactttaaacttttgtatgcttttctgtatttttatgtttactttaatgagtgcatcttctggttattttattttttatttttcttatttttgagactgagtttcgctcttgttgcccaggctggagtgtggtggcgctatctcaactcactgcaacctccagctcccgggttcaagcgattctcctgcttcagcctcccaagtagctgagattataggcatgcgccaccacgcccagctaatttttgtatttttagtagatgaggcttcgccatgttggctaggctggtctcctgacctcagatgatccacccaccttggcctcccaaagtgctgggattacaggcatgagccactgtgcccagccatcttctggttattttaaatgtcatcctctaccctagtagagtagaggatagacctgagacaaggaagcccatttgaaggggtggaggggagaatgagtttagtttcgctgccttgaattttaaagcttattatcttatctgctgcattaattagatcaaggccacccttctgggctggaatttaaattcactccgacttgatgattaaaaaaaagcattcagtgttacacagtgtcccctttctgaaataatgccacagttagtacgacacatttttccaaacttttaatggacacaagggggcagccttgctgttctttcagcctgaaggctgacgacctgtttgtggctgactaaccatgtgctcctcttctgaatgtcatggacttataacagcactcaacaaaatgccagcgctccttttaaataaaatcttaaaatgcttttcatgtgttcataagtcattctcgcctgcactggggtttccaagagcctttcactagggaggaaaggaaccgacttcttgggataactataaaaatgactttctgtcttaggcatagagaaggagacgtgccagaagatggaagaagacgggtccactgtgcttgtaagttcctgaatgtggagggccgggtggactcaggtttctttcagtatttgttttgaagcccatgtgaatttgttaaattctggtcagtgttaggtgatgaggataaaatgtaaatgagatagtttcttcacttgaggaacacatagtctctgcattgtaaccctagccgcaggtagctgtggagcacttgaactgtagctactcagaaaaagaagaagcataaatgtctcaactttttatattaactacatgttgagatgataatattttggatgtcttgggttaactaaggtttattattatcattattattgttgttattattattattatttgagacagtctcactctgttccccaggctggagtacagtggtgcaatcttggctaactgcaaccttcacctcctgggctcaagtgatccttctaccacagcctcccaagtagctggaactagaggcacgtgccaccgcacccagctagtttttgtattttttgcagaaatggggtcttgccatgttacctaggctggtctcaaactcctgggctcaagcaatctgcccacctccgcctcccaaagtgctgggattacaggcatgagcccctgcacctggctggtttactcagttcttttttttttttttgagacagagtttcactcttgtcacccaggttggagtacagtgacgcaatctcggctcactacaacctccacctactgggttcaagcagttctcctccctcagcctcctcagtagctgggattacaggcatgcgccaccacgcccagctaatttttgtattattagtagagatggggtttcaccatgttggccaagctggtctcaaactcctgacctcaggtgatccacctgccttggcctcctgaagtgctgggattacaggcatgagccactgcgcccagcccatttactcagttcttaaactttaaacttcctaattcccaactgattcatccataaaatgagtagcacccatctgccttatcaaagtggttgtaaggataagatgaaatgacaacgtgaaagatttaagctgtaaagtgctagaatacactagtgtgctagaatacactgttgtgttagaatacactggtgtggtgttgataggaaacacgtggaaaagagagtggaaaggaagagagtgaaaaagaaaaatggcaaacactgtctctgaagccagctggtgaggaacatatcatatgctgtgaccttttaaaagcaactccttttgaacttcccaacataaattaatttctgcttccttagaacattgaataaacattgtataaagaaatttcaccatgcaaaacattgaatgaaaaaatcatctatttaatccatcattcactttttaagtttatctgtgttgctctgaagtccattcttatgtggtcttgtgcccagcagtaggtggtggctggactaaggccagagtacaatcagtggtaggagtcagtctctccttgcttttcagctgttgttccacagcatttttcacgtaagaagttaacttttctttttaagttttaaatgttttaaaaggtgagttcatttggcttttttgggcacgtctctgttagagtacggcaggggctgatactgctctcttgtgattgaggacaaatgagcacagtcagcacactgccacagattagtgatgcgaattctccacagccacgggaatcagtggcatctgtgctcactgtaaatttgcaaccgggagtccattgagttctgttgtctatagactggtctttgttggtcctcaattgtgaatgttttgagggactgggagaagcactggcaaacatgaaataaagcccttttggaaggatatgattgattgatttagcgtcttcattaaagacatattagatggcccaggcctaaaacagatcttctggccaattctctgtgatggtagattctataacaagcttgtccaacttgcttaattttgttgttgttgttctgattggttttgttttaggcttttagcagcctgaagccatagtttttagtttctgtctctagtgataagcggaaaagagggatgaggaaggggctttactgccccaaccagaaacagaaactaagaacccatgactgcattctctcccttggacacccctgtgaaatgttctgcactttttgataagcaacttaaaggactaaggaatgtaaaaagttaaatcctaggagactggaaaagatggctaaagtaggcaagggcatacattcctgccctgacacctgtaagagttgttgcattttgagtagtgaggtttgtaaatgtggccaggcagagaggagagtggctggggagagtcggcaggctgaagagcccactcacctggagacattaaacaccatctaaggtttgatctcctaccgcctgctcaggatgctgcctcttccagaccccacatgtgttagcattgagttgttaagcaggcagactgaattcatttaccctctcaacaaatgaatgagatgctgaactctgtaatggatgttgatgttttcctggctatgaagatttttagggggcgtatttcccatattctcacgaacttggtagccatggaaagcactgagagtctgtttcctaaagttgacttaacctggggactctggcttaaactaagaactcagaagagactgacccatgaaatgttgttaatttagaatcagaagtttaacagtgaggtgaatcaagtctcaacttgacctcctgtattacctccctttaggcaagtaaaagtttcttgataagaaacaaggcacaggaagttagtgagatgattcaaatgtccaggggtgtatcagctatctgctgctgtgtaacacattactccaacacttaaagcaagtgtttattatctcattgtttctgtgcgtcaggaatcttgggcagctttgctgggtgcctctgactcagaatctgttacaggctgtgcaatccaggtgttgatcagggctgcagtcatatccaggcttgacttggggaggatctgcttccaagctcactcatgtggttgttggcaagtctcgggtccccactggctattggcagagacatcggctccttgccacgtgggcctttccctgtagcttctcaaaacatggaagtcagagtttgttcagaacctaacctcagaagtgacatccatgacgtttgccatattctaatgagtcactaggtccagcctacactcaaagggaagagattacagagggaggggattagtactggaggtaggggttactggggggcattttagaggctgcccactgcaagtgccttctggttctagtggtagatttttcccaagagagaaaagagaggttttgtgggtaccttggacttctgttggcatggtgggctgccctcccccaaatgctgctggaacatgggcactgccagcttgtggcttttgtattttgcttttctgtggcctgagacaggtttctattttgggcccatggctgaggtctgtgaagctgcatgctaaaattctgtttctgagcattttctagagagagggtaaaactataatgactctgaaaaatttaaaagccactcatctacgttcaccttggactttctgtttagtgttgattcacacaagatgtaactgattgattataatcagtaactaattgattagttatcccacatttaagattaagattattccaggtcactttggcattttggatgttcccaaagtattagatgactcatttatataaaaagtttacttctggccaggcgcggtggctcacgcctgtaatcccagcactttgggaggccgaggcaggcagattgcaaggtcaggagattgagaccatcctggctaacacggtgaaaccccgtctctactaaaaatacagaaaaattagccgggcgtggtggcgggcacctgtagtcccagctactcgggaggctgaggcaggagaatggcgtgaacccgggaggcggagcttgcagcgagccgagattgcgccactgcactctagcctgggccacagagtgagaccccgtctcaaaaaaaaaaaaaaaagtttacttccgtaggtaggaggaatagccagcaaaaacgtcttttaggaaggaaaatagtacaaagtccatgttctcatgaaaagaaaagtttgccagtgttttgctctggaacctgagcttatgaaagaagctcctcagagcttctgagccagcacctcagagggcgaagtgctgccagaagggagtggaaaacttagtagcaaggaagaaccaacacacaggcatggtccttgacttatgtatggccattttgcatatgggcaacaatggcacacacccagcaggctgggttacagcaggaggtcgctgcggagcagcggaagttcaggatgatcctgaatcatccgggtgaaagggtgggggtgagagttcagagttcaaatatatttgctatttctgccttcttaggcctgaaagttagtattttagaaacatttccatctgcagtggctaaagatacatacaaagcatcaatatgtaacaggagcagctgtcacttgtttttgtttttgcttttttaaaaaagaaattcccatttacatggagcttatccccagaaacttaatcatgggtgtgtttctcttttatccatgtggttctttggtgactgaccgctattataagtacactttctcccttttagatcagaataaaattctctaggttatctgctcaacagaagctaagaccactctgatagtcattataacagtttttctttagttacttccataattagatttgttttttaaaaagcttccccccgctgacttttctttaaacatggttttaaaggatgtgatcaatttagtaatgaggaagttgttgaaggatgtctggggttaagaagctgaaagctgacagattcagtgtaatccctttccccacaggggctgctggagtcctctgcagagaaggcccctgtgtcggtgtcctgtggaggtgagagccccctggatgggatctgcctcagcgaatcagacaagacagccgtgctcaccttaataagagaagaggtaaaagctctcctgtttagtctgcttatcactccatttctttgtaaggcccatgtaccagcaggtagattgcatctctgctggctcaagttatcacaggctggaagttcttattacctgcagcttgtttaggtcgtaaaagggccccctgtggcagtggtgctggagtcctgacattctggtctccagggtaaaatgttgacaatctgaaatattcttaagaattttgtacccttctttatctttcagccctgacatttaaaatacctaattttgccagctttgctcccatgtgtaactaaatcagtgcttttattttacagaggatatatgctaatgcctaaaaacatttgtaatttttttgcagtaatacacagttgtttcctactttcatccattctttaaaccgttcaactctccgattcctgtattgtgtttcttgaacagcctttgttcaaaatagatcactgctaggcctttcctggttatctgaaaaatacgaaagacactgttgtgtaccattaataagttgcccaccctctcctgtcatatatctatgctgtattttgtgtgtttgttttgtgtgtttcttgacaattccacctgttcttaaaggaaggtgtggcaattttatttttatagtttttagttttatagttttttttagttttaatttttatagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatctttttttttttttttttttgagataaaatcttggcgcagtagctcatgcctgtaatcccagtgctttgggaggccaaggcgggcggatcacctgagttcaggaattcgagaccagactgaccaacgtggagaaaccccatctctactaaaaaaaaaaaaaatacaaaattagctgggcgtggtggtgcatgcctgtaatcccagctacttgggaggctgaggtgggagaatcgcttgaacctgggagacgaaggttgtggtgagccgagatcgcaccattgcactccaacctgggcaacaagagcgaaactccatctcagaaaaataaaaataaaataaaagacaagatctcactctgtcacccaggctgagtgcagtggcacaattatagctcattgcagcctcgaactcctagggtcaagcgatcctcttgcctcagctgcctgagtagctgggactgcaagcacgcaccactgtccctggccaaaatcttgtaaatgagaaaaatgacttgatgtttttcctgggagttaaactatgagatcaccacctaatggatcaaagtaaagaggtgcctgattacctgaagcacacaggatacatccttctatgttcttgagatcctaataaatataatgaaactaccaattaggaagagagcggcacggccagggaagtacagtaagaggctgcccatgcaagcccagcccagggcaaatagagtttgaggcaatgaatttagagtatttccttccagttagcaagagcatcccaaatatgagcctaggttccaggctaactagcaagactctacccataagtgacggatgctatagctagatgtagccagctcatctgagccccctccttctgactccatttctatgaagctgtcagaaatctctatagaaagagaatgtgttgctcatgccaacttccagtggtctgactttgtggcagtttcactctggtggcctggcatcagccgtgattacatggccttagttaagagtgaatacctgccaatcagatggctctgttcttggtgtctgtcccagtcagggcctggccctgcagagctgagagctagaccctggaccaaggtaaagttcacagaggctgtaaatactacttgggatttctgagagatgttctactcatctttattcccgtgtctgcatcccagcattcagtgtggcttagaatacacttttccaaatggttacaaacatttaatattgaagtttatatttctaatatagattgaacatcttgggttagacctggttgtgtgctatttcagttcccagtcttaaatgcaaattgtaatagattgggtaaaactaagctttattgtactctagataattactaaagagattgaagcaaatgaatggaagaagaaatacgaagagacccggcaagaagttttggagatgaggttagactggaggttttggggaggggctggatacttttatgcactgttagatttgatacagatgaagtgatgacagtgtttgcttgccacagaaccaagtgttgagagcttgagggctttgctgtttgcaccttgctttgtgattgagaatgttatttcaggagttattgctaaccagttattatattcaaatactgtagtttatcttgggttgttcagaacatataacatgtaaacagaacccacataattcttatcttcttagaactgacagaaatttgtatcaaaatatccatttggaatacagaaaaataagatttatccaatgatagagacactgaaattcataatactacttttttttttttgaggcagggtctcactctgtcatccaggctggagtgcagtggtgtgatcatggctcactgcagcctcaacctcctgggatcaactgatcctctcccctctgcctcccaagtagctgggaccacaggcatgtgccaccatgcctgcataattttttttagagatgaggtctcgctctgttgcccaggctggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaaatgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaagataacgagagccccaaagcagataaatggattacatacattgtcagtgtatgttaatgtgtttaattgtttgggacagcatttctccaactttcattgtctgaaaatcctcctctggtaataagttctttttttctcatttaggaaaattgtagctgaatatgaaaagactattgctcaaatgattggtaaggagaacattttgttttttgagggtatgagccataggatctgtcttagtctgttcagcctggtataacaaaatatgtaagctaggtagcttataaacaacaaacatttttcatagctctggagacaggagagttcaaggtgcccacagatgagatgtctggggagggcccattcctcatagaaggggctggctagctctctggggtctcttttataaggacactaatcctgacataatcacctcccaaattcccttccatgcccactttcaccctgaacatactcacacactggggattaggtttcaatacacaaatttggggttggggggtggcataaactataagaccatagccggatccatttatgattttcagaccatgtcacaaacttgtatttgtctgtcacttagatacagtcgtctcattattcgtgggaggtatgttctgtaaagttgctgcaaacactgagttagtgaatactaaacactgctcctggcctggcatggtgtctcacgcctgtaatcccagcactttgggaggcttgggtaggtggatcacctgaggttgagagttcgaaaacagcctgaccaacatggagaaaccccgtctctactaataatacaaaattagctgggcgtggtggtgcatgcctgtaatcccagctactcgggaggctgaggcaggagaatcgcttgaacctgggaggcggaagttatggtgagccgagatcgtgccactgcactccagcctgggcaatgagcaaaattccatctcaaaaaataaataagtaaataaacactgctcctagggaaaagacagagttagagtcttgcatctggccacaacattttcattgattgatcagtatataaccttgttttacgtgtgttcctgtttaaagacaccttatttaatatatatagttgattcattaacattgagctcacagtcagcggcactttggctcacgtctgaacagagcttctgtaatgtatgtattttaaggaaccttactgccttcttgtgcttggtatcactagacagcactgtggcactgcccttggaggccacttaaaacagtgaagtctccggcaaaaagaacacaagtgcaacaaacatggcctgaatagaccaaaagaagaacacttgtttatagaatgaatcaagaaggcagagtattgctttgttcactgtcagctgagagcgtgcatatcaggtgactaaagcatttttgcactctgcacacatccacaaatgactgtcaaagtccaggaggatagattttaggattacaaataaattttagcaagtaggtgaattgggaggtatggacttggtgaataatgagggtcaactgtagttaggttcattttagaagatggcaggccttgaattctgtgactgttggtggcctggtcacatcactaacacccactgggagcatcctgtgttttggtgcagggttcttactctagtgcagattgtaatttctctgcatcagacccagcggtgcctttacaaaacaacagggattgatcctcctgcatggaatttagagtctcttctcatctatatcataaggattgactccctaaaccagagtctgtcctttctccactaaattgccgaaatgatactttctatcatccacatcacctaatgccttcccagctcagggccttaccacagctgttcttctctatggaatattctcccaggtagctgtatggctcacatcctcatttctgtccggtctatgctcagatctctccctgagagcaggtactctctgtacagtaacagccccctccccgcccccattcctccttaccctgccttgttctttccccatcacttgttaccacgcgtctcccccaactagagtataagccataagagcgggaatttggtcacatccccggctgtgtccctaccacgagaacactgcttgtcttctaaggagtgtctattttttgaataaatatgtcattccttttgacttgtgattcccagaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaaggtagagtgttttttccctctgtctcctggtgtatttccagtagtgtatttccttggtaactggtcatcaaatacatatgccagaggttgtgggtatccttttaaataggagctcagggcctactggccttgtatcctctattccagtgaagctggatttttttccacatttttccttctttggttgttcaggcatctggcccactgggtgccatgtcttggccattcctctcctgtgtcaagccaataagccccaggctgtggcgtagactgcaagaactgttaattgaaccctcagacctcaggtgaattctagaaatgttctttctggtaattcaccttttcagttttagtaaaagggattagaaggaattccatgtctctgaaaaattcaagctgcatattctagaagacattagtataatgtttcaaatttagatgtaaatgggcctgttgatttaatttaactttaccatatcaaccagacacaattatagcaatgaaatggctttattttcatattaaaataaaaatgaaactggccagtttatcaaatatggaaatcgaattgccattcagttttgaataactgccttcctaaagtaggcatattggtataactgacccttactgtatgatattgaaaattaacacatgaagacattatgtagaatttcctcagtgagaattacatgtggctatttcaaattactgcagagtatgaataaaagccatctgaattaattagatttttccattctttaaaaaatgaaaactctgatatgtggtagattagaagaaacaaaatgacctgtttattttcaatttttgctttggaacagaatgaagaagccttgaagaaatgtgctcaggattacttagccagagttaaacaagaggagcagcgataccaggccctgaaaatccacgcagaagagaaactggacaagtaagagcttgtaaatgttgaatttcactcttcatgatgttgtgggaagattgagagaggaaaacaaaatcactgtttcgcaactccaggttgtatttttatgtgtgtgtttatttcactttttaaacccttttcccattgttaaaacattaaaaagtaaaaaaaggtatatctgctcctgcctccttccactgggttcccatctttctctatgccaggtaatcaccattgttggtttctgttttttcttcctattacaatttttttcttttttatatgattatagcatacttcgctatttttgcttagcaatataattttgagaatctttccatgtcagtgcaagaagagcttcctcttttttttctaatagccacatggtattccattgttggaatgtatcatttatttaacaatcccctcctgttagacattaaagttaattcaaatgtcttgctgccacagacagtgctgtaataagtgacctggtaggtgatcgttttgcatgcctgtgagttatctttatgatctgtatgttagaaaaggaattgctagaccaaagcatatatgaatttataattataagtgttgtcagattggccccattagacttttatcatttgatagccctagataatatatgagagcatctcttttttctacaactgtgccaataggtcaacgtttttattttctgcaaatcaaataggtgaaaatggtatttcaacataggtatttgtttttggcaagcaacagagcatttatttatttattttattattattattattttttgagacggagtttctctctgtcacccaggctggagtggagcggtgcaatctaggctcactgcaacctcagtctcccgggttcaagtgattctcctgcctcagcctcccaagtagcttggattacaggcacacgccaccacacccggctaattttttgtatttttagtagagacagggtttcaccatgttggccaggctggtctggaactcctgacctcaggtgatccgcccgcctcagcttcccaaagtgctgggattacaggtgtgagccaccgcgcccagccccagagcatttattttaatcaatgtaattttgatttgcatctatcttatgaatgaaattgaatatatttcaccattcatttattaatatatttgctttactatgaattactctattctttgcccattttcctattgtcattttatagattttatatattagggacaccagccctttgtgataagaattttgaataatttttcaagtttatcatttgtcttttgcgtccacctatagtgttttttgatattcagaaatttacttttatgtgctgaaatgtattagtcatttcttttacagcttctggattctttgtcatagtaacaaagatcttccccatgctggatagaaaatattctcccatgttttacttacactttatggcttagtttttttaatccttaaatctaatacatttggagtttatcctggggagtgttatccaacttgattttttgttggttttttttgagacagagtctcactctgtcacccatgctgtagtgcagtggcacagtgtcagctcactgcaacctctgcctcctgggttcaagtgactctcctgcttcagccttccgagcagctgggattacaggcacccgccaccatgcccagctaatttttgtatttttagtagagacggggtttcgccatgttgggcaggctggtctcgaacttctgacctcaagtgatccgcccgcctcggtctcccaaagtgcaggattacaggcatgaaccactgagcctggcctcccaacttgactttttaactaaaaggtaatacatgcttgtacattttgctgcctaaatttctatctgtagaagcagaagttcccctgtccccttcccactcccatagtactgtattagatttcttatgcattcttctccataggttttacagatgcctctatatattatacgtaggtttattgtatatccctctagtcgtttctttgtgtctttataaatactatgattttgaactataaaaaatatttacaatattggaatcacattagacaaatttcctttttcccttaatagcatatcctgaccattttttcatgtcagaacatatagctgaatctaattctttttattaggtcgtggaactatagcatttctttattgatgggcacttagttacaaacttttttacattgaaggtaacactacagcgaacatcctgtgcactcactgttatgccaggtgggagtatttctgtgaatacataactgaaagtggcattgctgcgttggagggcatgtacactttaaattgccctggtgactaccacattgcccgccacaaggcagcgccagttttcagccgcccattggcacatgagcctgcctgtctccttgtatctcggcccacacaggactgtccttgttaatttttgccaattcaatcaattttcaaagcttatcattttaatttacatgcctctgattgctaatgaggctttagcatcctttcatcagtttaatggctgttcatcaactgacatttatggtttttaagaatgcctttcaggccgggcgcggtggctcacgcttgtaatcccagcactttgggaggccgaggcgggtggatcacgaggtcaggagatcgagaccacggtgaaaccccgtctctactaaaaataaaaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccatctcaaaaaaaaaaaaaaaaaaaaaaaaaaagaatgcctttcacatctcattaataaactcattccctgtaggcccgtgtctcacagatgtcagtggttagtatcccaactctagctgtgatcgtctccaaaattatgcagtctgcttttgtactggtctaaaaaaaaaaaaaaaatctaagactgttatagaaaccatttgctagtgagatacaaattttgaagttgtctgtaaattgaatttttataaattaaaatggaattatttaggtcaccgatttttgttttttttctctcatgcagtcaattctttgaggcctgtgcctcacagatgtcagtggttagtatcctgactggctttgactagtggctaatcatgtgctttttgtctctttattacacccaaacaccataaacagagccaatgaagagattgctcaggttcgaacaaaagcaaaggctgagagtgcagctctccatgctggactccgcaaagagcagatgaaggtggagtccctggaaagggccctgcagcagaaggtacagaaagggacctgatctgggtggccacagagacgtttggttttcctcctcagcagtgactcacttaatgacagatctgggtgaaagaggccttggctttctactcagacatttcagtccagctcctttctgaactgatccaggtggaaacaaacaagtcaaaccattaaattttcaagcacatcatgtggaaatcatccacaggcagggtgcagagaggaagttgcattttaactgaagttcagaacagcttcctagttggggtcatgagactgcctttctttctttctttgttttttatgcaatatattaatatgaagccatcttcccccttcattgctttagatcagtggtttgcagttgggggcagttttgccctccaggggatgttaggtgttaggtaatgtctggagatatatttgtttggttgtcaccactgggagatgctgctggtatctagtgcaggaagccagggatgctgttaaacatcctacaatgcacaggacagcctctgacaacacatttacccatcctaaaacatcagcagggctgctttgagaaactgctatagataaatgaaaaccaggactagcaacaatccctgtttctcactaagcaatttttagctttccgtttttatatgtctccggtgtattttctttactgcatttccaattatgtactcatacctgtgccatccattcatcaagagcaggagtttttatcacagggtctgttagcccctagaacggtgctccctgggagattcagactccagcatccctagatatgctaatggattgagtgagacccagatacttatgtttttgacaagtaccccagataattcctctgataacaagaaaattggggaactaagagattcatggacaagtttcagagggctggtgactgtcctcaccctttactcaatttaagcatgattttatgagtacattttttgaggtgtgtagcctttttttctttaaagcatctctgatgtagaaaagttaaaaatcactgaattaggatgtctagggtagggtagatccagacttgggactagttaactctatttgcctttatttcagaatacaaagtggcctgcataattatgtcatttgtctttcagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtt

SEQ ID NO: 35714 - DNA, 8725 bp, Homo sapiens
aatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggtaagctcctgcctctagctctcaggtgggcacccctctcagtctctctctcttttttatttttattttttttgagacagggtctcactctgtcacccaggctggagtacagtgatgcaatgtccgctcactgcagcctctgcctcctgggttcaaacgattctcctgcctcggcctcccaagtagctgggattacaggcgcgtgccaccacgcccagctaatttttgtatttttagtagagacagggtttcgccatcttggccaggctggtctcaaactcctgacctctggtgatccacccgcctcggcctcccaaagtgtagggattacaggtgtgagccaccgcgcccggccagggcacccctctctctacacaggcaagtgggggtcatgcctccctgtttgcacataggcctggagctggggatccagggctcctgagtccagcaacaatcattgctgctcccaggcccacagggcctctgtgtacagttgggcagattactcactgcacaaggataccagccaaagggcaagtgggttagaattcagcttggccctctctcagacctgtgcatttggcctaggcctgcacccactccaaggaagagcacctttttttctgatttgcacgaaggggccaacacaggcagccgggtctcaactgtatgaaggaatcaggcaaaaatagccgctgccacacaaagggcagcgacgccacctgccaggtgcttcgttgccccccccccttttttttttgagacagagtcttgctctgtcacccaggctggagtgcagcggctcactacaatctctgcctgccggattcaagcaattctgttgcctcagcctcctgagtagctgggactacaggtgcacaccaccatgcccagcttattattattattattttgtatttttagtagagccggggtttcaccatgttggccaggctggtcttgaactcctgacctcaagtgatccacctgccccagcctcccaaagttctgggattacaggcgtgagccatcgcgcctggccagttggccatttttccaaggccctgagttactctcccaggacggacaaacctagtggctgcagcagagtgaagtggctgggggcagaagtggagagggcgtccacccataccggcgtgcctgggactgaggggtttcccaggacacagggaaacttcagtgctaaaaccagcacagtccccagcacacaggacaggcggtcacaccctggcccctttagccatctactgacattgacacagggaggagaggtgggctcccccgagcagaccccctgcctgtggctcactgactgtggatgtggagcccatttgcctctctgggtgtcagctcattcacttgtaaggtgaggtgtaactaaggtggttctcagggtcacggtaaggcctccagtggtgcccggggagccccgacaaggggtggctgcacagtgccagcgagcacgagtcccagagcaaagctgctcaccagccagtgcacccagctcccagggcgcttgttcatgcagactcccatgcagaggggctagggcaaggccagccatgactgcatttccgacaagctctggggatgccattgcagccgtccaccaggccccctccaagcagcctcaaggtcaccaggcccagactcccagccggtgcccacagcagtgccacccagaggcctgccccaggcttgctgaactgaggggacagtgtcaggtatcacaggattcttaccgagccagagaaaccataactgtctctccattggcagggtgtgggggagggaggcagacgaagacaaaagcgtggaaattacacggaggcaagaacaccaggccagaaggtggagacccggacctccccagtcctggcctgagtgtcagtgtcttggggatacttcagcatttcctccctgttcttcccccagcctggcccaccctgggctgcagccctgacccttttcatctatcttccccatcggaacaccacggagccccgatatatctccctgccacttatctctgtcacccctcgcccggattctgtgccctctcctgacgagtcccctcccatccactctccaggctgcagcctcgtctctgcctgctgagaccctctgggacagtccctgcaggggtctgttgcctgaagcttaaggccgagatcttaaccaggctcacccggcctcccgacctgggcccacgcctgtggcctcctccatctccccgcccatgcccgtgtggcagccttgcccggggcctggttttttgagatgagctcacttgcctctagtcaccaattcttgctgcccttactgccagggggtgcccccagcccacgcttcatctagccaagtgttacacatccttccaggaccacactgcagaccaggtgaggggcccccgcgggggcatccacagcacacgtcacacttactgggatcatagtgggctctgcaagagagggaccccgcctgccacacagcccaggttgggctgaagggtgaatgggcaggccagtccctggggcctcgggccatctggctcccgtgcctcacccctccgcttctgtctgctgcaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccaggtatccccagtgatgatgacttggaggttcccgggggctcacctgggttcaggtgagatgcaggttatagagaggacactagggaatcctccattccgtccagagggaaccagaggggctgatcaaaccagcagtcacaggggccgttgtgaggtcagtggccttggacgcaggtcagtcttccagagggtcctggctgcttttcctcacattctttacactgtgagcccctggaagctcatgctcatcctgggggccccatggaagccagatgtacccccgactggattcaggcacccagctcctgcccggctctgtcagctcctgtaggggctggagtgttggtggactgagtcccagaaggacatgtggggcgggggaatcccattatctgccctggaaacattctgcctgtgctcccaggggtccctaggcctgctgcccccataggccagcacccccaaactgcagacaccctctgcagggcgggtcagcacggggcctccgttcccctcctatccttccctcagggtcttgccacctccactcccagtgctggagaactcagggcttctctgcccctgttctgtctatggagtgaagggctgagacccctaaaacaaggaaaggcgagtttggcctccttgcggggtagggggggctgtatgtatcttccactcctccctcatggaggtgcccctcatggagaggccaggggaccttgaagccctgaaatacaagctcagcaggggagacccaggacagcatatggggcctggaggtgtgggcggtgggtgctgcaggccccagcctcgccctcgctggtctctgcctgcaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggtagggcctgctgtccccttccactgaggctgagacccacagcacagccagctcccaggaggggcaaatcccctaagacgaaacagtcaggtttcaaagacatgcaaattggattcctattaatttagcaagagcaaacacttttttttttttttttttttttttttttttttgagatggagtctcgctctgttgcccaggctggagtgcagtggcacaatctcggctcactgcaacctccgcctcctgagttcaagtgattctcctgtctcagccttctgagtagctgggattacaggtacctgccaccatgcccggctgatttttgtattttttagtagagacagagtttcaccatgttggccaggctggtttttaaacttccggtgtcaagtgatccgcccgcctcagcctcccaaagtgctgggattaccacacccggcctatgagcaaacattttcaatggtgctgaaggcctgcggatcaagttctgatgggactgctccacccacacttggccagtgatggtggcgggtgcttgggcaggttcaagagctcggctgggctcgttccctccggcccagaaactccactccagggagtttatcccattgaaacaatttctcctcaaaagaaaagtctgcaggaagatttccactgacacagcagttgcgattctggaaaaaaaagaaacaatccataaactatttagcagcagggatagtcacacaattacagtatgtgaacctgatgttgcagggatagtcacacaattacaatatgtgaacctgatgttgcagggatagtcacacaattacagtatgtgaacctgatgttgcagggatagtcacacaattacagtatgtgaaactgatgttgcagggatagtcacacaattactatacatgaatgtgatgtcgctgaagcagccggtaagctttataagcatgaaggctaagtttatggcctgacattgcaatcacaaatccagcccatgctggaatatcctccgtggttcgctggtgaaggacctgtaagcagatggacccacacggccggggcggagaacaaagggctgagtcgcgctgtgggactcctgggtgcagtcgtcacgcccccagccctgccatctgctgtgtccacaggatcaggccccatcatgctggatgaggtccagtgcacgggaaccgaggcctcactggccgactgcaagtccctgggctggctgaagagcaactgcaggcacgagagagacgctggtgtggtctgcaccaatggtgagcgggggcgcacctccctgcggaggccccagtgtgccctggggtcccgtggcccctgcccctcccagcaccacccccccacgcacatgaagcacacaaaggttccttccactaccgcctgcccactccgcatggagaggcccagacgtcccaagagcccaccagctcccagtcccacagtcccagactcctccccagccccttctggagaaacacccagaaccaccaagtctccatgcagaacccgagtgtggggcagtgagccacagtttcagtgagcatgacacctggctccagcctgacctgaaatgccagcgtccgctcagaaatacacttcacagcacgcgacaggctcaagcccgtcctggcggagggagtcccggctactcgcagcctcagcctgcttcccccaacctggcccagtttggagggaacccaggctgctctgcaggttggagcctctggatctgagtttcttgtttttctttcatgccgaggtggctcttcctgggcttgcacgtgacaacctgggcatttcctgcccactgccctttgccaggagttggaggcccctaaggcaggacgggtcgaatcccagggagcccctgtgcccacatgggatggacaagtggctggagctgagcctggactcacagtgggggaagcccaggagacgccatggggctgtcgggggccaggggaggcggcggggagcacacggggccatgggcgcacggccaaagctcctggggcaggagagctgtggtaaggcgtgcaggtgggagggagctgggggtcctgcggtggctcaggttttaggaggcccagggcaagcccacctggttgaaaggtcacagttacttcaaaactactatatttgtggcgaagaaaaacctatgggatttcattttgagttaggctttgagaggggctcaaagaaggggagagggtgcaccacactgacccccgagccgggagcctcccatgacttctgcaggccttctccccgacaggaagctgctcgaggacccccggagttctaaaatggggttgccacaggaccctaacttttcaggccatctaagcaggcagtggttttggtgttagtggtgattggtgaccaaggctggggagtgggggctccggagtcagtaccaccaagtctccatgcggagctgctgcctgagtcgggggagcagcacagagcagagggcctaaagcgggggcctggacaggcttggccaggtcctagctgctcttgttccccagggctggaaggggcggggcctcagggtccaggaatccgacacttccggtctctcttgtccctcgtcttcccaggagccttccagagtgaatgaggcagccacaaatccctcactttcagatgaagacactgaccccagagagtggcagtgccccggctcctaacgcagcccacttccctcccgccccttcttagaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacactgtgtgcactcaggtggctgtgttggacagttgggcccagggctcccctgctgtcctgtggggccggcatctgctctccttctttctccccaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttccta

SEQ ID NO: 35715 - DNA, 2629 bp, Homo sapiens
cggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgattcatcctacctcctgccttctgagacagttcttttttttttttttttttttttttttacttctgagacagttctgaaacaggtgtccgttgtgtaaagcctggaggtttgggaaatccaattagagtggcaaagtctgaaggtggttcgcgtaagcgaacccagcagctacatgggaggctgaagcaggagaatcccttgaacctaggaggcggagtttgcagggagctgagatcgtgccactgcactccggcctgggcaacagagcgagactctggtctcaaaacaaaacaaaacagcaacaacaaaacatgggcatctggcagctactagttgcataatgaagagactgacagctttctctattccccaccaataccttttctcgactgttttatcattggttgttgatgtagatatattacaatgttgtgtcctctgttgtttgctgtatctttaacaagggcttattctgattcttcaatactggccatgcgcggtggctcacgcctgtaatcccagcactttgggaggccaaggtgggtggatcgccggaggtcaggagttcaagaccagcctcgtcaacatggcgaaacactatctctactaaaagtacaaaaagtagccgggcgtggtggcgggcgcctgtaatcccagctactcgggaggctgcggtgggagaatctaggaggttgaacccaggaggaggaggttgcagtgagccaagatccagccattgcactgcagcctgggcaacaggagtgaaactccgtctcaaaaaaaaatagtaataatatacttgatcttagccaaaaggccgagaagtgatgaaaaaagttattattattattattattattacatcacctagcccatataggactggccttgtagaaacttaacctagactcttgaatttgttgagtctttgagcggcactcccatccttgtacaatgcaattagaagccaaacagtaaaggtttctcagcctcagcactgttgacatttggggctgggtaattcttgttggggggctatcttgtgcattgtgaaatgtttagccatatccttggcctgtacccactaggtggcagtagtacctgcgcaaccccactcccgcttccccctcccccgcccccatcacagtgtctcccgatactacccagtgtgccctgaaggggcaaaatcaccctgggttggagaccgttgccctaaagtaatgcttttcaaaggtaataggcaagataattcagggtgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaattt

SEQ ID NO: 35716 - DNA, 45120 bp, Homo sapiens
ctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaaggtgcggcattgggcgacgtggggccgggagggaagacggcaggcttaggcgaggggaggctcgggttcgggggagtcgggccggcggaggcctgggagttgttctggcctcccgggagcgcaaaggacgtgcggtggagcccgccccctcaccccgctggttgcctgtcgcggggcggggcgggtcaccaacgcctgggaaccccaagaagggctgcgaggctttggcggatgtggtgacacctgagctggggcggttgtcaacgtcctataccagttttggtctcagatacattgaaccgtaatttggttctccaaataaatgttggggtgttgaatatttatacggattggcatcataagataccgcgatacctgcaggaaagtaaaggagacagagctaaccgtgattaataaaatgttatttattgagcatctgctgtgtcagttactgtgctactttgcatatattaccatttggttcatgcactaccctatgaagtaggtaggtactgttagccccattttacaaatgaggaaactgagactcagaggtaggataaactagtaagtgtcacagatggaatagattcttttttttttttcaaaattattattatactttaagttctagggtacatgcgcacaactttcaggtttgttacatatgtatacatgtgccgtgttggtgtgctgcacccattaactcgtcatttacattaggtatgtctcctaatgctatccctcccacctccccccaccccacgacaggccccggtgtgtgatgttccccaccctgtgtccaagtgttctcattgttcaattcccacctatgagtgagaacatgcggtgtttggttttctgtccttgcgatggaatagattcttacttagtttggtagttaagtatgttgagggaaaagcgctgcaaccttattccttccttgttttaaatttgtaatttctgtagttgattaaagtcgattattggttacaaaatggtctcagtctctagtcctttttctttggtatgccagaatctggacttggctcttttatgtaaataccaactatgctcttggatggtgacaactactgccataataccagtttgattctgttttgtagctaagagtagcctggcctggtctttgagacattaatataatttgatatctgtcagtatttggttgcattttaggtaattttattcattcacaataagcaaagtgtctttttttttctttgtaacacaatggggcttttgttatactaaatagaaacatttttactttttttttttttttttttttttttgagacggagtcttgctctgtcgtccaggctggagtgctgtggcgcgatctcggctcactgcagcctctgcctcccggtttcaagcaattctcctgcctcagccttccgagtagctaggactacaggcgccagccaccacacccagctaatttttgtattttagtagagatgacggttcaccatgttggccaggatggtcttgatctcttgacctcgtgatctgcccgcctcggcctcccaaagtgctgggattacagccgtaagccaccgcgcctggcctcgtttttactttttaaaagggtttcagatataataagaccataacttatgttaaagtagtggaacccagtagtgtggtaatacatgtaatttatttctactttatttgggagagacaaactattttcagggcaattaatctgtgacccatcattttattattctgtttgggtatcaaactctctacccaggaaaatagtgatggcatgattttagaagcttagatatagtgtttccggggtgggagatcatgcttccaactcttcagaggatgttcatggactcagggaatttcagcaatgaaagagaccttgctctcatctcgtgttgctgtctgatttgttcttatattttaaagcccttcagtggctcactattgcttattgatagtttaaatttctcaacatgctttgttgtgctcttcatgatctgtttctgagctatacgtgtggtcacttcccactttgcattctacatggagccaccctggacagtaccctgaactcacttattttctgaactgtttttgtttatgccttgacctacttactagactgttagtatcctcagggtaggaactattttcaggttcatcttttctagaatgccaagcatgttaccttgcttctagtaagtactctataaataacaggaactgtagtttagcatggccttatgggaattacattgaatttagggctgctgaaggcacctcaacagcaggactttaggccgggcttggtgggtcatgcctgtaaccctaactctttgggaggccgaggcgggtggatcacctgaggtcaggagttcaagaccagcctcagcaacatgctaaaatccagtctctactaaaaatacaaaaattagctgggcatggtggcgtgtgcctgtaatcccagctacccgggaggctgaggcaggagaatcactagaacctgggaggcagtggctgcagtgagctgacaccgtgccactgcactccagcctgggcaacagaacaagactcggtctcaaaacaaaacaaaacaaagcaaaacaaaaaccagcaggactttgtgcacacaccctagcactttactatcactcagttgctctcctgtgtctgctctgttcttttgctactaaccagcttaatggaaccacaagggtcctaaacccaaatgccaaataggtaatatcattgaataaattggaccaggtattttaaaaaaaaaagcagtgatgataaatgggagaataattggacgtagtagaaactgttaattaggggtgaccaatacttagttcttgatgagacttgccatgcaagcatgtgggcctttttgccacatctgatttttcccttcccctcccctcccctcttccttcccttccttcctttcttcctccctctctccctccctccctccagtggcaccatcacagctcactgcagccttgacctcctcagggcccaggtgatcctcctacttcaggctcctgagtagctgggattacaggcacatgccaccatatccggctagttttcatatttgtttgtagaaatggagtttcgccatgttacccaggctggtctcgaactcctgggctcaagtgatccgcccatctcggcctcccaaagtgctcggattacaggcatgagccattgcacctagcccacatctgatttttcaaatgaaataggaacaccagattttgatgtgaaagctccagacttttaaatttcatcagccaggtttcagcactgcagagcttgggagctcccggcccacccgagggccatggatctcattgtcctcaccactgctttgccactccattttcctcaataaaatggtttggccccctaaaaattaaaaaaaaaaaatttcaccagccaattcagattggttcgggcattgatttgttttcagtgttatagggaatagtatagtgagttcacctttctacccattactcatattcaccaattatcaggatctttccacacgtgtcatcttaactgcttctgccatatcatttcatgctaaattgtattaaagtaaatcccagatgtcatgtatttcattcctgcctacttcagcatgcatctctttaaaaatataaaccacaatgttacgtggctaatcacgcctcacaaaatgaacaatgatggccaggcgcggtggctcatgcctgtaatcccagcactttgggaggccgaggtgggcgaatcacgaggtcaggagttcgagaccagcctgaccaacacggtgaaaccccgtctctactaaaaatttaaaaaaaaattagctgggcgtggtggcacacatctgtaatcccagctgctctaggctgaggcaggagaatctcttgaacctgggaggcggaagttgcagtgaagtatgattgtgccactgcactcctacctgggctacagagtgagactctgtctccaaaaaaaaaaaaagaacaatgattccttgatacccagtccatatagtatgatcccacttgtctcaaaaatatcttttgaaagttaatttgttgtctctctcaagtgtctaatctagagcagtctcctcttcctctcacctccttttttatccttgcaattgaattgttggagtcaattgctcttaaaagaatgtacagcatttcggagttgtcttttgcttcctagaggtgtcttttaaccagttcttccactatattttttgtaaaaggaatcagctgtaaagatgtaaccagaggttcagcaaaccaccatggcacacgtatacctatgtaacaaacctgcacgttctgcacatgtacccctccagaacttaaagtgtaaaaaaaaaaaaaaagatgtaaccagattcaggtttaatctttctgtcgagggtgtcactgcaggaacacacagtactttttgtgccccttattgctgctgctaagattgataagtggattaaggtgtgtcttagtgtcctattgctgctgtaacaaattaccacagatttatggcctaaaacatcagggatttgtcttaatcgttctgaaggtcagaagtcctaaaatcagggttttggcagagccatgtttcttctggagactttttgggagtggggtggggatcagttttcttgccctttctagcttctagaagccacttgtattctttggctcatatctccttcctccatctttaaagccaggctgggcgcggtggctctcgtctgtaatcccaacgctttgggaggccaaggcgggcaaatcactgaaggttaggagtttgagaccagcctggccaacatggtgaaaccccgtcttcaccaaacatacaaaaattagctgggcatggtggtgcacacctgtagtcccagctactcaggagactgaggcaggggaatcgcttgaacctgggaggcggagattgtagtgagccgagatcgtgccacggcactccagcctgggtgacagagcgagactttgtctcaaaaaaaaaaaaaaaattaaagccagtagcatagtatctttaactctctccctttccttcccttttccatcctctgctttgttcctcaccaccccttcttcctctcttcctccctccttccccggctatcatcatctcatctcattctcttactcacctgcctccctcgttcccttataaggacccttgtgataatcttctccacctcaagacccttaatctgatttaatcacatctgcacaatcccttttgccatgtaagataacacattcgtgggttctagggattaggatgtggacatctttgtgtgtgggaggcatttttttctctacccgggtggtaatagcccaaagccttcattgtaaagtttcccattaacctttcacttaggaatccactgatgactactgtgtgcatttattatgtcattaaggttgtgaaatgatgactttctaattccgttactccttccatatttattagctgaaattattcttaaggaattaatatcatctgattatcctaaaatttatcattcacattggtaggataaatgcagaatttatttcttctaattgataattgtcagagtaaggaattgttgcccttgtcattttcagtgttgtccaagagtttttgggtttttttttaaagtattttactgaactctttttaattgttggcttcaacttttagaatcattgtgttttaggcagttgtttccattctttatgcccaatttgtccctttggttccttcatattggctcctgtattttttcaacataatcctgttaggttttgatagcatccttgttttctggcacaacaaagtgttctaggcttatcttgtatatgtctatcctctgacctcagaacaactgtttctctaaggaattctagttcctttttgtggggattggtatttggagaccacaagctaggtgtcatttttgaaaatgtaatataccatgcaagccacagaacacatttgtgagcagatgcagcccatagcggctttcagtctttttcatggtgtccgttcacttagttccactttttctttttttgttgagatggagtctcgctttcacccaggctgcagtgcggtggtgcaatcttggctcactgcaggctctgctccccggggttcacaccattctcctgcctcagcctcccaagtagctgggactacaggcgcccgccaccacgcccggctaattttttgtattttttgtattttttgtatttcaccgtgttagccaggatggtctcaatcccctgacctcatgatccgcccgcctctgcctcccaaagtgctgggattacaggcatgagccaccacgcccggccgttccactttttcttatattttgacgactgcttcaaggattctccctatgcatcattttagcttctggagtgcaactcctaagtgccagagctccttttcatatggtaggccacattctaggtctcagttcagccaatggattgtcttgtctttggtcatatttccacccctgctttaggcagctgtggtttgatttgaggtaggaggagaactggagactggtgcagaacctggccagctgagcttagcatttggtggttgtgctgaatgaggcagtcttttttttgagatggagttgcgctctttttgcccaggctggagtgcaatggcatgatctcggctcactgcaacctctgcctcccaggttcaagcaattctcctgcctcagcctcccaagtagctgggattataggcgcgtaccactactcccggctaatttttgtatttttagtagagacggggtttcacaatattgtccaggttggtctcaaactcctgacctcaggtgatccgcccgtctcccaaagtgctgggattacaggcgtgagccactgtgcctagcctgaggcagtctttcttataagggtctctgtgaatatagtgccttggttaatctgactgattcaccttctttctgtctaggaacatctcagtatccagtgaatgcacctatgttatcatataccactctgtgttgcagttgtgtatttgcccatctcctgggataaactataagctgcttgaacagagactaggtttcattcatcattgcaatgcttgtctaaaataaggcctggcacatagtaggaccttatcctaaggaattagtgaacagacgagcaagcactgtctttgcctcatctctgatctttccctcttccattctctttatttgcttcctcccactctgactctagctatactgaacaccttacagttctttgaatataatgttctctttacctggatcaatgtttgactttctgtgtcccctatgtgtcccattggcttataacttcttttttccccctcaccaaaagttgtatgaaaagatactgtagtaccattacatcctgttttacatggcacttttcatgtagtgtagtgtttactttgtgaactctttaatgtcttactcatctttgtgtctttagtttaacgtacacattgttgtataactgagttaaacatcttagtcttcttgagaagccttgtggtatggtagagactagatctgaagtaagatagatttggttcagatcccagcagctccaccatttaaaggttatgtgggtcttgcagggattacttaacccttcttctctggtcctgtttctgtaatatgggaatcgtagagctcataaacttgttagaaggactgattgagatgggtgaggtttttattgtgcagggcccattatggtgctccatagatgttagtactcttttctttcctctgtattgaatgaaaattgaattgcttctcagagcccctcatgctatatgtcattgaaataagtagatatggagtattttaatgagaggaattatgagtagtttgtgattctttcattcattcaacaaatatttatgtaatatttagtatgtgtcagacctggctgagaatatggggataaacgggacaaggtcctcaagctcttgtggggaacaaagacaaaaaacaagttaaaataatagaatttcaggtagtgataagcactataatgaaagttcaggcactagggagtagggggtgactgatgggttaaagggtgtttgagtggtcaggggaggcctttctgaagcagagagagataaatggattgaaatgatgggtggtcctctcctgcaaagatttctatttcagacctatattgagatgcattttgtgttaagatctccaaactgagtctattccatacttccctactcatttcataaagtgaggctaaatcaggctaactagtgtcaggtataaagactttgctgcacataattgaagcaggaagtatcaactcgtcatttacagtgaatatagaagtttcctccattacttcaggtccataataaaagcctgttgtagggactcagaaatttgggtaatatttttattattattttgctctggctggagtgcagtggcatgatcatagctcgctgcaacctcgaactcctggcctcaagtgatcctcccacagcactgagattacaggcatgaacccctgcacctggctgaaaatttggatcttataccaagttatgatttctgtccttcccaactagcttatagataagaaagccaaacagatcccttaaagagttcagccttgaatcacaggcctaccacaacttaagcctaaaaattatgaagaagtaacttggcagttgggaaactattggcttataacttcttttttccctcacccaaagctgtatgagaagatactataggccaggcatgaggacagagaggagagggaggaggaaggagaaaaggacagtggtgggggtgggggcgaggaggagaaaagagagagaggcagaggggcgaagaggcaggggagggaggaaggaaggaaaagatggtatatatgctatagttttcagattattttgtttggaattactgtatttcagcttttttattactggtatctgtactgaggtctgttctgtgctgacaaggagaaagaataggatgcttcggctgggcgtggtggctcacgcctgtaatcccagcactttgggaagctgaggtgggtggatcacgaggtcaggagaatgagaccatcctggccaacatggtgaaaccctgtctctactgaaaatacaaaaattagccaggcgtggtagtgtgcacctgtggtcccagctactcaggaggctgaggcaggagaatcgcttgaacctgggaagtggaggttgcagtgagccgagatcacgccactgcactccagcctgggcgacagagtgagactccgtctcaaaaaaaaaaaaaaaaaaaaggaataggatgcatgttgctcagtcatcgaaatgaaccatcctttttatcaataacgatcccatgaacccttacttatgccagactttttctgtagggagaaatatggccctttcagcgtgaatttaacgtgactgttgttcactgggttagaaacaggtcaataaatagatggttcagtacagaaggctaattggtacattgacatttaataatataaatcgaatttctttttgtattatatacaaagttcctagcttttaattataacttgacctttgcgtccttctccataaaagttaaaggatacattgcttcatttaaatctctcttattcagtaaacagttgtctacagccttccctgttttgaactgatctagagaagggggctgcttccagtttgaaattgctacaccatatctttatgctgacttctgaagactgagtctggtttctaggaaagtggaacaaatatataaaggtaacccagtaggggtgcagtgacttctatgctgtttcttgtgtgaattgctgactggtagtttgatcctgagccattgcccccatatgcatatagagcctggcagcctggacagtagagccctctgtgaaatcagccagctggccacagacctgaacttgggctcccaaacaagtctccgacttgagggaggttgatgtcatctgctttatcctgtgctcccaacctcattgttcaacataaaatgtgggaaatcaagggaatagttgttaagaaagaacaagactttgtttgtgctcataatgaaagggtcacgctggaggtttttaccgtaaataactttggaacagtatgaaaaaaaacatttgatctggcttcacccccgcagtagtattgttagggcagcaacgggtctttcgttctcgttcccctcctttcctccctctctttctccccttttcttacccccccactcctcccccaagtcaagcatgacgtattgcctatgttaagttaatgtagcaaatgctgatagaagcaggaagagagcatctatccattatcatgccagtgcctggaaatttgctatttctggttttcagcatttctagaaaaagcctcctagcctccttgatcatattttagcttaagcaatacttatgtactatgttatactatcagtgaactgtactagaaatttgaaagaatttagtgttgccaaatgctgcctgtgggctaagtttgactttgttctgggcaaaatctagatgtgatccttttatttcaggaatatatttgatagactttgtacatgcttttgtttaaaagatcagcttaaattcattttatgcccattaaatgtagcacctaagccgtcagagtttatgtttttcgtttttgagatacagtggtcccttttgaaagtgtttctgaggctgggcatggtggctcacgcctgtaatcccaacactttgggaggctgaggtgggaggatcacaaggtcaggagttcgagaccagcctggccaacatggtgaaaccctgtctctactaaaaatacaaaaattagccgtgcatggtggcgtatgcctgtattcccagctactcgggaggctgaggcaggagaatcgcttgaacctgggaggtggaggttgtggtgagccaagatcatgccactgcactccagcctgggcaacagcgtgagactgtctaaaaaaaaagaaagaaagaaaaagaacatgtttctgatatatttttctatctaaagccatagcatctttaatgagttggtgttctttctgcttttttatatcttaggggaatagaccctttggctcagtattcacttgtgaattcttatgaagagtagagataattatatatgcaacctcaatcctctctctctttccgccatatctaatgttggattcttcatgtagtttattccttattaagttaaaaaccacatacaggaaaagctggcatcatcttggattccttactgtctctctttttatcagctaaaaggatcaaacatctgctttcttaggcattttgtatcctttcattttctaaatcttgctgctgcttccttgagagtgtacctgactacccctttctctctgtttccatgcaatagccatttgggccctaatcatccctggatttagtgaacatagcacaatttatctagtttgccatccattagtactcttaggttagaacatatggttaatgggccagagatggtggcttacgtctgtaatcctagcactttgggaggctgaggcaggcggattgcctgagctcaggagtttgagactagcctggccaacatgacaaaaccccgcctcttctaaaaatacaaaaaaaaaaaaaaaaatatatatatatatatatatatatatatatatatatatatatatattaggccaggtgcagtggctcacgcctgtaatcccagcactttgggaggccgaggtgggtggatcacatggtcaggagttcgagaccagcctggccaacatggtgaaaccctatctctacttaaaaaataaaaaattagccgggcctggtggcgcacacctgtagtcccagctacttggggaggctgaggcaggagaattgcttgaacccggaggtggaggttgcagtgagctctgatcgtgccactgcactccagcctgagcaacagtgcaaatctctgtctcaaaaaaaaaaaaaaaaaaaagccgggcatggtggcatgcatctgtagtcccagctactctggaggctgaggcacaagaattgcttgaacccgggagtcagaggttgcagggagctgagatagtgccacttcactccagcctttacgacagagcaaaactctgtctcaaaaaaaaaaggaagaaaatgtggttaatgacctaaatatttatggagttctgagttatcaccaacagttataacaataatataacacctattgaatgcctgctatgtgacaaacactgttccaggcagtttacctgtataacatttaatcttcacagtagctgggcgtggtggtgtgtccttgtaatcccagctactcaggaggctggcacaagaggatctcttgagcccaggagtacataaccagcctgggcaacacagtgagaccctatctaaaaaaaaaaaatcctcacaataaccttatgatgtatgtacaactgttgtccttattttacaaatgaggtagacaagttaaggaacatgcccaagtgtttacagctggtaaacggcacacctgtgatttgagcacggaccagaaagtctgactctagaaccttccatcttaaaagtactatgttgtatggtctctcagagagagaaaaggctagctattcctgtttccgttctttttttttttttttttttttttttgatacggagtctcactctgtcgcccaggctggagtgcagtggcgagatctcggctcactgcaacctctgcctcccgggttcaagcgattctgctgcctcagctgcctgagtagctgggactacaggcgagtgccaccatgcccggctagtttttgtatatttagtagagacagggtttcaccgtgttaggcaagatggtctcgaactcctgacctcaagtgatctgcctgcctcaacctcccaaagtgctgggattacaggcgtgagccaccgcgcctggcccgtgagttttttgtttgtgtgtttgttttgagacagggtcttgctctgtcacccaggctgaagtgcaatgacatgatcacaactcactgcagccttgacctcctgggatcaggcaatcctcctccctgaggcttctgagtagctgggaccacaggtatgcaccaccacaccaaactaatttttttttttttaattatttttagaggcagggtcttcctgtgttgcccaggctggtctcaaattcctggactcaagtgaccctcccctttcggcctcctaaagtgctggcgttacaaggtgtgagccagtgggcctggtggaccttgtgagttttgaggaccctggccaggtattttgtaggttgccctctattgggcatttgtcagatgtttttctcatgataaggtgaggttatgggttttggggaggaagaccacagagataaaatgtcattttttttttcttgtcaaaaccatgattcacttataaagtgtcattttcatcacatcatatcaacatgatttgtcacgttgatactgcccttgatcatttggatgaattagtgtttgtcaggtttcttcactatacaatattcttttctttccttttttcccccttaatgatgttttggtcagtccactacagagtaactcttttttccccctttctattctgtgttctttagaaggaagtcactttatgtagcccacacttaaggagtggggagttatgcttcacactccttacgggtgcctacataaattatttgagaatcttcacggaagatttgtctctcttccttatttatttatttaatcaatcatttatatgtaagtgtagattcatggatgtttactatgtactttggattataaaccagtactataattgttgccctgattgtttcagctttagctattgggagccctttaggttcctgtgtccctttgacatacccgcattcttgtattttttggattttcatttttgtttgtttgtttgttttgagacagagccttgctttgtcacccaggctggagtgcagtggcataatctcctctcactgcaacctctgcctcctgggttcaagtgattgtcatgcctcagcctcctgagtagctgcaattacaggtgggtgccaccatgcctggctaatttttgtatttttagtagagatggggtttctccatgttggccaggctggtcttgaactcctgaccttaaatgatctgccccccaccccgccccggacctctggtttttgtttttgagcacttcttactttctggcactataagatgctccaggctcattttgtacatttccttcctcagtcttaggatcatttctccaaggagccctggttgcttttattggagaagggaattaagtctgggtggatagtgttatttttaaggcatctttttctggtacctttttttttttttttaaatgcagttgtgctagcaagtggccaaaagtagtcccgtccttcctgcaactttagagtaagggtggaattctgtgagcagcaggagtgggctaggatggggagaaatgtagtgcttaggggcagggcagagaaccaggtctcacctctgcattagatcaggtcattcattgttagggagggtcactaaaagaactcatttgaactgtacttgtatctttagcaagatgatggttgaaaatgaagagtctgttagttacagtccttttacgaggatcttcctgataaattgttgttcgtggttacttccaggaaaattgtcccttagataaatttgtgagctttcatcagaaaacaaatgatgtctctttagtcttttaattttggcttccagaaaacttagaaccaaatttattttacagatatcatttgctcaatttaggttcttgataagacttttttcttccctcaggtgaactctattccattttattcctaattgccttattgacctaagctacttatagatccttttgaagttttattttgaatgtttggtaaaggaatgagagcaggcttcagtggcaggacctgctcaaaaatctgtttccagccactgcctagcacggtccaagaaaatccaattttaaatgagtttatcttcccagttacctgttttcgcacttctcacaggctcagtgtgagtattcacatattcttgacatcacctactctgcatataaaattaacacttttttttccttctctttttttcttgagatggagtctagctttgtcgcctaggctggagtgcagtggcacaatctcgggtcactgcaacctctgcctcccaggttcaagtgattctcctgcctcagcctcctgagcagctgggattacacgcgcctgccaccatgcccggctaattttttatttttagcagagacagggttttgccatgttggtcaggctggtctcaaactcctgacctcaaatgacgtgccaccttagcctcccaaagtgctgggattacaggcatgagccaccgtgcccatcccccctactttttaagttgtgaactttgttttgcttttcttcagaaggtgatatctagaaacaaatctttattacttcctattccttgatgtcatatgggcaaattttatagcttggtattacctttgtttaattaaagaactttattatcactattataagtatttattgttaaaaggaaagaaaagaatccttttaaggtcttgctattatagtaggtaaaagtagcagttattgattcaccaaggtggttctctaggacaatttaagaagaaaaaaaaaacctctcacttcttgagaaaccagatgaccttttaaggtgatctgtaattagaacattttaatgaaaggaaattaagctatcattttatttttttagcctattagactttgctggctctggttagtcattgagtttggcccagtttcctattccctaattttagctacctggtttatgtaatgatattggggttgggagatgtgatttttgttttgttttgtttttctttaagactaatgacttggctcctaaataactacaaagttatatgaactagataggaaacctactgattttcagaaaaatcgtgagatgttttagaatgcccaaacaggccatatgagtgagccccacctgaaagttcagttgtcaggttgcctgcctggatttccaaatatccagataaattccctcatgtagttgtgtcatctgaaggttatagggagtgtagacatgtggaggccttgggcgaacttccagcatcatcacacactatttctgggaggtaaatttcatgttgataaaaggtgcaggctgcagtggcgggccctttgccttcagcctcttgaaatgaatttcagtttttgccttaaaatgagtctttaataatcttcggatgtcatagagagaagagacaatgcaaatggttcttctgtgattgcagttcctcagtacaatgtggtagaggacaatttaaatagtatttacccctttggagtaccagctggagatgtgattttcctgaagtctttcagaaaaacatagcagatttcttaattcattttgtaaggtacttttagcaatgacttaagaattttatgacgtgcatttaagctcctttatgatgtagagagactcctctccttaagttaaaataaaaaaaagtttttgaaggacactgttcatatcttggaggaaaattaagagattataatctcttcttccaggaaataaggtggttgggcaaatgtgtgcaaatcctgcaaacactgttaaattcagttgtttgtcctaggccaatgacttagtctctttccttgccttagcatggagatgatgaaatctgtgatgactcttttcagtactttcaccttgatgcttattccaggctgtcctctaccagtttcacttacatttagacattttcagcaacctgtaattattagccttcttccttcagaattaagccaatgcaatgagcaaatctggaaagttatgttacccaagttcaatgttgtctgcaactttattcttaggaggaaagtccaaatccaaattagggtctctagattggcttggaatgtgaaaaatctgttattcctgctgtctacctttttgaacttcttctttgctcttaaattttgtctttatgctttataaagtgagaatcttggggaagtgagtatctttgtgggtcaactgattctgaagaaaggaagagaggcatcacactgatgactacacattactttgtgatttggttagttctcagacctttttgactgatatgtgtgtatccagggttctaaggtatttatttatttatttatttattttgaaacggaatttcactcttgttgcccaggctagagcgcaatggtgcgatcgcgactcaccacaacctccatctcccgggttcaagtgattctcctgcctcagcctcctcagtagctgggattacaggcatgcgccaccatgcctggctaattttgtatttttagtagagatggggtttctccatgttagtcaggctggtctcgaactcccgacctcaggtgatctgcccgcctcggcctcccaaagtgctgggattacaggcatgagccaccacacccggccctctgaagtactttttggctgggcacggtggctcatgcctgtaatttcagcatttgggaggccaaggtgggaggatcacttgagctcaagagttcgagaccagcctgggcaacatagggagaccctgtctctacaaaaaataagacaattagtcgggtgtagtggtgcacacctgtagtcccagctacgcggaagactgaggcagaaggatggcttgagcctacgaggttgaggctgcagtaagctgtgattgtgcagctgcactccagcctgggcaacagtgaggccccctctcaaaaataaataaaaataaagtagtccttttttatgctgcttctttcagtttatgattcagaaaaattatcacacaaacaagaggcctttaagaatcttcaaggctaaatttcccttgattgtttagctgatgctaacttcaaggtctttaccttgtggctgcctgctgatctctctaaggtggagaatgcagactgatcagtgctgtgttaacacttgagaggactctcaactctgatttgcactgatgcaaagattctattagtctttcttggccactgtacattcctcttttttcagacattccttttgggggaaggcagcatgggatgcagaaagagagtgggttttggacatttctcaaatccacgtaacactatttatttatttttacttctttttttttttgagatggagttttgctcttgtcactcagggtggagtgcagtggtgcgatctcagctcactgcagcctccgcctcccaggttcaagcaattctcctgcctcggcctcctgagtagctgggattacaggcacctgccactacgcccaactaatttttgtatttttagtagagacggggtttcgccacgttggccaggctggtctgaaacacctgacctcaggtgatccacccgcctcggcctcccaaaagtgctgggattacaggtgtgggccactgcacctggctatttattgagacatgttctcactctgttgcccaggctggagtgcagtggcacaatcacagctcactgcagcctcgacctcatgggatcaagcagtcctcccatctcagcctcctgagtagctgggaccacaggcgcatgtcaaccacacccagctaattttattttttgtagagacggcatcccactatattgcccaggctggtctcaaactcctgggctcaagtgatcctcccaccttgaattcccagagtgctggtattacaagtgtgagccactgcacctgaccaacacgatttatttattaactgctataatggacaagttactaagtttcctcatcagtaaaacaggaataacaagaccagtttccatggagttgctgagaagattaaagattatgtttgtaaagtatatagcatgattctttaacccttttatctttccaaaccactcagttgcagaaccccaagctccgatcagttcatgcatgtgccttttcttttcttctgcatcctggctgctaggttgtaccgctagaaatgtgtggttcattatcttagctgagatctcagtgctacccagcagtcattctatgtgatgttagtcagctttctttctgtcctgtggagagggcaaaattgttggcccagaagaacttggttctataggtgtgttttgtttttccttgagatagtttttcttttcttttcttttcttttcttttcttttcttttcttttttttgagacggagtcttgctctgtcaccaggctggaatgcagtggcgtgatctctctcaccctggtttcaaacgattctcctgcctcagcctcccaagtagctgggactacaggcacgcatcaccatgcccaactaatttttgtatttttagtagagacggggtaggatggtctcgatctcttgacctcatgatccacccacctcggcctcccaaagtgctgggattacaggtgtgagccaccgtgcccggcctgagatagtttttcaaatgttgggattggttgtaaagatttaaaaattaagagatttcaaatgaaagttaaaatgtctaccttctcttgaaaaactggatgatctgaaaacctggagtgccatggcagtcattggcttttcctataacacaggccatcttttctagtttgctgtgtatggcttgtgctggtccagtagactcagtatgtttctcacttgatctctgtgggcatttactttttggttttgtcctgtagactctacctccttaaaatccctcaaactcttcagttcatgggttactaaacttttttgtaattacataaaattatttaattaaatacaatttaataaaccttaataaaattaaataaaatttaaaattattttaattaaataaaatctgtcaccttctctctatactgaaggcccttctcctttcttacctggagtactggaatagtgtcccaacccacctccttatctctagggttctctctctatagtctgtcttcatagtactggtagcgtcatctttctgaattgtcattgactcacatcattctgtttcaaattccttattgcccttccactttgtactaaatgaagcttaaactccttagcatgctattctagttctacatgattgggccagtacctctccaggcacttaacctctctgggcctcagtttcctcccatggaacacgggggaaataattcttgccagtagggttatagtgaggattaaatttaaaatgcttataaagcagcaacacattatttgacacttagtaagtattcagtaaatactagctattagtaatatgataatgccatatttttgttttatgtttttctggacccaggccttcatatttgctgtctcttctaccctgaacttctttacccctctttcccttgattgaaattcatcctttaggactcagctcatgtgctaccccctcctagatacactccctgaccctccataatcccatggcacttgtgcatacctctggtagcatgccttgcacattgcagtgaagcgctctctctctgttagctttattgaggtataattggcaaataaaaattgtttatattcaagatatataatgtgatgttttgttatacatacacattgtgaagtgaataccacaatcaagctaattaacatatttcatcaccccatacaaatgtctaacaaatacattaaaagttccccagtatcactaaccatcagggaaatgcaaaccaaaaccactatgaaggcatatcatttcttatcactctcctctcctcatttagactcataagccctttgaagacaggaactatcttactcatacttgtatcccagtgaccagcacaggtctaggtatcttaaatgtttgataaattaggccgggcgtggtggctcacacctgtaatcccagcagtttggaaaagccaaggcaggcggatcacttgaggtcaggagttggagaccagcctggccaacatggtgaaaccccatctctactaaaaacataaaaattagccgggcttgggggtgcatgcctgtagtcccagctacttgggaggctgaggcaggagaatcacttgaatccggaaggcggaggttgcagtgagccgggattgcgccactgccctacaacctgagtgacacagcgagactctgtctcaaaaaaaaaaaaagggccaggtgagatggcttacacttgtaatcccagcactttcagaggccaaggcaggtggatcacgaggtcaggagatcaagaccatcctggctaacacggtgaaaccccgtctctaccaaaaatacaaaaaattagccgggtgtggtggcatgtgcctgtaatcccagccacttgggaggctggggcaggagaatcgcttgaacccgggaggcagaggttgcagtaagccgagatcgcatcactgcactccagcctgggtgacagagcgagactctgtctcaaaaataaataaataaaaataaatttaaaagtttgacaaattagcaaatggtgctggatggcagaagacagttgactaatactactgtttattagggaatttagaagatgtgccataaaactttttttagttaatctgtcatttcaaatttatctagtagtgataacttttctttagttattatcaattttttccaaaataaaataactttattattatttttgaatataagtgatccagtgatacatgcctttttttttttttttttttttttttttttgagacagagtctcgctgtgttgcccaggctggagtgcagtggcacagtctcggctcaccgcaacttctgcctcccgggttcaagcgattatcctgcctcagcctccaaagtagctgggattacaggcgcccaataccactcctggctaatttttttttttttttgtatttttagtaaagacggggtttcaccatgttggccaggctggtctcaaactcctgacctcaggtgatccacctgcctcggcctcccaaagtgctgggattacaggtgcgtgagccactgcacctggcagagctaccacgcccggctacatgtcattttcaaaaaaggccgggtgtggtggctcacgcctgtaaccccagcactttgggaagccgaggcgggttggattatgaggtcaggagatcgagaccatcctggccaacacagggaaaccctgtctttactaaaaatacaaaaaaattagctgggcatggtcgtgggtgcctgtagttccagctactcgggaggctgaggcaggagaatcacctgaacccgggaggcggaggttgcagagagccgagatcacgccactgcactccagcctggggacagagtgagactccatttcaaaaaaaaaaagggaaaaaaaaatagaaagtctcacccctcagaaataactactgttataaagtacttttaaatatataagcttaaatgtgtgctacttaattttcctgcttaaaatttccccttaaaagaattatgttttaacaaatagcattagaacatccagtttaatgtaattaagccactacttttgtgttccacattgcaaagtagcttccagtcttaagtgatgaaatatgctttctactaagacagccacgtgctctagaaatgaaggctaagatccagtctgttaaattaccatggaattcccttgctttgtatgtggctgtttacttagcagtatatgccctttattctgtgctgataggccattctttggtaatagagcagcttaagtctgaagagctaaagctaaggatctagaagaaaggaataatcatttatggaagccaaagatacctttttttttttaggataaatttctctcctttttgtttttgtttttgtttttttgagacagagtcttgctctgtcacccaggctgcagtgacacggcaagcttcccagtacctgggactataggtgcgcaccaccatgcctggctaatttttgtattttttgtagagatgaggtttcgccatgttggtcttgaacactttttttttgagacagaatctcactctgtcatctgggctggagtgcagtggcgcaatcttggctcactgcaacctccgcctcccaggttcaagcgattctcctgcctcagcctcctgagtagctgggactacaggcatatgccactgcgcccagctgattttggtatttttagtagagacgaggtttctccatgttggttggccaggatggtcttgatctcttgacctcgtgatccatccgcctcggcctcccaaagtgctgggattacaggcgtgagccaccgcgcccagccaggtcttgaactcttgagctcaagtgatcctcctgccttggcgttccaaagtttgggattacaggcgtgagccaccatgcctggccagaaacttcttttttgtttcctgtgttttgttcccactctacctggccgttgacataattaacatgaaatttgcaggaatagatctcctggattgtcttctctatgtatgcttttcttcctgctgtccttgtattgtgtgtcctaattttattctccacccacaccccttccccatcaaatttgttttatagaataaatgtgtttttatatatctttgtccctcttgtataatcttttgataattgtctactttcatttttgtgacatgttcctctatgcggaatgatactagtgagtttttgccaataaatccaatgtatgtaacttggagcattagctagattaactttttggtatggtaagacatcctatagcagcaacagattttagcccacagtgtgattaggctatttgaatggatgaaatttgctgtatttggatttaatcttctaatccagtttttgtctttggggatggttggaacatagtcatcataatgagaactatcaattgtctttcatagatagtgtctctatcttcccagtttctgtaagttctcttcctgagtgttatttgctgcctattcttactacttttcttattttagatcacagattctgctggccatattctctactccaaagaggatgcaaccaaggggaaatttgcctttaccactgaagattatgacatgtttgaagtgtgttttgagagcaagggtgagtaatcaagagtgtttctctggattaagaatcttctccaactctaatgctccttaatacagtcagcacttaatatctagtttcatttgtattctttatttattctgatttggagacctgttaccttgtagtctttggagcaccttttaaaaggtcgactacatggaataaaagattgaataggtggaacagagagaatttttagggcagtaaaaatattctgtatgatactgtaatagtggatacatgtcattatatggttgtccgaacattacatttggaatgtacaccaagagtgaatcctaatgtaaactgtggactttggtagatagtgatgtgtccatgtaggttcatcatttgtaatgaatgtaccactctggtgggaaatggtgataatgggggaggctatgcatatgtaagaggaagggggatatgggaaatctttgtgccttcctctcagttttgttgtgaacctaaaactgctctaacaaagtgaagtcttaaaaaaaaggctgggcatggtggctcatgcctgtaatcccagcactttgggaggccaaggcaggcagatcactgaaggttaggagtttgagaccagcctggccaacatggtgaaaccctgtctctactaaaaatacaaaattagctgggcatggtggctcgtgcctgtaaccctagctgctcaggaggctgaggcaggagaatcacttaaacccaggaggtggaggttgcagtgagcaagattgtgtcactgcactccagcctgggtgacagagtgagactccatctcaaaaaaataaacaacaacaacaacaaaaaaaactggccgggcgcagtgactcacgcttgtaatcccagcagttgggaggccgaggcgggcggatcacctgaggccaggagtttgagaccagcctggccaacatggcgaaaccccatctctactaaaaatacaaaaattagccagatgtggtggtggcacatgcctgtaatcccagctactcgggaggctgaggcaggagaattgtttgaacccaggaggcagagattgcagtgagccaagatcgtaccactgcactgcagcctgggtgacagagcgagactctgtctcaaaacaaacaaaaaggattgtctgtttgccaggcaaatgcagagagaaaaattatgaagggtccttttacaaaggagactctttagggctatgatgtcagctaagaggataggctgacagttctatgcaagagactgtatagtctggactcgaccattctgagaaatggtggttaggtgatttcgttgtgcaaatattaagtgtacttacacaaacctagatgttatagcctactacccacctcggctatatggtatagcctactactgctcctaggctacaaagctgtaaagcatgtgactgtactgaatactgtaggcagttagaacacaatgctatttgtgtatctaaacatagaaaagatatagtaaaaatacagtattataataatcttatgggaccaccttcatatatgcagtctgtcctcgactgaactgtcttcatgtagtgcatgactgtactgtgctgtgacaatcagggaggtagttggaagaccttgtaagaaagaagatatcctgatcatttggaccaggtggggctgtgaactgcttaagtttcacaactttttcaatgaggaagtacatcttccatggacaatgtcgtaatcaggattacacattggatttgggagaacagaacactctgggtgccacattttgttttgttttgtttgaagacttgttgttttcatgctcagaagacacatgtgacttgtcttactttgttctcagtcttaccctgtgcagtcttatttatatttctcttgctttcgagttaatctttccagtctatccaaaagaagtcctttttttgtgtgtgtgtgaaacaagagtcttgctctgtcacccaggctggagtgcagtggtgcgatcttggctcactgcaactttaccgggttcaagtgattctcatgcctcagcctccggagtagctggaactacaggcacgcaccactgcgcctggctaatttgtgtatttttagtagagacgggtttcatcatgttggccaagctggtctcgaactcgaacctcaagagatccacctgccttggcctcccaaagtgctgggattacaggcatgagccaccgtgcccatcccaaaagaagttctttactgtctttcaagcatgccatactccgattttaatatctgagcctttgctcatgctttgccgtctgcctagagtactttgcctaagtcctgcctttaggtgttccctttttagtgaagtctgtccacaactacaatcttctctcctcttccctttgctccatattggaattgtctgaaccagttcctttggcttaaacttttacagtgctttgcattttcaccatagttgttttgtgtatatgtcttagatcccaattgaattatttgaaggcagggattgtatcctggcttagtccattttgtgctgctataacagaacatcgcagagtgggtataaacagtagaaatttgtttggttcatggttctggagtctggaaagtccaagatcaaggggccacatctggtgagggcctttttgctgtgtcacaataacatggcagaaggtatcacatggcaagagaatgcacaggagagcaagaaggggctgaactcacttttataacaaacctacttctatgataatgacattaaatctattgatgagggcagagccccatgacctagtcaattcttaaaggtcctacttctccgccaggcacagtggctcatgcctataatcccagcactttgggaggctgaggcaggaggatcgcttgagcccaggagttccagatcagcctggacagtatagcgagaccctgtctctacaaaaaatacaaaaattacctgggtgtggtggctcacgcctgtagtcccagctacttgaaagactgaagtgggaggattgcttgagcccaggagttcgaggctacagtgagccatgatggtgcgtgccactgcactccagcttggaagacaagagtaagaacctgtctcaaaaaattttttttaattaaataaataaaattaaaggttttacctctcaacactgttgcattggggattaagtttccaacacatgaactttgagaggggcacatcgaagccgtagcatatctctttaaaatctccagcacagttttagtacttagtgagttttcaatgagtagttattgaattgacttcagttcatttcagaaaacttccagtgtctctcaggcatcagagggtacagtaccattcagtgtggcttatggtttcaggaaccccagtgcttcagtggcactgtttcccacaacttctaatttcatgcaggcagttgtaaattttataactaggtgaattccaggggattggggctgaacagttttctggggctccttgggtcttttcctttctcctacttgatgatttaagattagaatgcttctttgatccagctgaatcagattgactcttctaacatgaactctattataagaagcatccctgagatttgaacacttaaagttgttttttttttttccttgagctgttgtaactcttttaagggcttagtgggaatagctctatgacattgtactcctactgaactaggccatacattgatcaaaatgtttgaattaaagtggaatattagataaaacttatgttcttttcagtactcagatttatattaagtaaatccaagcttagcacatatccaataatcctaattcatcatggccttccctcaaaatttgacagggcaaccttttcagatgtggaaatacacattttcagccgaagttgttgcctactatctcttgatttatatgccactcaatttcacactgttttgatttttgagttttatttcccaattcaataagcctgtgtggtttcccttctgttctgttcctctgtagtaccagttgcagtatcttgtgtccttgcctgctcagagatgtttgccagcagcatgttcttgttgctttccggcaccccacacagatagaggctttgtctggaatgtttgtgattttagccagagccaggaattttctgcaactgagcagggggaggagttgtggctgtttccctctattgagagggtaggggttctgtagagggagggcgggcgggtgggtgggtaatttcccagaattttaagtatttcacacaatgattcctttgatttctttctcaggaacagggcggatacctgaccaactcgtgatcctagacatgaagcatggagtggaggcgaaaaattacgaagaggtatgtcctgctctaacagccagaggaggcagcagtgtgctatgctgtgaggtttctgtgacctcggcaggccaacaggctgtgctttgcccaaagggctgtggtttcttagcagtcttgtgacagccagccatgatcttactgatacaaaaagtggtattaacagccttagccgggcgcggtggctcactcctgtaatcccagcactttgggaggccaaggcgggtggatcgcctgaggtcaggagttcgataccagcctggtcaacatggtgacaccaagtttctactaaaaatacaaaaattagccaggagtggtggcgtgcgcctgtaatcccagctagtctactcgggaggctgaggcaggagaattgctggaacctggggggcagaggctgcagtgagccgagatcgtgccactgcactccagcctgggcgacagggcaaggctccatctcaaaaaaaaaaaaaaaaaaaaacagccttgaagaataattctggctgtgctgtcagccaaagactgaacaaactgtcccacagaatgttggtttgataaaacactgaagcatatggcattagttctcttgaactgtgtgtgtgtagagagagatattttaaattttttaaagctggaattcagttatttgttaatgcccaaggttaagaaaagtgatttgtttttaattcctaagactttttccccaagaccaacagttgtatatctatctatctatctatctatctatctatctatctggggcatggattcagtgctgtttagtcttgaacaactgttttgtgtttgggaaataacaatagtcaaagatagtttttagttaaaataatttcaaactttcaaggaagagggcaggatggaggaaaaagctgcaagagactaggaatggtgataatagaaatttgatgctgataagaagttatttattatagactaataaaaactgacacttatttgggtgacagggagatggaggtgtacacagaatgaggagaaggacaacagcctttttcatctctgcgagacttgggggcagcacaaaagggttcttcaaatgaagggcacctttgaaaaaccacaagaactatttaagactagataattgatctttacagaaagataagagtatttttacccaacaaaacagtacgtaagggcatgaaggaggagtggggtacaggaaatagaatgggcttttgaagaatgcaaactaagtaaatgaaggaaaattggtttaagtgatttaggaaaattgtctaggaatagtggaacagaagttgctctctctttggacagcactttggaagggaaatatcctaaaatggaagaagattggaaatgactggttaattctgcaacaggaagtagtacaacagttgcagctctttccttgttcaaatcctcaattgaatgaaactaggtagcgttatttagaggcagtaaataggagcaagtgatacagttgtgaatgggagacagtttccggtagagaattttcaattgtttgtttctgtttccaggctagtttaatttaaataaataaaacaagaagacctctttatttgatgaacttgagtaaattgaaaaatttttttaaaccttcatgattcagaagaatcttaattatatttaaataagattatgttaaagtgcttttataagatataaaacactagggagaatgttctcattattataaggtagaagaataggtaaaatgatttccagtttgtggttactgcttctgttcccgaactgtggaccattctcagttgaatttgtactctgtggaattttacctattgtaatctttttctccaacatgatgcctgtcattaagggtatttatttatttatttattgagatggagtctcgcttggttgcccaggctggagtgcagtggcgggatctctgctcactgcaagctccgcctcccgggttcacgccattctcctgcctcagcctcccgagtagctgggactacaggcacccatcaccacgcccagctaattttttgtatttttagtagagacggggtttcaccatgttagccaggatggtctcgatctcctgacctcgtgatctgcctgtcttggcctcccaaagtgctggcggattacatgcgtgaggcaccgcgcccagcccaagggtatttattaaataacaacacatcaatgccctattagacagtagacatagctagttcccctcaaaaacagatgacattattgtgggtttatataaagaatgctttggacacagctgtcgtatagcattttagaacccctatacctcctggaatttccatcatccttggactttatagacattaggaaaggggctttatctttcctgaccttttgcttaacccaagaggggaatccctagcccaaagaaaaccacggtgcttcctttgcctgcttcctgcttcagacgtctgacatgtcctaagcctgcctttacgcatgtagttacaacacagctccaaggttctgcttcttaaccaagaaactcctccccactactttctttaacatctatccccaccctcctgcccttcacccctgctccccagcagcagaccagattgatgtagaggaggaatggctatgacacagtccgaagaccagccctttcttcagtctgcagcaaggctgccttgaaccttgcttagaaatggctgttagctggcagggcacggtggctcacacctgtaatcccagcactttgggaggccaaggtgggtggatcacccaaggtcaggagttggagaccagcctggccaacctggcgaaaaccccatctctactaaaaatacaaaaattagccgggcatggtggcgggtacctgtagtcccaactactcgggaggctgaagcaagagaatcacttgaacgatttaatttcaggcccttgagataatggagaggctttatctccagaggatttggaatctttggcatcagcattaagattcgggaatgtggcatacttctttaattttcatgtccaacacatctctccctcatatctgtggactcataattctgaaatcccatgtggtcctgtaagattgaatagtaattgtaccacactacctacctaaattgttattaattaatccatgtgaaattgctatgtaacacaatacaaatgtaagatgatattatttggaagacagaatgcttgtcatactgtgaagaagcattaagtcttgttgtttgaattctttaaagagaaagaatgcctttgtcctcggaaataaagcacttttgattttgatttcttgcattttattttatgaacctctgaccactgtctcacttctgcccttcagagggtgtatctttgtagattcaggatgtgaaccgagccacttctttttagtttgtcatctgtgaactagagcagttgtttgtagggacttactgtctgtgcagttgggagaatgcaggcaattactgtccgacaaagaaggagctatctgacacatcttctaactcctgggctgtgtgtcccacgagtaaaataccgctttgcctaggcgattctatttgtctgtcatttgctatcaatctatattccaaaaacacagctgccctggttggagcaacagctgaagactttccaaaagttctgtttctctgagtgctctcaggaaggaggaactctgattccatgtactagatccaaagtcctttttttttttttttttgagacagagtatcactcagttattcaggctgtagtgcagtggcgtgatcttagctcactgcaacctctgcctcccgggttcaaacaattattctgcctcagcctcccgagtagctgggattacaagtgtgcaccaccacacccagctaatttttgtatttttagtagagacagggtttcaccatgtaggccaggctggtctccaactcctgacctcaagtgatctggccacctcggcctcccaaagtgctgggattacaggcatgagccactgtgccagctctgttatgtttatcttgcttgtgttagactagatggtcttcacatttattgctgtgctcctggagttggtgggggctgtggtgggaggcatggaggcagcaaactactttgactgaatttgtcttgtcacaagaagcttctctcttggatcttgatgctccaccaaggaaaagaatttagagattccctagaggttagattaacacctctgttttaagaagcagttttttcagagaattaataccttttcttggtacagttacatataactctgtgaactctttagattcaaatcttcattataatggaagatttggatatggttttagaagagtttaattttactggtattttggaggtgttatacagaaaaaggctttgtaacttgtagcttttccaaacagtacctaccatgaccagtaagaatgatgttaatagatatggtggtagagaaggctttctcctaggcggcgggcctcatgaaaatagatgcaggctgggcgcggtggctcacacctgtaatcccagcactttggaaggctgaggcaggtggatcacctgaggtcaggagttcaagaccaacttggccaacatggtgaaaccctgtctctactaaaaatacaaaaattagctgggtgtggtggcaggcgcctgtaatcccagctactcgggaagctgaggcaggagaatcatttgaacctgggaggcagaggttgcagtgagccaagatcgtgccactgcactccagcatgggtgacaaagcaaaactctatctcaaaaaaataaaaaaaagaaagaaaaaaaatcaatgcagagtgcttttagtatacaagaaacacttgcttcaggggaccagcagcacttagctactttgagaaagttggcttctttgaagaaggcatagagtgggcagaacaggtcaattacaagtgtttaccaagtctcaggtctttacgactatataaactataaatcattttaatttccttgagttcaggagccaaactagtgtggagggacaggataaaaataaaacaatttgtgaatatgacaatatatgattgagtgttaactgtgtgacacagtatgtgttgtagggcttcagggaagacagtgtggacaagagtggttgaaggaggctttcaaggaggcttgaaagataggtcagatttgggtacagagagcataaatgcttttggaagtcagggattctgttctcgaattttacagcagagtttggcagtttaaatgctgtgatcaccctgggtagggagttaagagaccatggtactgttaattttggttggacacccaaagggctgagtaactttatggaatctttagtttcctcatttgaaaaatgagggactcactgcaaaatgaagcaccttgtaactataacatcctttgattatttaacaactacatgcagcttgccagggggatatcaccccctattggagaacctgtggtgcacattgtcttacagacttggcaaaacatacctcatgcttccagtgatgaaggagagtagaatagaataccagcctgccttcatgaaacatgtataatttggcatttttacagatactctgaacagttcaatcaactgcttacaagagcagaacaacagaaagtgggaattttgatattgaggattttttagctttttgtactgtgatataaagcctcaatgctatgtattgaatgcttagtccagagcaagtaaagagcgtcttcttgagaatacttaccatgatttgttttaaaattttactctgttgccctgcaaaaataatagcaatgggaaacccaggaagtttattagtcaaactttattagtcaagcaaacaggacaacttatatagatccttgtggcctaatatagcttgttcatttcacctttgattcaggaaaaacttagtatactcatctggttttctttattaaatttctagtacttacagaataaactcacatagacttggattctaatgccaactgcaccaagctgtgatactttgggcaaattatttaatacctcagagccttagtttcctcatctgcaaaacttaaggataaaaatattcaccttatagggttacgaggattaaatgagattacaaaatatactacattgtgagcatatatgaatggctctgattcattatactacctttttcatccccttccctaatttagtctcagcctaacttttgagccttttatttgctattatcccctaccctccccaagcacaagtgtgtggcagttatgtgtgtacatgcacacataccctatagtctagtttctagcacaccagactacttatgtctagactattcgtagttgctaaacatgcctgcactttactccctccgtgttttggtttacaggttcccctcagccttgaatgccctctcaaaagtcctgcccaacttgtgagacccagctcacccacttcctgttaagcttcactttgtcctcccaactagaactgtttttaatgtgtattttttgttatagaagttactacataaagccatatattatggttataacttactatataagctgtgagagcttaagatcataacttaccttggtaccttgcacataataagaactcagaaaaaaacgttaaggccttaaaatgtttaaaaaaaatcaagaaacttttttatatttgttttaagctggtaataaaagtctattgttatatattcttgcaataaagtttttttttctttattattattactactttgtaatagagatggggtcttgctgtgttgcccagcctggtctccagcaatccacctgccttggcttcccaaagtgctggtattactggcatgagccactgtgccctgcctgcagtgaaggttttttgttttttgttttaaaccactgactactactactacttcttcatttatttatttttttgagacagagtccacccagcccaggctggagtgcagcggtgccatctcagctcactgcaacctctgcctcccaggttcaaaggattctcgtgcctcagcctcctgagtagctgggactacaggcatgcgccaccatgcccagctaatttttgtaattttaataaagactgggtttcaccatgttggccaggctggtctcaaactcctggtctcaagtgatccatccgcttcagcctcccaaagtgctgagattacaggcgtgagccaccacacctggctaatttttttcttttgtaaaaataaacaggccaggcccagtggctcacgcctgtaatcccagcactttgggaggccgaggagggcggatcatgaggtcacaagttcgagaccagcctgaccaacatggtgaaaccctgtctctactaaaaatacaaaaattagctgggcgtggtggcacgtgcctgtaatcccagctacttgggaggctgaggcaggagaatctgggtgacagagcaagagtccatctcaaaaagaataaacaacagaaatttatttctcatagttctggagtctaggaagttcaagatcagggtgccagtgtggtcaggttctggtgagggtcctcttctgaatgcatactgcctcctcactgtgttctcacatggaggaaggcggaattactttccttaatagcatttaattgttaagtccgtcagattttggtggtttgaaaagatctttgttctttgatttcctccaaatattatttggatttctaggtttagattcaacatagaaatatatccatgattgttgttttttactattgagtatccatggtgtactaggtgtttggaatggcaagctagatttcagtactgttttagtctcttgagatttctttaagatttctagattttaaattagtatcatgagtgaaggtacttattaggcaaaaatggcttctaggaaatgagaccaaaatgagaccttcatcccactaatgaaggtctgaaaataattttctggatgaaagatgggattcaatagattttttttttttttttttgagtcggagtctcagtttgtctcccaggatggagtatagtggcatgatcttggctcactgcagccttgacctcccaggctcaagtgatcctcctgcctcagcctctcgaagtattgggataacaggtgtgagccaccacgcttggcctcagcagagattttgttgaggaaataaaatcaactttgaagataggaatttgactgtttggttatgaatagaggtgtagagtctgaagtagcacctgtactagaaaaggggttgggaattgaatgattaactaaacaatgtggaatactagctgtgtggaatgctgtgcagcagttaagaataagatgaattgataagcactgacatttttggaaagatcttactaaatggaaaaaagctatagaacaatgtgtgtagtatgccatttataaatagattttaagttatatttttctgtgtacatttacatacaaaagcatagtgtctcagaagaaaaggtgtggaaagataatacatcaagtttataagcatctttacctctggaaagcaatgtgggaattgaggaaccatgaaggtagacttttggtttatattctctttgcttctggatagtttaaatttttagccaaagaatatatttatgtgttggttgtacaactaaaaaataagttttattactggaaagggattgggaacagcttgtggggggctgtaatctacaaaagccatcttcagtaccaggtttaattccatcattgtttttcgggttttaggtctctggactattgtcctttaacaacaacaacaacaaaaataaaaaaaaaaaaaaaaaaaagaagcaaaggctgtgggattcagtaggctttaaagtaattttttttttaatatcattttcagctggcagaggcacagccatagtttcacttccagtttcttttgcaagtttctatttagggaactttaaataatttatctctaagaagtatcatgccatttcctttatactgtctcatttaggaagctctgagtggggaagtatagagcaggagggaagatgttagactaaggttcagcttgtatagctcctgtatttttcttgaggaatttttttttgttctgcagctctatatgagatcaatgaacagatatatattctgggttaatgacaaaacctggcatttggccattcacttaggaaagttagctctgtgcattaactattggttaaatcttacacccagaagctgttctgcagttaccagtcacaccgttaactctagccaacattttacaaacgcaagaaaatgtgcttctggtgagagaaaactgtaggtgtatcatcgcaagtctatcaccatatttttatggaccttaaatataaactcaatttttacatcccaattttaacagcagtttgttttattttaaataacttttgttcatcacacatttagtgaagaatataataagaaaacataaaataaatgcctcctattcatcccttgttaactgctgttaacatttcacaaagaaaaggacaaggacaatgaattgaacaaaggagagaaaaaaaagtgggccatagggaatgtacagtaaatagggagtaaagaagcagatatataaacagaattattaaggccaggtgcagtggctcacgcctgtaatcccagcactttgggaggtcgaggtggatggatcacctgaggttaggagttcaagaccagcctggccaacgtggtgaaatctcatctctactgaacatataaaaattagctgggtggggtggcacacacctgtaatcccagctactcaggaggctgaggtgggaggatttttttgaacctgggaggcagaggttgcagtgagccaagatcataccactgtactccagcctgggcaacagagtgagactccatccttaaaaaaaaaaaaaaaagaaagaaagaaacagaatttttttttttttttttgagatggagtctcgctctgtcacccatcctggagtgcagtggcacaatctcaactcactgcaagctccgcctcctgggttcacgccattctcctgccgcagcctcccgagtagctgggactacaggcgcccgccaccacgcccagctattttttttttttatttttagtagagacggggtttcaccgtgttagccaggatggtctcgatctcctgacctcgtgttccacccacctcggcctcccaaagtgctgggattacaggtgtgagccaccacacccggccagaaacagaattattaaagaattctctatgtggaaactttaagagcaactggtatgtaaaagttttaagatctggaaagctggccgggcatggtggatcacgcctgtaatctcagcactttgggaggccgaggcaggtggatcacgaggtcaagagatcgagaccatcctgaccaacatggtgaaaccccatctcgactaaaaatacaaaaaattagctgggtgtggtggcgcacgcctgtagtcccagctacttaggaggctgaggcaggagaatcacttgaacccaggaggcagaggttgcagtgagccaaaaccacaccactgcactctagcctggcaagagtgagactccatctccaaaaaaaaaaaaaaagatctggaaagctctggtggtgtatctcattttaaagcaaagcataatctaagactgataagaaaaaaacaataatgacatctttgctggtgtgacagatgcctctagttattagatactcttaagagttttcttaggggtctaacttgagagcagaagacagttaatttctttctcacatccttcattcctcagcatacagggaattccttgaagatttcttttgataactggctgtgtcattctaaaagaaaaaaatacataaaaaattcagtgcagttttctcacatctgagctctgatattaaaccttaaagttgttgtaggatttatatgaaccagaattctctaattgtgtattttgaattattactttaatgctataacaacacatgctcacattcctatgtactgtcaaaggtttaatgaatttagtggtttttcttctaaaaccaggtttgacttaatatgactcccacatttattgtattaacaatagtttacttcttagacatgagtggaagtgcaaagtaaagtgctttactaaagtcaaaaatcagctgggcatggtggctcacacttgtagtcccaacactttgggaggccaaggcggacagattgcttgagcttaggagttcgagaccagcctgggcaacatggcaaaaccccatctctagaaaaagtataaaaattagctgggtgtggcagtgcatgactgtggtcccagctacttgggatgctgaggcaagaggattgcctgagcccaggaggtcgagcctgcagtgagccaagactgtgccactgcactccagcctgggcaacagagtaaaaccctgtctcaaaaaaaaagtaaaaaatcttgagacaatagtatatcttactttatagcctacggttattatattacttctaagattttagtcaaaattaaagtatcaaaaaaggtctgaaatggaaagatatagtctatagggaaagaaagaagcccaaattttaaaatatgttaggatgattgataggagagaatttaaatctggtgaaactttaaaaaagacttctctgttgccttctttatgttcttgactgaagcgatgttttcagagagctgaaaatattccattcttttccagattgcaaaagttgagaagctcaaaccattagaggtagagctgcgacgcctagaagacctttcagaatctattgttaatgattttgcctacatgaagaagagagaagaggagatgcgtgataccaacggtgagggggaaggcgactcttacttcttaagtgacccataaatgagacagtctccaaactttcaattctggtgtacccttttctcagttttgccaaggtgggtatatggaggggaaattgcttgcttcgctgttgttgctgctaaaggtaaatgagccttgttagattttcaagagagtagaaactcctactgtgataggcaggtgacaacatcctcaattagtctatacccacatcaaactgatagcaccaatctttgtaattttcaacatttatatataggataatgaacttttatttttatttatttacttatttttgagatggagtctcgctctgtcgctcaggctggagtacggtggtgcgatctcggctcactgcaacctccgcctcctgggttcaagcaattctcctgcctcagcctcccaagtagctgggactataggcacaagccaccatgcctggctaatttttcgtatttttaatagagacagagttagccaggatggtctcgatctcctgacttcatgatctgcctgcctcagcctcccagagtgctgggattacaggctgggattacaccatgcccagccaggataatgaacttaaaaagaaaaattatctgaaatcctactgttagacctagggacagagtgaagttaattaattgcctttacccacctcccctgccattgtttagccagctgaggaggctcacttcattatgtttacaatgcttttgtttttttttagagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcatccaagtagagaaaataatatgtgggttaagatacatccttaaacttttttttttttggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaacc

SEQ ID NO: 35717 - DNA, 122041 bp, Homo sapiens
gtagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggtgagcgcgcagggcctggcgcgggagcgggcgcgggaggtatccccggggccccggcccgcgtcgcggctgcctgtggccggctcgctggccgtggctttccgcgtgggttccggagccaggcgccgagggttcgaatggcctcttctccgccctgtgaccttgagcgagtcctgagcctctccgggcctcagtgtcctcatctataaaatgggagcagtcatgaaaaaggctgccttgcgggcttgtcgtgaagatatggcgaggtattattcgtggagtgcctcgcgcggcgtgtggcccacagcagacacccaataaatgagagttgctgggatgtccgagggtccctgccccgcgcaggcttcgcccccacgttgacttcctcgctctcagcgccttttaggcctcctcgatctggctgtgcgggggagggagagcgggccttcccacggatcccttgccttctcttctagggatccttatttgagccacgttgtcctcctttctaatacttctgcccctcaccctgagacccgcctcgcccacccccgctccccagagctccctgtattccgcccttttattcacttgcctcactctctgtcgcctcctcctccctcctgggcattttacttatgctcactcctctggcactctcacacctttatgcagtcattcgtgaccacaagcccggtttttccttccgctcagccctgctgcccttcctttcattccctcctgtggacattttcacctggcgttacctgctgtcaaacggcctcctcccactggggcctttctagactcgggggccctccttggcccctcctcctggcaggaagcaagatggagctgttgggagaggcctgtggaatctgggatctgccgcccctgccggagagaaggctggggcatccgctccccatccacaactttcctggtggctctgcagacccctgtaacccacagctgtgactcataaccgaggtgattcctggaggaggtggagcccacgtctgaaatgggaaaaaagaggtgctgagaccagtctcccaagactcccctggctaatgtcacacttttctttcccaccctgggtgggtgactcagactggtcctgcttgtgaggaacaattttggaaaaagttcatactgctcccccactgagctgtgtaaatagtgtgtgtcagggcagttgggcggcaactgtgggtctgtctgggtggggcttgggttacttttctgatttgagcactttagtgcacttagaggctctttagcagctgaaagtcttcctcagtcttcaggggtccctggactgtctcaagcaatttaggagactggtagctaggaagacagggtgacaccaccgaccaaattcctgatctttcttctctatagctttagtaagaatctattcattcagtaagaatgctgtattcattcacaatgtctacttgtacattgttcttctttttataactaatttgaacagaacactccagagtacattcttatgtagtgttgtctaacatggctgcattccaggcctccatttttcaacaaataggaaacaatgtaaagagacaaggtaatagtgtctctccatgtagtacttcaggaaatgaaatcttaaaaccacatgttgcacttggaacagagctagtgtagtctaggggttgatatctggttaggctatttagagaaaagttatttatgggcttccatgccatgaattaataagcattgaatgtctgctatatggaaaacactgcaataaatcagtgcttctcagcttaagagtgttcatgaaaatcatcagtgaggctttttagaaattaagatgtccagctcccacgggtcaaggcctttgtattttgcttttttttttttttttttttgagacagggtctcgctctgtcacgcaggcgctggagtgcaatggcgtgatcatagctcactgcagcctccatctcctggactgagaaaaatcctcccacctcagcctcccaagtagctgaaggcctttgtttgtttgtttgtttgtttgtttttgagatggagtcttcctctgtcacgaggctggagtgcagtgacacgatctgggcccactgcaacgtcctcctcccaggttcaagtgattctcctgccttagcctcccgagtagctgggactacaggttcgcaccaccgtggccagctaatttttgtatttttagtagaggcggggtttcaccatgttggccaggatgatctccatctcttgaccttgtgatttgcccgcctcggcctcccaaagtgctgagattacaggcatgtgccactgtgcccggccaggccttcgtattttttaggaagctccataggtgattgtgatatacggccttagttaggaaacactgtaatacacactgtgagacaaatacaaaagaaataaggttataagatgaaaacaatgatatgtagttaagttatatactttccaacacatacaaaagaggggacttgagattggtggtagctatgggttagcagagacaaagtagggaggattgtgctgataaatagttaatcatgaacaaaggtacttgtgagtaagtcacttccaggttacagcaagtagattatcttgattgcagctcaggagacaagttggagagaaattggagatgaagttagtgcgtgacatatgggcagtgtaacataggccttatccaaaaggatgaacaaagagagcaggaggggaaggaggatgagaatagtgtgtgagaaagactgcgtgagaatggcgtgtgagaatagtatagtgtgttttggggaggccagaggacctacccattgcttcacattcttggtgccaactgtgaccgttaaatatgtggattctgtacatgcttcaagattgttcctggaggtcaagccttgtctgatattcctctctttttaaaaaattttattttggttttaaatagagacagggtcttgttatgttgcccaggctggtctcgaatccctgggctcaagcaatcctcccgccttggcctctcaaagtgctggattacagttgtgagctactgtgcctggtctgatatttctttatatggtcctcagttcctgccctcaaaattggcacataggatcactcaataaatattgttgaaggaactatgggaagggagacaaattgggaagcttttaaaattggttggttatgaagaaaatgaaggcctggacttgcgagtggcagggaaaatggagaaggaattaatcagaaatatattagaagaagaaataatagaactggataattgaactctgaatttgctagaaaagaaacatagtattacggtaaaataatgaaactgattttagaacaaatcttctggaatttatgtaatctgggtgagtatttcttgggagttactttgggaggttatatccttattctagtgcttttctttgggaatttctttcagattatttacatacgtatgccaaattagtcttattttggtcaagaaagtgtacattttgactgaagtaggcattcttgagctcaactacttcatttactgttcttgagcctaaatgacttttggatatttccataattaaaatttactagatgaagatgaaattttcaattgttgtaatagtcattcacttatcaagcaggtgtttattgagaccccttccaatgtcaaagcaataagtgtgatgcctgtcacaatcagtatgatactgaattggaagtcttttttttctgagatggagttacgctcttattgcccaggttggagtgcagtggcatgatcttggctcaccgcaacctctgtctcccaggttcaagtgattctcctgcctcagcctccctagtagctgggattacaggcatgtgccaccacgcccggctaattttggatttttagtagagacggggtttctccatgttggttaggctggtcttgaactcctgacctcaggttatccgcccgcctcggcctcccaaagtgctgggattacaggcgtgagccaccacgcccggctgaattggaaatcttaagtggcactgaggaaacagagtatgatggaaagtcagaggaagacgagattacttttgattggagaatcagggaaggcttcacagaggatataacattgagttgggtcttaaagacagataggatttgaatatttagagatgtggtaagaaaggtattacttggccaagtatggtggctcatgcctgtaatcccagcactttgggaggccgaggcgggctgatcacgaggtcaagagatggagaccatcctggccaacagggtgaaaccccgtctctactaaaaatacaaaaattaactgggcatggtggcacgcgcctgtagtcccagctactcgggaggctgaggcgggagaatcgcttgaatccgggaggtggaggttgcactgagctgagatcttgccactgcattccagcctggtgacaaaggaagactctgtctcaaaaaaaaaaaaaaaaagaaagacattacttacttttatgggggcagaactcattaggatttgtaatttcatgtatatttgctaagcaaagtagtctggtcactgatatatatatataaatatatatataaaatttgcaactgggtcatcacttttactccacaattagggagggggtagggtgggagtatttatttatttatttatcttgagatagagtctcactgtgtagtccaagctggagtgcagtggcgtgacctcagctcactgcaacttctgcctcccgggttcaagtgattctcctgcctcagcctcccaggtagcagggattacaggcatgtaccacttaaaactctatttaaggcagttttaaacacagagagtgagtccaattcaataatgaaacaaggaagaggaggtagtcaagggaagggtgggaaaggaaaaataggagaagggcacaagaaattctaagaaggcttggattcagcaggcagtgtgaaaaagtcacaagtcttagactgagtactttgtagcatggtatataaatttttctttttttcattaaaatggcccatagaaatgtgtcagtctgtgatgtgacattatagtcatgccagttttgttaatggggcttcagatactttgctttctccagtgcatctgagagcatgtgttgtaagtactccttgggctcatgaaatatttattttgggagttttttgtggccttgacttttatgggcctcacttgtatatcatatgttcttgggaccagctctgggacaaatagcagtattatcttcactttacactgataaatgggaaagactgctctgctcttgttttgttgttgtttagagatggagtcgctctgtcgcccaggctggagtgcagtggtgtgatcatagctcactgcagcctcgaactcctgggcccaacagatcctcccacctcagcctccttagtagctgggactacaggggtgcacctccatgcctggctaatttaaaattttttttatagagatagggtttcactatatttccaaggctggtcttgaactcctggcctcaaacaatactgctgcctcagcctcccaaagtgctgggattataggcatgatccactgtgtccagcctactctgatcttaaaaggagatcagcagttaattttgtcatttgtaattatcagtattaacatctgaaaatatttttgctttaaaatttggttgatattagactttatttcagttaagtaaataacagtgtttgggtgggtgatttttttcttcttaatatatttctgtattttccaatttttgaaaattaatatataattcctatgctaaggaaaaaatagagtaaataaaaagaatatttatgtgatcatttatagctcataaaatacttttatatttataatctcatagcagtctatgggtaggtatagtggtggtctccgttttacagatgagggaggatactgtagttcagataaattaagtaacctgcccacagtggcacagctggttaacctggacttgaactgtggtctgttgttccagatcctctgctttttttcacaccaccattccacatctacttagagcaaagttgttaaatatcagtggaggtttcccacctagaatcagaagcaacaggaatgctgttagtcatagaggttccatttgtcctgggtctggcaacagtatctgtttagagcctggctttagcatagcctgcatgaatggcctatatgagaagaatgatgtgaaggtaagcttgtttcatagccacacccaatttcatagcatttcttttcttttctttttttttttttgagacggagtctcactctcttgcccaggctggagtgcagtggtgcgatctcagctcaccgcaacctccgcctcctgggttcaagcgattctcctgcctcagcctcccgagtagctgggattacaggcatgcaccaccatgcctggctaatttttgtatttttagtggacactaggtttcaccatgttggccagggtggtcttgatttcctgacctcaggccatccaccctcctcggcctcccaaagtgctgcggtcacagacatgagccaccacgcctgatccacagcatttcttttttgagaaattagagtagatacagatcagcacaaaagtatgcctgcaaaacagatgaagagtttttgtggtatatgtgcctgcttagcttgaagcctgttagaatgaaatcgtatgtaaaataactttgtagattacttggggaatcatgaagtttcatttgtaaagctgttgctacatcaaaagagatgtaagaacgagacagatatctatatctatagatagatatatgtatttttcttttttttcttttttgagatgcagtctcgccctgttgcccaggctggagtgcagtggtgcgatcttggctcactgcaacctctgcctcccaggttcaagcgattttcctgtctcagcctcctgagtagctgggattacagtcgtgtgccaccacgcctggctaattttttgtatttttagtagagatggggtttcaccatgttggccaggctggtctcaaactcctgacctcatgtgatccacccgccttggcctcccaaagtgctgggattacaggtgtgagccattgcacccagccagagacagagatatattttgttccaatcatttttaacatttactcatgtgactgagagaacagaagatttttggagatgggcagttatccgtcggtatccatgggggattggttgcaggaacccccctcggataccaaaatctgcagatactcaagttacttacataaagtggcatggtatttgcatataacctatgcacatcctcctgtatactttgtcatctctagattacttatactgtaatacctaatatgatgtaaatgttataaatagttatactgtttttttaatttttatttttattgttgtattgttttttatttttatttttatttatttatttttttgagacagagtctcgctgtttcacccaggctggagtgcaattgcacgatctcagctcactgcaacctctgcctcccagattcaagagattctcccacctcagcctcctgagtagttgggattacaggcacccaccataatgcctggctaatttttgtatttttagtagagacagcgtttcaccttgttagccaggctgctcttgaactcctgacctcaggtgatccgctcgcctcggcctcccaaagtgctgggattacaggtgtgagccactgtgcccggcctatttttatttgtatttgtatatttttgatctccagttggttgaatccatagatgtggaactcaaggatatgcagggctatagctatgtttaaattttaatggaaccacaacttaaatgtttgtttacatccacacagtggaaaattgggcttttctaaagctgttttataaatagagctggtataactctaaatggacaaagtaagagggcaaaagtcctctggtatcagcaacagtagcttagattgggtcctcctgttacagtcctggagtaaggacaacagtaggacaaactacttttataggactcatttgaattttactatttcttagatatttgtttaaaaacaaactagcctggttatttcatacacaggttgagtatctctaatctgaaaatctgaaatctgaaatgctccaaaatctgactttttgagtattgacgtgatgccacttgtggaaaattccacatctgacctcatgataggtagaagtcaaaactttgtttcatgcacaaattattacaactattatgtaaaattaccttcatgctatgtgtatatgaaacataaatgaattttgtgtttaacctttggtcctatctccaatatagctcatgatatatatgcaaaaattcccaaatccaaaaaaatctgaaatatgagatacttctgatctgaagcatttcagataagggatatttaacctgtacttatttaattactcatcatttatatagttatgaagtgtttatgttttatatatagtcattttatttttatttatttatttattttgagacaggatcttgctctgctgctcaggctggagtgcagtggcacaatctgggctcactgtagcgtcgacctactgggcattgatcctcccaccgcagcctcccgagtagttgggactacaggcttacaccatcatgcccaactatttttgtatttttagtagtatttaaacaaatatccaaatggggttttgccatgttgcccaggctgttcttgaactcctgggctcaagtgatccacctgccttggcctcccaaagtgctgtgattacagatgtgagccagtgtgcctggccaggattgtaactttaagagccttctgacaacttcccagtctttcactgcaccctttgaaatgggtaggataggaatatcctcattatccacagcctgtagttcagcatagcatggagatgctctgttattacactcatacttgttcagtgtttgtcatctcactaagttgtaggttcctcagtggcagggacaatatgcctctccgggttataggtatgcaatatacttttttttgagacggagtttcgctctgttgctcaggctgcagtgcagtgggacaatcttggcttactgcaacctctgcctcccgggttcaagtgattctcctgcctcagcctcctgagtacctgggattacaggcacgtgccaccacacccagctaatttttgtatttttagtagagacagggttttaccatgttggtcaggttggtctcgaactcctgacctcaagtgatccacctgccttggcctcccgaagtactgggattacaggcatgagccgctgcgctcagcctaaatttttttttcctttttttttgagatggagtttcattcttgttgcccaggctggagcgcagtggcacaatctccgctcactgcaacctctgcctcctgggttcaagtgattctcctgcctcagcctcccaagtagctggaattacaggcacccaccaccatggacggctaatttttggtatttttagtagagatggggattcaccatgttggccagtctggtctcgaagtcctgacctgaggtgatctacccaccttagcttcccaaagtgctgggattataggcatgagccaccgcgcccggcctaaatttttaaattaagtgaacatatgcatagcatttatttttatttataacatataatattaggaattatcgtacagtgaatatttcccatccccagctgtcaaatatctggtatagtcaaatttgagccatctcatggaatttataatgggctttgactgaaacaagtgaaatatatactaagaggaatgaatggctaactgcccattgtttgagataacaaaagtgttcaggctattttgggttgtggtttttctgtttcagagtcatttcagctatgcagatcacttactaaattcataatgtgagagtatgttaccttctatctgaaagtggcgttgggattttgcattctcttcttgggagtgcctttttaaaatttaatgatttagaccagatgttgatatattatttggagccctgctggttacaatgtagtctcatactatgagtcagaattcctcattaaaggatctttatttccctgaaccatatggcaagagacaaagatatcacaaagttgatctgctgcttttttgctttctggctgatttgggcccagccttttcattaaacctttaggtcatggttccgacagcggggtgtatttttacataataaaccagcattagggcagtatcaaaagaagtagcagtctttaatgagcaaatatcagagattagctgctttctttgtagatgtttctttctagaatatgctgtttggtcagaattcttgatgaggaaggtccattcagtcagttcttgttgctctcaggcaggtcaacccttaaacctttccatacagataggactagaataaaaaacaaacttctgccttggcatttttaagcttcaacaactttcagtgctatataatgtaaatccttaagagttagcttttgggggggaaaattcaagtctgtaataagactgaaagatagagaagaaatttgatatattggaggaaggacgtcccattgaaagctttcatgtgtctttcttttccctgtaccttggatctgtagaagtcttgcagtatatgtttgaatatagtgggccacataagttcaggtgaaataattttcaaattgtctaggtggctgctgctttccccccccccccccgagccattttagtatttaattctgttttttatttttatttttttttgagacggagtctcgctctattgcccaggctggagtgcagtggcgccatctcggctcactgcaagctccacttcccgggttcacgccattctcccacctcagcctcccgagtagctgggactacaggcgcctgccaccacgcccggctaatttttttgtatttttagtagagatggagtttcaccatgttagccaggatggtctcgatctgctgacctcgtgatctgcctgcctcagcctcccaaagtgctgggattacaggcatgagccaccgcgcccggctttaattctgtttctattgggaattgttatggaaaggaaagctgtcttaccttatttattaattattattattattttgagacagagtctcactctgttgcccaggctatggcatgatcttgactcactgcaacctccacctcacgggttcaagcagttctcctgtttcagcctcccaagtagctgggactacaggcatgcgtcaccacacctggctaatttttgtatttttagtagagacggggtttcacctattggccaggctggtcttgaactcctgacctcaaatgaaccaccccctcggcctcccaaagtgttgggattacaggcatgaaccactgcggccagccacctttttcttttttttatttttctttacttttttgagatggagtcttgctctgttgcccaggctggagtgcagtggtgagatctcagctcactgcaacctctgcctcctgggttcaagtgatcctccctcttcagcctcccaagtagccgagattacaagcatgcgccacacacccagctaattttttgtatttttagtagagacagagttttaccatgttggccaagctggtctcaaactcctgacttcaagtgatccatccgcctcggattcccaaagtgttgggattacaggctgtgagccactgcaccagcctacctttttcttcttaacaagttacaaaaagatttattagggaaggaagttgagaatatgtaagtagggaattttgttcttttgtatttttatcaaagtattttagttttcatattgcattaaaaaataatactattgaacagtatactattagtaatcactttttatcatgctgtgtcttcatatagtctgaaagaataatttttcttgttacaaaataatgcatttttattgttgaaaatttagaaaatctatctttatttgcaatcttctgtcagtatttctcagcctttttcatttctgtctacttgaacttgatttgcatcattttttcttgttactccaaaccaatttatgtttctctgggtataaatacaaatttaactatatatagatgcaccagctcttatccttttcaccgtttaaaaaaaaaaacaaacaaaaacaaaacccatctctagttcactttcctgcttatgaattttcaaagcaaggtgaggaaacccactgtcttaaaataccccaagactttctctgccatctggggagctgtgctgtagacaggaaactgctgcttcagaaaatatgaaatgaaataacttcaagataatgagcctcatcctgaaagaacttctggtcccaacatacttattaagacatgggggctgggcatggtggctcatgcctgtaagcccagcactctggggtgctgaggcaggtggatcacctgaggtcaggagttcgagaccagcctggccaacatggcgaaaccccatctctactaaaaattcaaaaaattggctgggcatggtggcaggtgcctgtaatcccaggtacatgggaggctgaggcaggagaatcgtttgaacccaggaggcagaggttgcagttagctgcgccattgcactccagcgtgggcaacaagagtgaaactctatctcaaaaaaaaaaaaaaaaaaaaaaaaaagacacgggatcaaataaccattgattaaattaagtatgtgcattgcatgtatgcaaagaggtagagtgggatagagtgttaggtaaaaaggaacttgtataattagacgtaggaaatggggaactcactgccttctttcaagtcccttggtaaatgtagattttatgtcctcatatactggatcatcagtccttggatgatggatttcatatcgaattttcttccccctctcctccctactctcctagggtgtctccctttagactgttggtttctgaagggcaaggagtgggttttattcttcatattattggttctgtgtttaccatagtcccctgctcatggtagttcttcaattaagtgtgttatgttctgatatttaatataccagctagtcattttaggttattttatgataataaggatagctgattatctcttgcctccactggaaggcatgatgtttctcttttcctgccctcaaatgttgctatgtaccaaatatttatacagtctcaaagagaaacaaagattcataaacgatattatattgtgttgggtacatattttgaacttttagattccaaaaaattccatgtcacttctatcagaagttagcacactggattggcataagtgtggggtgtgtgtatagaggagagaggtggtgaatcttagaactcgaaatgttttacaaatgttgttaagctgcagaaaatagagtctttggcccttagagaatttcccactgataaaatttccagttgaatgacttttaaggggaaagtggctgaatttcactgcacttcttaccacagctggccaccatccaagtcaaagtcattccttcttttgaaataagcttaagttattcccatgagtaagctttctgtgaagaaagaaatggcacagttgttagagttgagagttgagggacctttgttatatagctttcttgtgtttccagccttctctttgtcctctctccatccctggagaactggctcatcttttatctaccaggtggataacatgtttttattcttgcaattaaaatagataagggtatatgaataggctagtaaatctcataagaaaaaatgtagatcagcaacacttaaatttctcattctacaattctccccaaatagtaaagttacttgtcaaactccagctatgcacattgctaggtgttgggatatataagatatggtctctggcctcaagttgcctaaaacacagatgaaatcaataatcttataaaaaagatttattcacatcctctccaccaatataattgttgcagaatttatattattcttcttaaagagttgtgtgttaactactacaaatacagtggtttttcttctttggagtcatggagaagatgtgaagtggtagggacgtgggggaagagtgacacacacacagtaggccagcagcagatcgagactggtatggtatgagaggagtgaggagatggtgggccacctagttaggaagagacctttgagcattggcctcagctgctttctgcttgtggctgcccaaactcactgggtttttgtttcctccaaagtacagtgcttcctgttggccttccttctgcctgatgtactcttctgtagttctttacttggataatttctactaattctcagttttcatagtaaatgtccatttttcagggacactttccctgactacctctaagctaggttaggcccttctatcatgtactttctatattttttccttattatgcttatcacaattgtaattaattatttgtgtgattattcactgtttaacatatctccccaccagagcctcaggggcaaatattggctctgctgtgtttgtctctgaatttttagtatccatcatagtgcttggcatatagtaggatcttgccttgtggagtaaagtatttgttcaataaacaaataggaaggccattttctgctgcgatcaaaaactgttttaagcttctttggagaaatatatatcaggctgtggttgaatcttggtgaaatttaactgccaattaggaaagtagctgtaaataattgcttaacacagggcattgcatgcaaaaggaccatctaatttgtgttctctgagtgaaaaaaatttaggcacagagtcctggggtgcagatggggataatcctgcacagcccagcacaggattatacagaatatgtaagtgtgaataaaaaaataaacatggatgtagaattctctattagttttgatcttttgcaaatgagcagaatagccatctttggcaaaatgtggtagtatgagttagcaaataccaaagtcacactttagatatagatactagataaatcagcatatgataatcagcacatgataaaaattttgggaagcagtacagtagtataatcgttaagcattaaactccttattttaaaatcccattgttgacaccttcgagataggtaacattggggaagttatttaatctccatttctcttgatcctcctatgtaaaacaaaggtaaagatagtacctggctgataatgttgttgttgtgtgggttaaattagttcattaaaatgtttataactattcctgacacagagctaagagctttatgagtgttagattttatcattactatattttcccatgattttaagtcatattttaaacgttagtctaatgaaaaggcagtgttgatttaaaaaaaaaatgtctaagcatagcttctaacttttattcaacaaggcaaaatgccaatgaaagctttcagtagaattccatatgttgtggaatatacagttttaccaactgtggggaaaatatcacagttttaggtgcttgaacctttgattgccagtttcccatgattaaagatagacatctaaatttttaatttatatttattttgttagaagcaatagtgagggaaaaagtatatatatattttccaatttgaagcaagaattagggtttaggatttagggttttaactcaagcattaattgtcttttctcttttcttttctttcttttctgttctttttttggagacagggtctcactctgtcacccaggctggagtgcaatggctcaatctcggctcactgcagcctcaacctcctgagttcaggtgattctcccacatcagcctccccagtagctaggactacaagcatgtacagccatgcctggctaattttttttgtatttttagcagagacggggttttcccatgttgcccaggctggtcttgaactcctggacttaagcagtccacccgcctcagcctcccaaattgctgggattacaggcatgagccactatgcccggccagtgtcctattttcttaaaaaaaaaaaaaaagaaaaaaagcaaaacgaaaatcccaaagaggtacccaggccattcactgaagtaataagatagaaccagctttccaggtagagttgagaaatattatgcatttgtgaaatacaattcatcatattctggaacagccaatttagttttgagacagggtctcactctgttgttcaggctgaagtgcagtggtgtgatctcagcccactgcaacctccacctcccaggctcaagcttgcattagtctcctgagtagttgggactacatgcgtgcactaccatacctggctaatttttgtattttttgtagagatggggtttctgccatgttgcccaagctggtcttgaactcctgggctcaagcgattctcccacttcagcctcccagagtgctgggattacaggtgtgtcaccatgcccagcagcttatcaaatatttaatgagtacattctattccggatactagactaacttaatttctcttgtctgaaaaaagggatagaatcgctttcagattcctaccaaatataggagtaatagagttgaaaagtgagattaggagaccttaactactagtttagaggttatactcagtatttctagtctttcaagaagttttttgctatgcatatttaatttcaaagtcttaaattaattagcatttctactattctcctgagtaataaaaggatattaaaacaatttttggccaggccctgtggctcacgcctgtaatcccagcactttggggggcccaggcgggtggatcgcttgaggtcaggagtttgagaccaacctggccaacatggtgaaaccccatctctactaaaaacacgaaaaattagccgggcgtggtggcttgcgcctgtaatcccagctactcgggagactgaggcaggagaatcgctggaatgcgggaggtggaggttgcagtgccactgcactccagcctgggtgacagagggaaactctgtctccaaaaaaaaaaagtttatatttcccacttggtaatttctttagttcttccagtttgctaattcttgtgtagtagtttctaatatgccatttaatccattcactgcatttttaatttaaatgacagtcttttcctttttttctttctttttctttttttttttgagaggaagtctcactctgttgcccaggctagagtgcagtggtgcgatcttggctcactgcaacctccgcctcccaggttcaagcgattctcctgcctcagcctcccaagtatctgggattacagtcatccaccaccacatcaggctaatttttgtagttttagtagagacagggttttaccatgttggtcaggctgatcttgaactcctgacctcaagtgacctgcccacctcagcttcccaatgtgttgggattataggcatgagccactacgctcagccttttttctttttatttatttgcttttgtaaataatggggtctccctgtgtttcccaggctggtcttgaactcttgagctcaagggatcctcctgcctgggcctcccaaagtcttgggattacaggcatgagccaccacatccagcctaaatgacagtctttttcccttctataattccctttggatctttttcaaaatctgcttcagttttgatagtctcttgttcttttattatacttaaaattgtcatttcttgttgttcgtgttgttttccttggagtatagaaactataagagcttaataccagagagagaatagcaaggcacttttaaaatctggtgaaggctgggtaaggtggctcatgcctgtaatcccagcactttgggaggctgaggcaggcagattgcttgagtgtagaagtccgagaccagcctgggcaacatgacaaaactccttctctacaaaaagtataaaaattaactaggcatggtggtgtatgcctgtagtcccagctacttgggaggctgaggtgggaggattgcttgagctggagatcgtgccactgccctctagcctgggcaacagagcgagactctgtctcaaaaagaaaaaaaaatctggtgaaatgtgaggataatcttattgttttgaggctgcaagagtctctcactcttttttaattttggtaaaatgtacataatattagctttacaattttaaccatttttaagtgtatagatctgtggcattaagtacattcacattgttgtgcaaccattaccatcacatacctccagaacctttttattttccccaactaaactccctatttctcattcctcctagcccagcaaccaccattctttctgtctctgtgaatttgactactctatgtaagtggaatcatacagtgtttgtatatactgtataacatatagtatatgatatgctctatataagtgaaatcatatagtatttgtccttttgtgattggcttatttcacttagaataatgtcttcaaggttcatccaagttgtagcatatgtcagaatttccttcctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccttcctttttaaggctgaattatattccattgtatgtgcataccacatttgtttacccattcatccattgatggacatttggattgcttccaccttttggctattgtgaataatgctgctatttcatcatatgtttaatatcttaagaggcctgaactctgtctctgaagggtgtaagctgctgctgctgctttttctttctttctttctttttttttttttgagacagggtctggttttgttgcccaggctggagtgcagtggtatgatctcagctcactacaacctcaacctcccaggctcaagccatcctcccacctcagcctcccaagtagctgggactactacaggtgcatgccaccatgtctggctaatttttgtgtgtatgtgtatatattatacacatacaattttattatacttaaaattgtcatttcttgttgttcttgttgtttttcttggagtatagaaactataagagcttaataccagagcgagaatagcaaggcacctttaaaatctggtgaaggctgggtaaggtggctcatgcctgtaatcccagcactttgggaggctgaggcaggcagattgcttgagcgtagaagtccgagaccagcctgggcaacatgacgaaactccttctctacaaaaagtataaaaattaactaggcgtggtggtgtatgcctgtagtcccagctacttgggaggctgaggtgggaggattgcttgagctggagatcgtgccactgccctctagcctgggcaacagagcgagactctgtctcaaaaagaaaaaaaaatctggtaaaatgtgaggatatatataggatatatatatatatatatatatataaatacatatatatatgtgtattattttattttattttatagaatggggttttaccatgttgctcaggctggtcttgaactcctgggctcatgtgatctacctgccttggcctcccaaagtgctaggattacaggtgtaagccaccgtgcccagctggaatgtaagcttctgacggacttgggctaggactgtgaacttagcctctgatgccaaggagcaaacatggaatgaaagcaggccaaaggcccttttgcataatatggcagtaaggcaggaagggaagttcattccactttagagaggcagtgtttgaagcatgaggaagtttgccagccagagaaaatgggaataccttctgtgcagagtgaatacaaagatacaagggtgtgaatgtgcagttagggaatggggaagctttagtaatgagactgttaaggtggattgtgtcccttgtgaagggactcagacgacataaatcagttaaaaaaaacaaaactaacttcagtttttgaataggtataggattcacctggttcaaaatttaaaaggtaaaggtatacagtgaaaagtctccctttcccccttgaactccagccacccagtttccctcctcataggaaaccgatgcacttaagaaacccaatgtcttggatatgcttctagagatagtttgtgcacaatctggcagtaactagtcccctttcatacaaatgaagacctgttatactgtcttgtcctgtttcttgatttttttttcatcctttgcatgttttggggaacatttcttgcttgtatctacagaactttctcttcttttgacagttaaataatagtcccttgatggttgtagataatttattaaactagacccttatggaaggttatttgtgatctgttgctgtttcagacaacatggcaaagaatgacacaaatatgtcagtttacgtatgtgcaagtacatttacaggataatttctagaagaggaacatactaagcattggatgttagaaaacagagaaatcttgtattattattatttttactttattttactttaagttctgggatacacatgcagaacatgcaggtttgttacataggtatacatgtgccatggtggtttgctacacctatcaactcatcatctaggttttaagccccgcatgcattaggtatttgtcctaatgctctccctccccttgtcccccatccccctacaggccccagtgtgtgatgttcccctcccgaaacagaggtgtttaagctgatgtataaaattttggtaaaataatcctggtagtattgaggaagatagattggagcgctggtgagacactggggttggagagccatccattcaagcaagaggtagtaagagctgccttcaggcagtggtaggagtgcagatagagaaaagacacatctgcagcatgtgtagagtacaagagggagagggaggaaaaagaaaagataaattctagagatagactcattattacttaatttatatttggattcatagtgttctcgattttgaaaatgaatcagtaaagtaaatgttttaaaaataactaattggcccggtgtgatggctcacgcctctaatccctgcactttaggaggttgagatggtcagatcacctgaggtcaggagtttgagaccagcctggccaaaatggtgaaaccctttctctactaaaaatacaaaaattagccgggcgtggtggcgggcgcctgtaatcccagctactcaggaggctgaggctggagaattgcttgaacccaggacttggaggttgcagtgcgccgagatcgcgacattgcactccaacctgggcaacaagagtgaaactccgtctcaaaaaaaaaaaaagaaaaaaattactaatttattttcaggggagcactatgtggttattatctctattttacaggtaaggaaactaaggctgaaagcatttgagtaacttgtcccgagccagtaattggtggtgtcggagtgcaaatatttttattatgcaaatgagcttactttgagatgcagggcagaaaacctagaattcttattaaatctaaaagatctcatcaatgattttattgaagctgaatatgaaagaagtcatgccttaacctttttgatctcacttggaaaaagaaaaactaaatacaatagctggtagcatggatccacctagagagatgctgcaagaaaacacaatctagttgaagtgagagctcaaaggatggcgcataaggaaagggcttgaattcaggaatgccagtgttttttaatgactctgatatgtattccaagctgggagggacagatatctatgctagtaagaaaaaacagggtcaatcacttggtggctcatgcctgtaatcccaacaccttgggagaccgaggtgggtggaccacttgagctcaggagtttgagagcagcctgggcaacatggcgaaaccctgtctctacaaaaaatacaaaaattaggtgggcatggtggtgcacacctgtagtcccagctactcaggaggctgaggcagaagggtcacttgagccctggaggttgaggctgcagtgaaccatgatcgccccactgcattctggcctgggcaacagagcaagaccttgtctcaaaaaaaaaaaaaaaaaaaaagagagcgagagataaaacagtagggtaatctgtttatgatgtatgtgtggaagagtgcatactaaaatggtggcgggattgaatggtaggatttcaggttaaataattgttttaatgaaaaactttttctgaccatagtttgtgcttttaccctaacaatgaacatgtgccactttggaaataagagaaataagttccgtatttcccctccatcttttcgttattgtttgtactcttcccactgcctggagttgcccttcctctctcattagaatgggcccagtgcagatgtcactctcttcatgaagctcttcccaggctgctcagcaaagggaagctctctccctttgctgtgttactaaaatatttgactatggttgttatcatgaattagaactaattgtgttcgtgtctgtttccacccctcctttctctgacccccctacccagcttccaaatttgagtccgtagaatgagagtagttacagacttcaatgttgaattggttgcattttcagcactgcagtttttttttttccctgtcagaacaagaaaagatagataaaaattctgagtcatagaagaatgacttaaaacttccgaaggcaatgatatatctatgtaagccatatgaatactcttgcctaatttgggaactctctggagtaaacagggccataaataaataaaccatctctggaactaccatacctattacatctgtaaaaccaaaacatgattgccacatttcaactgacatataccagaagactctgtctctgaactggaagctccaacttgggctgttctaaagcttctgtaaaaaggcaaattcctcagttagtctgctgaagttatatactataatgatagcactagagaatgagaatgcaaaaatctccttttttctccttcttgtctagagattgaaccttttacttattcttgccagataaataaaccattcctcttctttttttttccaacaaatgttccgttgatctttccttttacatcttttttcttctttttttcctcaaagcaaccagtctggattaggctgattgttatcttctaatctctccttcctttccattactgccaagtaaatctttcttaagtatagctctgatctcaaaaggttcttgctcagaaacctatgccttgtccccagtcttccagattaatttaaattccttattctagctcttcagggctatcacatccctaacccctttctgattgtattatttctctatggagagcagaagtcagcaaactatagcctgtgtttttaactgtccaggagctaagaatagtgtttgcatttaaaaatattttgggaaaaaaacagaagatgaatattttgagacacaagaagttattcaaaattaaaacttcaggccaggcacggtggctcatgcctgtaatcccagcactttgggaggctgaggtgggtggatcacctgaggtcaggagttcaagaccagcctggtcaacatggtgaaaccccatctctactaaaaatacaaaaattagccgggcatgatggcacgcacctgtagttacagctactccggaggctaaggcaggagaattgcttgaacccaggaggcagcagttgcagtgagccaagattgcgccattgaactccagcttgggtgacagagcgagactccgtctcaagaaaaaataaaatacaataagaataaagataaataaataaataaataaataaataaataaataagtaaataaaacttcagtgtccgtaatgtctttttttttttttgagacggagtttcgttcttgttgcccaggctggagtgcaatgacacgatctcggctcactgcaacctccgccttccaggttcaagcaattctcctgcctcagcctccctagtagctgggattacaggtgcgtgccaccacacccggctaaattttttttgtatttttagtagagaaggggtttcgccatgttggccaggctggtcttaaactcctgaccccaggtgatccacctgcctcggcctcccaaagtgctgggattacagatgtgagccactgtgcctggcccacattgtctctagatctccagggactctctgctgttatatatctcccacctaaactcttagtttcagatggttttcatttatgaaccaaatatagacttgtgttgttctttaatgaatcattagaagtgaacttgatatttattgaggaatgaagataaaaggattgtagcttagtgtgtacgtgctttgcctgcactgtctttaatgcagttgtgggtaatgaggtttcaacaaaaggctgcatatgtgatgatggtaccataagataataatatattttcactgtaccttttctatgtttagatacaccaatacttacaatcgtgttacagttgcctacagtattcagaacagtaacatgctatacaggtttgtagcctaggagcagtggctatgccataaagcctcggcatgtagtaggctataccgtctaggtttgtgtaagtatactctatgatgttcacacaatgacaaaattgtctaaaagcacatttctcagaatatatccctgtcattaagcaatgtatgactgtacttaaaacagtgacaaactggataaaccaatgaactctctagtatactgtaattctctcaattctgactaattctgattattccttttgcctaactgggaataagttatctgagatggtatagcctaatttactaatgagtttggttgtccgtggcaactgttcaatatctaggctgcagtattgatgttttatattggtaagcaagtgaaacaaaaggaaatgaagttaacatttctataaaagtctttttcttgttttagaccaaaggctgtgtctaatctattaatgttctatgaagagcagtgatgaaatacaatctgcaaaaggcacaaacacaaatagtattgctggagctggtttacagcttattttctatcaatacatctcagccagcatgctctggaagtgctgtagctgttctcttctttcacttttcagcaacttcagaactgagtccatgcccagctcatatgtagtcacactaaattgtgtttgcagtagttgaaaaggaaaaaacattaagaaaaaaaagcctaaaggtgtaactttggaagtacagatatcataaaggttactcttttctatgagcattttaattggaggtcttgccatttgacacatgaatattataaaacttataatattctgcctgtggctgcctgtgagaaatgtgtttgtagcttgagcaaaggaatagagtgattttgcttgtagccttaatttaatgggtcagaatgtttattatggcctggagccaaattcaattactatattgtaaaagtgactgaataatctccaattagcaagcagaatggtcaacgttagtaaatgcatttaaagactttttgccggctgggcgcagtggctcatgcctgtaatcccagcattttgggaggccaaggtgggaggatcacctgaggtcgggggttcgagaccagcctggccaacgtggtgaaaccctgtctctactaaaaatacaaaaattagccgggcatggtggcaggcgcctgtagtaccaggtactcgggagactgaggcaggagaattgcttgaactcgggaggcagaggttgcagtgagctgagattgcaccattgcactctaggcaacaagagcaacgtgacactccatctcaaaaaaaaaaaaaagacttttgccattgtgttaccatttcaagttttcatcacacctgtaatttaaaaaatggggggtctacagtgttggtcagtactggttcaattttaaaagttacttaaggccaggctgactcagctgatcatgcctaagcaaataacagttaaggagctgaagccctagttaagcctaactgatcttggctgtggaaaccttccagcttctgggaagaaccaggacaatgggacatcagttggttagactgcatcttgatggtttatatgtgcccattgtgtacttgaagtttttcttgtccttcttgccatctgatagtgctgtagagttacagaatcacacaatataacagccaaaaatattagacataattgaatcccactctcattttattttattttattttattacttttttgagacaaagtcttgctctgtcacccaggcatggcacgatctcagctcactgcaacctctgcctcctgggttcaagcgattctcctgtctcagcctcccaactagctgggattacaggtgtgcaccaccatgcctggctaattttttgtattttcagtagagacggggattcaccatgttggcctggctggttcaaactcctgacctcaggtgatccacccacctcagcatcccaaaatgctgggaatacaggcgtagccatggtgcctggccccactcttcttattttaaaaagacacagtatggctgggtgtggtggctcacactttgggaggcggaggtgggaggattgcttgaggccaggagtttgagaccagcctaggcaacatgatgaaaccccacctctactgaaaatacaaaaattagctgagtgtggtggtgtgcgtctatagttccagctactcgggaggctgaagtgggaggattgattgagctcggaaggtcaaggttgcagtgagctgagattgccccactgcagtccagcctgggtgacagagcaaaaccctgtcaaaaaaaagaaagggaaggggaggggagggggaaagaaagaagggagggagaaagggaggcagggagggagagagggagggagggaggaaggaagggagggagggagggaggagggaggtttaggattagagtgtaggtgtgctgagatcatcattactatttgagtgataattgaagcaatgtcacttatcttgggtaatacccgaggttcattgctggaaatcaaggatgtgaacacaccagagtgaggttaagagtggaagtttaataggcaaaagaaagagaagagctctcagcccagagagggatcctggagaaaaatgggttaccagttccatgatgaaatgcacggagttttataaatgagcttgaggaggcagtgtctgatttacatagggcccaaaagattggttggaccaggtgtgtcatttacatagcatgcaaagaagctaatgttttattatgcagatggttctctacctggcctgcatcatattgcctgtttctttattgtacacatggttgaaaaagaaaagggaagatggagcctccatgttgaacatgcctggcccccaggtagccttttcctattggcatagctgctggcattcacccatgcaagttttagcatgcttttctatgtctgcagctcgatttttcagggtggtctttgttagaaaagaaatgatttgggggctgctttttattaaaagggaaaccttgctgagaactcttttaccctcaccaactgcctaaataatttctttctagcttctgcatcaatattaggcaaattgacaaacttctctgtgactctgttcctcatctgtggcatgggatagtaaatggaacccaccgcatgggggagttgtaaagatttaatgagatcataaagagctcctgacttacagcatgtgctaaatgaaaaataattttttttttgaaggagaaaactgaaatcacaaacgaatattgcaatggcagagaaggaaaaagggactaatgtttatttagcccttgttatctaccaggccctattctaggtgatttacatatgtattacatcatttatctctgagagagatgttactttttccattttactgataaggagactgaggctcaaagagattaagtaacttgccagaggacacagatctggtaacagcacagtgaggtgagattcagattgctgcattccaaagccccagttctttttccactattccattaccttccaagatgaggagtaggacctcattttcctaacatgaaaatgggttgcatttcaaaaattcgtttacaagttggttgtttggagttacttttccatggagacaatgttacatggttacatgcccaggcttatctgcaaaagctataatgtaactgaaattctgcacatttgtgaactgaaactattaaggaaaaaaatgcatttgcagttctagctataagcagaaaagaaaaaataaggatgcattttaaattctgtggaatgagaaaagcacgttcggttagagggcagtgagggagaagatggggactgtttttattctggtggggctctgggatactttcatggtattcacacatatttccttttaaaaaataattacatatgcaagagataggacaggtggtagcgttgacctaatttctgttggcaatatttagctttccgttttaaatatatttacccatttttttttttttgtaatgacatgtgggagcccagctagtcaccctcatatagtcatagagtattaaagtttatagatgtcatgcctgtaatcccagcactttgggaggccgaggtaggtgaatcatttgaggtcaggagttcaagactagcctggccaacatggtgaaaccccgcctctactaaaaatacaaaaattagccaggtgtggtggcgggcacctgtagtcccagctactcaggaggctgaggcaggagaatcgcttgaacccggggggcggatgttgcagccattgcgctccagcctgggtgacagagcgagactgtctcaaaaaaaaaaaaaaaaaaaaaaaaatgaagtttatggatgtgttgaagaaagaatgaagataaaaagaatgttttcctgagtgaattgtataagaatttgaaggaattgaggagctaaagagcatgtgcgcacagatatgaaaatgataaaattaaattttcatttcatcttaaatcttcatcattttacttcagttggcatttaatttctgagcatatgctatgtgccagtcaccatgtgtcatggctatgagggaaaaaaacagtcacagacccttagtcacaaatttgcaaaagaatttgctttgtacttgaagcatctactagagattatattcagatcatccagtgatgttttcctctttatcggtatttatgaatatgtaaaggttacttaattataactagtgggaataagactgagggtttttttgtttgtttttgttttttaagacaggatctccccctgttgcccaggccagagtgcagtggtgcaatcatagcttactacagcctcgatcttctcagctcaagtgattctcctggatcaccctcccaagtagctaggactacaggcaagagccaccacacctagttaattttttattttttttattttttgtagagacagggtcttgctatgttgcccaggctggtctcaaactcctggcttcaagtgatcttccagccttggcttcccaaaatgctggaattataggtgtgagccactgctcccagccttaagtaatcttttttttttttttttttttgagacagggtttcgctcttgtcacccaggttggagtgcaatggcgtgatcttggctcactgcaacctctgcctcccgggttcaagcaattctcctgcctcagcctcccaagtagctgggattacaagcatccaccaccatgcccaactaatttttgtatttttaatagagacggggttttaccacgttggccaggctggtctcgaactcctgacctcaggtgatccactcaccttggcctcccaaagtgctgggattacaggcgtgagctatggcgcctggcaagtaatctttttaataactaagaacactggaaaaactagaggagattattagtaaaaggtgttcattttattttcccataattattgcttgatttcctgtcactagtcaggactaaaaggtgggagatgtgggacctttgagttctgttacatagcatttgcttatgtatgtttgcaactaaaatggaaactttaggctgggcacagtggctcatgcctgtaatcccagcattttgggaggcccctggagtagttgggactacagctaggtgccaccatgcccagccgatttttgtattttgagtagagatggggtttcaccatgttggctaggttggtctcaaactcttggcctcaagtgatccacccacttcggcctcccaaagtgctgggattacaggcgtgcctccatacagaagaattttttttttttttgagatggagtctcgctctatcacccaggctggagtgcagtggcgtgatctcggctcactgcaagctccgcctcctgggttcatgccattctcctgcctcagcctccctagtagctgggactacaggcgcccaccatcatgcccggctaattttttgtatttttagtagagacggggtttcactgtgttagccaggatggtctcgatcttctgacctcatgatccccctgcctcagcctcccaaagtgctgggattacaggcgtgagccactgcgcctggccagaagaatcttgagttgagggggaggatgaagtgtttgcacattagaagcttagtcatggtatcttcataaatggggatctggtgagcaaggttgctctgctaacatttatgtagccttaactgacagactgagtctcatattgggttagaataaacagctgctgccaaggaagcttaacattggttctaaggaaactatgtggcatcagataagcttgcttgacatcagaacttgccactgacatggttcatctgctgcctagcctatgtgattgtgttctcattgatgcacatttaaattaatattttgggcaattggttaaaattttgacctttaggccctagaggtttctcatgactttatttatgaagaatattgttgatgcattttagaatttaatttgtgtttttttctgattatgaaggcaatacatagttgatttaaaaaaaatactctggaaaaagtatagaaaaggattaagaagaaaataaaaatcacctgaaattctacttcccatggtatgtttgcttccagttattttttcaatgtggatatatatttgggagagagtgggatgtttccttattagtgaaatagctgaggcttcagtaaaatttcacttaacactcatgatattgagatgtttgcctaatgcactgtgctaattaaggttgtttgtttaatcaggtggtacaaattctgatgccttaggagccaaataggcaatgagtgaatcaggccagttataagcactggggagtgatggcaactgtggttaactggaaaatgccggccctaactgaagaagttactaccatcttcaacttactgttgtcacatggaaacaggggctaatgttaccaaatcttcctaattgtcaagaaagtcccagaagtctgtttctttttaatgtgaaatttctcatgttaaaaaatactgtgcaggtcaaacaaaatagtctgtgtgttgcacttggcccatacactggcattttttgtcactcctgacataaatgcttctcaatctttctcatagctcttacaagaagagcacatttattaaagaaaatgttgggagaggagtttatgcataaggagtttctgagaatggcttcaggaacttttccgtctgagagggttgcttagtatagaaatgataaactcagttacaggaatcaggtggtgacataaatgagtaaaatgaattgggattaagattatgagtgtggacatggtacaaatgcgctgtttgggacatttgggttccagtaatgtttttccttgatggaatgcagatccaaattgctgccagaccttctaagatttaagagatgtcagaaatttggatctttgtgaaatttcttgattttcaactcatttatgcatagtgttccattattggaacgctaagcttgtgggagttatttatatcctactgctcaaggtcatcgccaaggtctgatttttcacacaaaaaaattgcaacctctggcacaaatgggttaaaaatactatgtggaccaaacaaaaaccatccttgccccaaattctacacaaaatccactaatttgcagctcttggcctagatcactgtttcctacatatgtcctagaaatcctaattctgtcatatattaataggtgctaagaaataaggaattcttggtcacatgaatttggaaaatgatggattaaacaaaactgaacacatttcctgactgaaggttatcatagatcctcaattatgctaatgtgccttgtaaattcctaagaagatatagcccattaccccacagttacagttaggtcaccatctccacttgcttcccccaccaccccccttgtctagggtaagagtggctttcctcctggtaaaggttagtctctgtatctctctccagattcttaccctgtctcttcagggatctgacttcagaagaaatctatttcctgcctcttgtcctgtagcctatcagtatgcttggttttctccagtttaaaaaaaatgacgaccttttcttataccatacacaaaaattgactccaaatggatcacagacctaactataagagctaaaactataaaattcttagaataaaacatgggagtaaatcttcatgatctcaggttagatgaagccttcttaagtgttacaccaaaagcacaagtagcaaaagacaaaacaaaacaacaggaaaaaagcacaagcaaccaaaatcacaaacaacaaaagaagacaagctgggctgcaatcccagcactttgggaggccccgcaggcagattacttgagcccagaagttcgagatcagcctggtcaccatggtgaaaccctgtctctacaaaaaatactaaaaattagccgagtgtggcccggcacggtggctcatgcctgtaatcccagcactttgggaggccgaggcgggcggatcacctgtggtcaggagttccagaccagcctgaccaacgtggagaaacccagtctctgctaaaaatacaaaattagccaggcgtggtggtgcgtgcctgtaatcccagctacttgggaggctgaggcaggagaatcacttgaacctgggaggcagaggttgcagtgaaccaagatcacgccattgcactccaacctgggcaacaagagcaaaactccatctcaaaaaaaaaaaaaaaaaaaaaaaaaaaagccgggtgtggttgtatacacctgtacttccagctactcagggggctgaggtgggaggatcacctgagcctgaagaggtagaggctgtggtgagctgtgatcatgccactgcactctagtctgggcaacagagactctgtttcagaataaaaaaaaaaaaaaaaaaaagaaaaaggaaaagacaagctatattttagtcttaaattggcctttatcaaaattaaaagcttgtgctgcaaaggacactatcaagaaagggaaagacaacccacagactgggaaaaatatttgcaaaagataaataactcaaaatattggcaaggggccaggcacagtggctcatgcctataatcccagcactttgggaggccgaagcaggcagattacctgaggtcaggagtttgagaccagcctggccaacatgatgaaaccctgtctctaccaaaaaaatacaaaaattagccaggcatggtggctcatgcctgtagtcccagctacttgggaggctgaagcaggagaatcgcttgaacccgggaggcggaggttgcagtgagcccagattgcaccactgtactccggcctgggtaacaaagtaagtctcggtctcaaaaaaaaaaatatatatatatatatatatattggcaaggtatctgaatagacatttctcaaaagtagatatataaatggtcaatacacccataaaaagatgctcagcatcattagccatcaggtcaaaaccacaatgagataccgcttcagtaggagggctgtaattaaaaagataataacaagtgttgccagggatattgagaagttggaaccctctcatgtagctgctgcgaatgttaaatggtttagcctctttggaaaatagtctggcatttcctcaaatggttaaacatagagataccatatgacccagcaattgaatacctaggtttataaccaagagaaatgaaaacatgttcatacaaaaccttgtacactaatgtttatagcagcattattcataatagcccaaaaatgaaaacaactcaggtgcccatcaactgatgaatggacaaaatgtgatgtaaccatacaatgaaatatgatttggcaataaaaagaaatgaagtactgatacatagcacagatgaaagaagctagtcactaaagagcacatcttatgtgattctatttatatcagatatttagaataagtaaatctgtagagagaaagtagattagtgtttacctaagattaggtggtggtgaggaagggttagggctaaatgggggtggtgttgactgctaatagttactaggtctctttctggagtgatgaaaatgttcacaaatcaattgtcatggttgcacaactctgtgactgtcttaacgacaccattaacctctctgtggcagttgacactattgactgttcctgaaattcttctggcttttatgacagagttctattgatccccctgcccctatctctgatattttctttccagcttttttcaccagcttgttcttccaccagctacttatctgttggtggtgttgggtcgtgatttcattcattatccatggcttttagaacgtctgagttgcctgttacttgtgaatcaatttttctagtcccggtaagtgaactgaggaaccatcttttcagttgcttattggacaactccctctgaatatcccagtgctaattactttccctctcagagctggttttcttcctatgttaccaattgacccagtcacttgagccaggggctgggagccatcctagatttctgtctcaccctccacatggagtgtcatgtggctgccttttttacacctgccctctcatctccattcacactgctgctgcttctgctacagttaatctgtagtttatctttcactaagactgtaagctccatgagatctggggccatgtgtgttttcttcatcactgtctgtaatgcttggtacattgcatgttatgtaagtaatatttgttgattgaataaatgaattcacaaatgaacttgtcttccgagttttcttcgctctgatccattcttgctgctgaatttttctgtttgaaatgcagacctaacaatgtcttttacttagaataattaaataattccccattgcttagaggataagtctattgcattgcatacaaggccctccatgatgtggcccctttctgcttttccaatttcctgtcctctccacatctcctctctacccagtaccccattttccagctatgtttcctgagctggccatgctttcccatatcttgccctattaactagaaagccctcctttttaccttgaattccattacttctggagaactcttattctgccttcctagagtttctcttcctctgtgaaacttcctgtacctcacctacgcagagcagaaacttggttgtaactctactagagcatgcattacactgcattgccttatttgtttaagcatttgtcaacgaacaacaaggactgagtctcacttttgtatccccatcacacagtgacagacacagtgcctcccacatgggaagtactcattaagtgcttgattaaatgaataagttggaaatcagagtagattagagagttttagtttttctggatgtggcctcttaaacactgaactctggctggccatctgtgaatgatgtacaaaggatatcagtgaggggtggatggatcacaagttcatcaccaccccagaaaaacaatcaaaagcattgctgatgatgggtcacttacattattattatccttgtatgactgaggcctggtactgggcacagctgcaatcagaatggttgttcagtataatggattgatcaggctaactgttatgccatgacattgatttgagccacagtaagtacaggcaaatgggtacacattcttaagtctggtcacaatcagttggtcacaacctattgtctaaatacattaagaacatcttcctaccacatttttaatgtaatgttctttagttacgacttacattgtacaaataagtaacacaagtcttctcagctttgttttgtctttctgttttcttgtacttagtctagctaagggagacatctacattaacatattttttagtctaggtagtgacttgaaccagccaaccttttttttctttctttttttttttttgctggaaagaaaccaaatctctctacattaccaaaccaaatcgagtagattgtgatgaaaggagtaataataacaacagcagaagacaaaaggcctctcacatagaattttgaactaaagtcacatattgaacaaaggatatttaaattaactactgaacaaagtaagagctcttcaaaagaaacagagctccctgccaagccccctaaaaatgcccccaggcctcttattcattcactaccattatttcagtttatatctaaagatgttttatttcttatctcattctcttcccaccacctagtggacacatagttggcacttactgcttgtttattgaattgaatggaatctagccccaagagttaaaagctattctctgaagaagaaaataaaagagaaataattttgtcagtgaatagaaataacaagtctgagtttctctcggcaatggaataaagttaggaagggataacacgtacagttggctctctgtatctgtgggttccacacttctgcatttagccaactgcggattgaaaatattcagaaaacaaggatagttgcatctgtgttgaacatgtacagattttttccttgtctttattccctaaacaatacagtataacaactatgtacatagcatttatattatattaggtattataaataatccagagataatttaaagtatgtgggaggatgtgtgtaagttatattcaaatactatgctgttttatataagagacaagcatctgtgggttttggtatttgaagggggtcatggaaccaattctccatagataccaagagacatgactatatttattataaagttagattactccaaaagggttgtttttaaatactgacccagagaaagctaattagactataactaagatctgtttgttcttttctctgtttttgtttttgttttttgttttttttagacggagttttgcttttgtcgcccaggctggagtgccatggcacgatctcggctcactgcaacctctgcctcccaggttcaagtgattctcctgtctcaccctcccgagtagctgggattacaggcgcccaccatcacgcccggccaatttttatatatttagtagagacagggtttcaccatgttggccagtctggtctcaaacttctgatctcaggtgatccacccgccttggcctcccaaagtgctggattacaggcgtgagccaccgtgcccagccactctgtttttttttaaccctttaatccataggacttttttcagaaggaataagatctattttaaggcataaaaaaaatgaggcatcagacagatgtggtggcatgcacccgtattcccagctacttgggaggctgaggtgggaggattccttgaccccagcagtttgagtccagcctgggcaatatagcaagaccccatcttaaaaaaaaaaaagtaaaaaagaagcatttgttgattcttactgacctgtttgcaaagttgtagtctacattgggaatcatatttctccatactaagttgacctcgaagaataacattttcccaccagctatgaagattcctgttagttaacaaaagacattttgtgaattaatccctttcttgtttgttctactttttttctttttcttttttttttttcttttgagatggagtctcgctctgtcacccaggctggagtgcagtggcccgatcttggctcactgcaagctctgcctcccgggttcgcgccattctcctgcctcagcctcccgagtagctgggactacaggcgcccgccaccacgcccggctaattttttgtatttttagtcgagacggggtttcaccgtgttagccacgatggtctccatctcctgaccttgtgatctacccacctcctgaccttgtgatctacccacttacgcctgggattacaggcgtaagccaccacggctgactgttctactctatttttatttggaaaagatgggtgctatggaaattttctgttttgatggtgacaggagagtacaggaaaatgcattttctgtcatcaatgggttaatggcttaaaaattaaagatttgtctttggttctcctagacaggctttgccagttgttctcaaataggacatacctttctgcttctgtagatctttacaaagtggttctttggaagttctcgacttgttattttggtgatagaacactaaattgtaaagatctagaacagaggatgacaatctttgaataaatgggcaggtcaaggtaacataatcctctctgccttcacttagcatacaaagtcctgaactaactgaactttcctttctagcctcatttcctctgctgaagccacaccagcgtgtctttctagtcctggcctccttgtactcgcatatctgactgaaccttctttgcctgtgctcttctctttgtttgggctgtctgattcttctctactgggcagcttctcctttccaggcctggctccttttttctaaaagaccacataggaaaggaataaatgaaggttatagtagctgtgtgaagaatgaattggaagagtctggagcaacaagaccagttttaggatacagtgagggtctcatggatctgtgctgcctgatatggtagccactagccgtaggtggcaattaaaatgaaataaaggtaaaaattcagttcttcagttatactggccacatttctttgtttctttttcttttcttttcttttttttttttttttgagacggagtctcgctctgtcgcctaggctggagtgcagtggtgcgatctcagttcactgcaacctcctcctcccaggttcaagcaattttcctgcctcagcctcccaagtagctgggattacaggtgcctgccacacccctggctaatttttgtatttttagtagagacggggtttcgccatgttggccagggtggtctcgaattcctgatatcaggtgttccacccgccttgaccttccaaagtgctgggattacaggcatgagctattgcacctggcctatgctgggaacattccaagtggtcaatactcacaggtggctaatgggtactgtattgggcggcacagattaaatagaatatttccatcataaaagaaaattatttggacagcactgccaaaaatcaattccccaagaaaaaatggcattcattctatatagtcatgttttatgtgttgtaccttaaaaacagtgccgttcgttgtccctaatctaattctagccagagtgtattgagcaatcatggatactattgcttcaagtatgaatgcagcttagaataacaaaatcacatttagtgtttatcacttaagtattcaaaaatagcatttaaataaatgcccttgaatatatttttaattatccatttatctttccttacctactcctactcttacaaagaggcatcaattaattacatgccattcagtttttagtaattacctctactgaggtcagaatatatgctatttacaaaactgttttaatgtttttgcctggtgtagccatgattgctttatctttggataataactgtttgccatatatcagccttctagcattgctacctttgaaggctttttatttcattgatttagaagtgatttttttttttattttttcctttttttgagacggtgttttgctcttgtcacccaggctggagtacagtggcgcgatcttggctcactgcaacctccgcctcccaggttcaagcgattctcttgcctcagcctccggagtagctgggattataggcatccgccaccacgcccagctaatttttgtatttttagtagagacagggtttcgccatgttggccaggctggtcgcgaactcctgacctcaggtgatctgctctcctcggcctcccaaagtgctgggatttataggcatgagccaccacgcccggccacgtggtttttatttctttacctcagtctagtcttcatcccccaccccaccccacccagtccaagagcaagtcctaataatatttcttccgtaaaaaggtaacacaattctattcttttctccatttctgttttcactacttaagtagtgaaaccttaagtcactactatcactctcccggctgactgcagtagcctccctgcaatcatctaggagagtgatactggttaccctgctctcccctcaccacctaaaaataggcaaaatgaccttttaaaaagaaaatcaggccaggcgtggtggctcatgactgtaatcccagcagttaggtaggcaaaggcaggaggatcgcttgagcatgggagtttgagaccagcctgggaaacatagtgagaccccatctctacaaaataaaaaaaaaaaattagctaggcgtggtgtctcatgcctggagtcctagctgctccggacggaggatcacttgagccctgaatcacttgagctatgattgcaccactgcactcaagtctgggatatggggccagatcatgtctcttaaaaaagaaaagaaaagaaaagaaaagaaaaagtcagattaatctcttgtttagaactcctgcctcctattgtactgataaacgattccaaatatttcaagctggcctaaaaggctctttatgatctggcccttgccttcttacccagcctcattaccacaccatacttccctccctccctgaggttcagccactctggcctctttccagttcctaaaatacacccaatcttttcctgcattagggcctttttctggctgctccccctagattgttcttgcctagctctttcatgagtgactccttcttagtttcaaagtctcagctccaattttgcttctttgtctactctttccaaagtaagctcctttgtttccagcccgtactctttattatagcatcattcttaccattatctggaatcatacttgtttatttacttgactctctgtctctccctactagactgtaagttccgtgaaggcaggaaacttttttttattctctactccatctctactacctaaacagtacctggctcatgttgttgtgctaaaagcaatgtttaataacactgaataacttactattttctaaaggaaatataagaggaactcacctagttctccctcccacgcttgctctctgtgtctgtgtccctccttccccccacatatataaaaggaatctctctgtgtcttaaatgtgaatatctttctaggccctttatactgaatgtgaactagtgactttgtggctgaacttcatcttttacttcatgaaatcatggccatagctttttgaatggttagtttcagttggaaaacatagtgaacaatacatctggaaatattctgtcatgttttgagctgagaaactctagagaaccagctgctgatttaaaagccttttattatgatacagacagtctattgtctataaaagcattggctattacacagtggtagatatgtgttgctttttctagctattaacttgaaagaaaaaacttgtattcataatttatgcatgacttatattccctgagaatagtttattgtgttattttctttagctgatttactgagcatttagagattttttgagacagggtcttgccctgttgtccaggctggagtgcagtggtgtaaaacactgctcaccacagccttgacctcctgggcttaagtgatccttccacctcagcctcccaagcagctgggaccataggtgtgagccaccacacccgactaattttgtgtagagacaaggtctcactatgttgcccaggctggtcccaaactcctggtttcaagtaattctctcaccttggtctcccaaagtgctgggaatgataagtgtgcaccactgtgccagccaggatttttcttactccatttttttttcctttaaactcaatcaaaagttaaatggttaaatagtaggactgacatattttccattctgggtttttttaatttcacagatttctacattaaaatatggtttataaatatgatttagtactcttaggtggctttatattgttaaaatgggtgaatttcaccatttactatattaaagtttactcttatattttataatacatgaatatagtggaagaaaaattgacattcaagacctgcatagagataattttgaagaaagtgaatatgtgtatgattagtggtataatacacacataatttggtagtgtgacatttaatattttgataatttaaaaaatttctgaccattactatttggaagatctatataaaatgacagataattgtgtactgagattattaggtaggaaataattacaactaaataacttaggctgggagtggtggctcatgcctgtaatcccagcactttgggaggcaaggtgggtggatcacttgaggtcaggagttcgagaccagcctggccaacatggtgaaaccccatctctactaaaaatccaaaaaaaaaaaaaagattagctgggtgtggtggcacatgcctgtagtcccagctacttgggaagctgaggcatgagaatcacttgaacctgggaggccaaggtttcagtgagctgagactgcgtctctgcacttcagcctgggcaacagagtgagactctatttcaaaaacacaaacaaaaaataacaaaacaacttacagtaacatttttgtgtttttaaattacaaaaattactttaaaatttacatttcaggaaattagaaaataggaaacgcagatacaaattcattcaatttcctaagcattagtacaaccagtagaatattttaaaaatgttctttcggtgttgttgctttatttatacatgtggattttttttggtgttgtactcataatgtatatttcttcttttaagtgaaatataatgtcataaacattttcctataatgccaagtttttataaccattgttttaatggcccacatagtactcaacctaacgatatatcttaatttacttaactattcctctttgttggaggagttatttatgaagtgttttagcttttataactgtcatcttagtgaatacttttgtgaatattgtttttattatcacatttggcattactgcttataaggtatattctcataagtggaattcccaggtatgactttttttatgtccgctaacaaattctagcaagtgattttccaaagagaatatgtcagtttatatcaccacctgcagggtgtaaaactacctattccattgttgcattcagcattatatattctttctttttaactcgcactataattagggaaaaatatcatattgttttaatttcagtttttttgattactagtgaagttgcatattttcatgtttggtttctagtgtcagaatcataatagcttcaaatatttttcccagttccaataacttcgtttttttctgtatagatagttttgtctgtctaacttgattcatgtacttcatgtaacattttagagatgtggcctagttttttggcttaaatacacacacttatattctcaatgatgaatttctcctattatgctcagtaatgctttcaaattagttattctgaagaaggagtaatacaacattatgtttgtattccatattgttattctagtatattgtgaaggcatattatgtgagtaatcctaaaaaattttttaaatccagaaatctcccttaaatctagaaactttaatgatagattatgtttaagtatatgtttcaaatatgcttaagtaatagttttttaaagtctgagaatttatatttgaattatgattttttttcctcttgtaggttggaaaagagactgttcaaaccactgaggatcagattttgaagagagatatgccaccagcatttattaagtgagtaattgaaatattcttctgttgctaagcagaataatactcttgttaggaagaaaaagtagctgatttcagtaacaacttttttttggtataaaacttttgtttacaattgaaatttcaacttttttgtcttctaacttttttaaaaaaactgttcattttagtttttgatattaggcatttttgacataataattttttttttttgagacggagtttcaccctcgtcacccagtttggagtgcaatggtgcgatgtcagctcactgcaacctctgcctcttgggttcaaatgatttgcctgtctcagcctctggaatagcttggattataggcgcgtgccaccatccctggctaatctttgtatttttagtagagatggggtttcaccatgttggccaagctggtcttgaacttccgacctcaggtgatccacccaccttggcctcccaaagtgctgggattataggcgtgagccactgtacctggccaatttttgacataataatttttaataagaccatgagttttgagtttttctttccaaaatgaaaagtattcagagacccactgtgactatagcatgcatgaatctacattgtatactaggcacctttgcttggagataagggaataatggtagatataaactttaaaaaattattgttttggccgggcgtggtggctcatgcctgtcatcccagcactttgggaggccaaggagggtggatcacctcaggtcaggagatcgagaccatcctggctaacatggtgaaaccctgtctctactaaaaatataaaaaaaattagccaggcgtggtggcgggtgcctgtagtcccagctatttgggaggctgaggcaggagaatggcgtgaactcaggaggtggagcttgcagtgagtggagatcacgccactgcactccagtctgggtgacagagcgggactctgtctcaaaaaaaaaaaattattgtttcatattttcagttacattttaaatttaagttatatttatatatctcctagtattcctaaaaataatttccaggctttttgggctattctgcataaaacaagcagacatactaatttttgaatacttaaaacttcttaggttcttatattgtctttgattagtggttttgttctatatggcagtcaagttgtaagcaaaagtaaaagctgatgtgtaggacaaaaaaaatagaactcatagaagtcaataagaataacataagactttccaaaaaggtgtttgaaggacttgaataggcacctcaaaagaggaaatttaagtggccaataaatattttatttcagtcatcagagaagtgcaaattattttattatacaccccaaattaagaaccctgataatattagttgttgataagatgtggagcaactggaatgttcttacactgctgttgggaatgtaaattgctgcagccactttggaaaacaacatgacatcagtaaagtagaagataagcagttccactgtcgggtatgttccctaaagatactcgtccacatgcacaccagcatccatataaaaaacatttctatcagcattgttcatgatgaccccactggtctatctagagtagaatggataaaataatcatggtgtaatcagaaattgtaatattaatcagtaatgaaaaggagtgaggaattttcacttaaaaatggttaattttatgctatatgagtttcatttcaattgaaaaaaacaatgaggccaggtgcagtggctcacacctgtaatcccagcactttgggaggccgaggagggaagatcacttgagcctaggagtttgagaccagcctgggcaacatggtgaaaactcatctctacaaaacattagctccgtgtggtggtgtgagccgatagtcccagccacccaggaggctgaagtgggaggatcacctgagctggggaagttaaggctgcagtgagctgtgactgcaccactgcactccagcctgggtgacagggtgaaaccctgtatctaaaaataaataaataaataaaaagacaaaaaaagagaaatgaatgaatctcaaaaataattgagggaaatgaaaaacagagagacagagagacggatagatagatagatagatagatagatagatagatagatagatatgtaggttccacttatttaaagttcaaaaatggccaggtgtggtgactcacacctgtaatcccagtactttgggagaccaaggcaggtggatcacttgaggtcaggagttcgagatcagcctggccaacatggtgaaaccctatctgtactaacaatataaaaattagccaggcgtggtggctcacacttgtaatcccagctacttgggaggctgaggcgggagaatcacttgaatccgggtggcggaggttgcagtgagccaagatcaagccactgtactccagtctgggtgacagagtgagactctgtctcaaaaaaaaaaaaaaaaaagttcaaaaacatgcagaaataaactatgttgtttagacatgcctatttatatggtaaaaagatgaagatgagtaagtaataatggtcaccacagccagggtagtcctacctctgggagggaggaagaggtctatactcaggaagaggtacacaggggcatctaaaagtggtaataatgttctatttttgatttaagtgatgagttacatgggcggttgttttatatttatgcattatattatacatatgtttattttctctatgtatgttaaatatcacaactttaaataaagctaaaagtgttcctttatttttatcctccttatgttctattattttcattgaacagatgtaaaattctcacccatattgaaatcttcttatttctacctgagtgggtgctttatgcaactgtgtttctgttaattccataaaatgtcttcatgtgtcaggaagtaaggtgctagaagcatctgtttttttgtacagcctgttttgtgggagtatcttttttgtcctaccttcattggacttggtgatctcaaggtttcttcgagctctgatcaacatgagcctattttgtttacatgccatccgatcagcctggtaatatatatatatttttgagacaggctctcactctgtcacccaggttgaagtgcagtggtgcgatcatggctcactgcagcctcaattgcccagacttaagtgatcctcttgcctcaccccgagtcgctgggactacaggtgtgtgccactatgcccggacaatttttaaatcatttgtagaggtaaggtctccctgttgcccaggctggtcttgaattcctgggctcaagcaatcctcctgcattggcctcccaaagtgttgggagtaccggcatgagccactgtgccccggccttagcctggtaatattaagaggaatcttatgctgtcaactaaacatattataattaaacttgcatttaccttacattaaaaacatagctctagcttgtagcaggttgcccctcaccccttggaagatacagagcacggggaatgagtgagtacaggtttcactatcgggtaggtagttggactagaagaccttacaaacaattgcttccaaccctgacattctagtctatgaatatgatttgattggtaagtggattttgtcaggaaacttatttttgcttatccccagagacatattctgaaatatgctatgtgctttcacagacttctttggggacttagaaaaattaaaaatgagcacaccctagttgtgataaaaatttcaaaaaatttggtcactttaaaacaaaataaaactttactgatcaccctgtgtggtaactagggcatcaaccccttactctaataattggtaatttaaaggaaattaagcatttatcttgcctttcctgtacaaaatttttagagtagcccaatagccctagttgtaaggtgaattctaaccaataaatgtggaagacatgacagaattaaaaaatcattgatcgctgggcatggtggctcacgcctgtaatcccagcactttgggaggccgaggtgggaggattgcttaagcccaggaggtcgaggctgcagtgagctgtcattatgccactgcactccagcctgggtgacagagtgagaccctgtgtaaaacaaaacaaaataaaacaaaccgtgatggatttttatgtttgcttttcttgtttttctatagaatgcaaaatgaagcagaaaatagtagatgccttgacttggaaaagacagggacagagaagggggaaacagatggaagcaattaatgacatccttggaactattgagtaggacattcttttgagctgcttggttgatgtttagaaatttctagggcatgaccgactgaaacttcctctgtagtctacttttgcaaggacttctcaagtgactgcttaagcaacactaaaggctaaaatatttaaacatttattgttagatcagtctgtactcctagaatgttaagatgtcaaggctagagaaaacagaagatacttggcctgtagatagatttatacctaagctatctgatatatatttaaagatttttcagggaaagatatgatacttttaggatttggggatctcaagatcctatcataggctatttgtgtgattggcaattagggcatatggaaaaatgggtttaatacatttaaaatgatacaattgtcgatgaggaacttccagtgctcaggcaattccttactgtaaaagtgagagccattttaatatagaacaagatttgcatggtcacagcctttctcttgggtggagctaaagttatttgatccctggctgcactggcagatagagctcacaatttactaattttacccaagactgcaataatagccacagtgttgcataagaggtgtagggttgcatggtgattgccatcgaaactgcccagattgtcataaacttcaggagtgcagcagctatgctgtattgttaaaatgttggttagactaaccttataaccctataagaaatcatttgttcctggctgggtgcgctagctcacgcctataatcccagcactttgggaggctgaggcaggtggatcacttgaggtcaagagttcaaaaccagcctggccaacatggtgaaaccccatctctactaaaaattcaaaactagccgggcgtggtggcacatacctgtaatcccagctacttgggaggctgaggtaggagaatcacttgaacccaggtggtggaggttgcagtgagccgagatcatgccatgcattccagcctgggcaagagcgaaactctgtctcaaaaaaaaaaaaaaaagaaaagaaatcatttgttccttttgagactgtcagcaggggagtcagctactgtactccatgtttacattttgtatcactgtcagttgtcattttcttcttcgtcatcatcatcatcagactgctgtggcagtaatgttttatatataattgattaatgggctagacatgctccttggttaattatttactgattgccttctatgtgcctagcatgctgagtgctgtttatagaatagtagttcctaccagtgtgtaatgaatagtcacttgtgagatatattgcaaataatatattaacagtaataaagtgccagaggatactaatgctttgctttaaaagaaaaaattaattgagaggtcaggcgtggtggctcatgcctgtaatcccagcactttgggaggccgaggcggggggattgtgaggtcaggagatcgagaccacggtgaaaccccgtctctactaaaaatacaaaaaattagccggacgtggtggcaggcaccagtagtcccagctactcaggaggctgaggcaggagaatgcgtgaacccaggaggcggagtttgcagtgagctgagattgcgccactgcactccagcctgggcgacagagcgagactccatctcaaaaaaacaaacaaacaaacaaacaaacaaaaacttaattgagcatatttaagttcacgtgtataataatatccctctcattccttctcattatgtttttttttaaactttcattgaagtataatatgcttgttattatgttttctttaatgggagataaaatagtggaactacagctattgtggctgggaattatgcataatcccaagtagacccatggggatatgccataaacttgagttttatttttctatatatgatggcagagcaaaagtggaaacactactgcagagaaattttgtaaaaaagaaatattttaagacgtttccaattaaagagctataatacagactgactttatgataggaattcagagagagagctctctcattataagtaggaatagtagaaagagcgtttatgtaggaagtggggcttgggaggatggttagatgtagggaggaaggaaaatactctaggtgcaatgaatggcatgaccaagtcatgagggcctgtggggagaggggcacatggtgggggtggtaggaactaagcttaggtaggtaggttgggcaatagtgaaggtccttgaaagccaggcaaaggaatttagaattgggcaggagggaagctttgtagttgctgagcagtaggatgacaatatgaaagcatcttccagaagattcataaccaaatacagaaggaatagtaggtgctaatgttgtaacagagaataagctagatgtcaaactgaccagatttattttctgtcagtgtagatttgcttcagattgattccttattataggtgagaaatgtttatagcaaactattttatttgccttggaaaaattgtcattgctgtatacagtggaatttcattcttatttctgcaatggagcagaaatgaataaggaaggcaattcttggacctgatccaaggatgttcagaactgaatggatcaaaaagcatcacttctgaggtggtcttgtgatatgaacttgaaaagggcatggtgtacattatctgttggcaggcaaatgacagctttcatttcgaactggacagtgttgtcactttctgccttagtgctgctctgacagtctgcttgaagtcaaaacttggattggttcaccagcttggactatttttgaagcatactgtaatgtctaggcttattgaataaaagaatgttcccaaaataccatgtgaaaggatgtactactgctacatgattgccattattcacatttcttgggaattctttgttttaacccttaaactttattagttaagaacagttatggtatttacttatacaaatttaccataatttatattcatgcacaaagaagaaatttgagaaggattaaaatatgctttatacttaatttagatctcttttgacctaaagtaatgatgtcacatttttaggtcatcaggccttgtagctttttctttgcttgtgatcttgaacactcaaaataatttgtgatgaaatttgtatttttaaacacacttgtgggtgaaagtgcccagaatatctttttttaacaattaattacttaatcatatcacttaataccttttgtttgcctggggctaatgtgtgatttgtgtgtgtgtgtgtcctgagttttgtggtcctttccactgctacagtattagaagatttttgtctcttaatgtggatgcccaagttctgtgatgtaatcattgacctctgcccactgccttgctgcatttttgacctagagcaagcactcaaactttaaatagttcacctttggacttgccacattaagcataatttagtactactgtatttttttttttttttttttttttttgagatggaatctcgctctgctacccaggctggagtgcaatggcaccatctcagctcattgcaacctccacctcccaggttcaagagattctcctgactcagcctcccgagtagctgggattacaggcatatgccaccatgcctggtcaatttttgcatttttagtagagatgggttacaccatgttggccaggctggtctcgaactcctggcctcaagtgatccatttgcctcagcctcccaaaatgctggcctatcactactgttttttgtttgtttgtttgtttgttttttgttttagacggagtcttgctctgtcatccaggctggagtgcagtggtgtgatctcggctcactgcaaccgctgcctcctgggttcaagcaattctcccgcctcagcttcccgagtagctgggactacaggcacgcaccaccacgcccagctaatttttgtatttttagtagagatgggatttcagcatgttggccagcctggtcttgagctctgctcaatttcttaaataccttgtatgagctgggtattttaagttgtgttatttagtccacttcatttttcagatgaagagaagctcagtaaggtgttgaaagttactcagttcatacatggcagaggtaggattctaaccctgaactgtttgattccaagtatgctcattccagtatgctaaggtactttctcattcttctttacaatagtctcttcttctaacataatagttattgtgaggtttaaatgagtgaaatgatatatgtgaaaatacctaaaacaaacaaaaagaaacatttggtgattatgttgcaggacaggcaaaccccaaaactgaggtttatcccaagagggttcttggcttttcctaggaaagaattcaagagctagccagtggtgttagcaacttttattgaagcagcagtgtacagcagcagcagcagcagcagcagaggcatttctgctggcggagcagggctaccctagaggcagcgtgcccagagtagcagctcagaggcagttctgcattcatatttatacccacttttaattatattctaattaaggggtgatttgtgcagaaatttctagaatgcaagtggtggctactaggttgttcagttgttgccatggaaaggggcagtaacgtctgggtgttgccgtggcaatggtaaggtgacctatcaccctggtgggtgtgtcttatggggaggtgcttttaccctggacctgctttagctagtcctctatgtggtccagtgtccacgccctgcctctggaattgagtactgactcctacttcaattacatattagctcccttctatagcttctttttttttcttctatagcttcttaatttttgtttcttaataattttctccaaataaatgattcaattcttcagttagttttttttttttttttttttgagacggagtctcactctgtagcacaagttggagtgcagtagcgtgatctcagctcactgcaacctccccctctagggctcaagcgattctcatgcctcagccccgcaagtagctgggactacaggtgtgcaccactactcccagctgattttttgtattttggtagagagggggtttcaccattttgcccagggtggtctcaaactcctgagcgcaggtgatctgctcaccttggcctaccaaagtgctgaaattacaggcgtgagccaccgtgcttggcccttcagttactttttaagcttttctcagagatattttttatctaatttgtagtcttctgtagtaagacttttttttttttgaattggaccatgattacttgtttttatttaatgccctttctttctgtatctgttgagtggattacacaatttttatcctttactctgttgagatagtctatggtttactacatgaatatagatttgctgataatgaaccattcttgcatttctaggataaaccctacctggctgtgatgaaaaaaaaaaatatatatatatatatatatagtgctgaatttaatttgctaatattttaaaaggattttgcatttttgctcatgagggacctttatctgtaattttcttttctttttatgttcttttctagtttgggtatcaaagttattttagcttcataaaataaggtctttttctagtttttgaaacaggttatgtaagataaagattatctgctcttgaaagtttggcaaaacttgcatctaaaactccctgtatctggtggtgtctttgggaggaagagatatgactaaaaagaaactcgctcagttttgttttattatctaaatcaggttctaaattcattgtgagtcaactttggtagtctgatacttttctaagaaattaccaattttatccaaccttccaatttattagcataaaattcataataattattcttttaaaaatctctgttgtatctagttatatcacatttcctattcagtattgcttatttctgccttttgtctttttttcttatcgctcttattagagatttatctgtcttaccagcttttcccacaaagatctatttcattaaattcttttctcatatttattatttacttttctcaagtttattatttgaataccttatttttaatatttcagtctttatgttcaatctttcttttcttttttcttttttgagatagcgtcttgctttgtcacctgggctgtagtgcaatgacatgatctcggctcactgcaacctctccctcccgggttcaagcgattctcctgcctcagcctcccaagtggctgggattacaggtgcccgccaccatgcctggctaatttttatatttttagtagagacagggtttcactatgttggtaagactggtctcgaactcctgacctcaggtgatccactcacctccacctcccaaagtgctgggactacaggcatgtaccactttaatttttaaattagagaatttaaaaattctttaaaattattttttaaagttttcaaaattctttttaatatcttttgttatatttctaatataattgtattgtacccaaagacatggttggtatgatatcaattcttggaaattcttttgttacatacagctcagttctagtgagtttttatgtgtgcttgaaaagaaagtatattctcttttgcttgggtatagagttctatttatactaattaggtcagtatataaatattactagtccaattttttatagcctaatttgtctgtttcaactatcagcttatgattgatatatgttaaaaatctcctatactaattgtagacctgtctgtttttcttataattgtcagtgttagctctacatatttcaaagcaatattgttaggtggttacaagtttgtgattcttctgggttctgaattctgttaattatttgttgctaattatctttttttagaatgactgttgatagacgttagcctgctgttggcttgtttctccagactgtgttcttcttcttttaatctacatcctagtttttgccagttttcttcataagtgaaaaatatcctcttattgtatctatcacttcattttgtgtttaggttgccacgcctgtaactcttttattacattctactgtagaacagtgattgcctactttttttcagcataaggacctttaagtaataatagtgaaattttaggctgggcgtggtggctcacgcctttaatcctagcacttcgggaggccagggcaggaggattacttgaggccaggagttcaagaccagtgtagccaacatggtgaaatcccgtctctaccaaaaatacaaaaattagctgggcgtgatgctgcacacctgtaggcccagctactcgggtgactgaggcaggagaactgcttgagcctgggaggtggaggttgcagtgagctgagatcacgccattgcacttcagcctgggtgacagagcaagactatgtctcaaaaaaaaacaaaaacagaaaaaccaacaacaaaataataatagtgagattttaaattatttcttgattaagaaatgcataaaaacaaaaagatacaggccgggtgcgatggctcacacctgtaatcccagccttttgggaggctaaggtgggcagatcacttgaggtcaggagttcaagaccagtctggctaacatggtggaaacccgtctctactaaaaatacagaaattagctgggcatggtgaggagtgcctgtagtcccagctacttgggaggctgaggtgggagaatggcttgaacctgggaggcagagattgcagtgagtggagatcatgtcactgcaccctagtctgagtgacaaagtgagactctatttcaaacaaacaaacaaatgatacagtgaatttcataatattttattttattttatataattttttgagacaggatcttgctatgtcacctaggctggaatgtagttgtgtgatcacaactcattgcagcctcagcctcctgggctcaggtgatcctctcatctcagcctcccaggtacctgggactataggcatgcatgctaccatacctggctaactaaaagaaaaaaaaaatttttttttttttagagatgggatctcactatgttgtccaggtgggtctagaactcctgggttcagtcaatcctcccagaatactgggattataggcgttagccaccacgcctggccaatttagtaatattttaagataatttaaaaattttattcatcacaacagaatcaacatacatttgaaaactgctagtatctgtaagacactcttgcttgtatactcagtctatttctgctgcaaccctagtatgagatggaggaaggactgtggagctgatggaccaggaggtagcagagttcttgattgaactctgcacactcagaatctgcactgacgctagatttgacaagagaataagggaagaagggagaaagaacaggactggttattcaggttttaaaggatttaaagattgtgacttatacacatctttaaaataaactacttaccaagacttgaggaacatatagcttgggcagctgtaacgtttgttcctctcccattctttcccaacatgctgcttccccttcagttatcaattgacttggacagagtcctgttttatttgaagtcaaaactggctgcataccctcctaatctcaataatctgaaataagagaatttagtgagcctgtgggttttgtgtgtgtgtgtgctcatgatgggtgtgtgtgtgtgtttaggctttgttatctagtatacatcctctagcaaagggtttggtgtttcccttgaaatgttttgaatgttttcaatatgactcattgtgggttattttttaaaattcagttttccccttagctttattgagatataattgacaaatggaaattgtatatatttaagctgcatccttgtggttttatttttagttttgggtgtactcatgcagtgtcctgtactatcactgtttggccttgataagaacaagaagtccactttgcattatgttgtactttaagagagttgggacagggaaaggaatactttgtggatgaggtctgtaggatctttaaatgtaggagtacagggttggaacagcatgtattaatattatcacacagtgtacacccgtgtgagttggtgctgcatacttgctacttgaattagattaaagcttgtcattgtactctgtgttcctgactccctcctaaaaactgtaactatgcttgtggccttcagtcaggtgtctaggtgactaatggctgaggatccttgacctttctcaaaatggcaactccaggagcaaagcatatcagctattactgatatgccacagaatgcgtccatctctactgttttaaagtacaatctgtgccaaatgcttcatattaacatagaaaagaaatttcttcacctatctcctgagtcttttgaaatcttcacatatattattttctaaattattattatttaaaattttcttaaagatggagtcttgctctgtctcccaggctggatagagtacagtggcatgatcttagctcactgtaacctcagacttctgggatcaaacaattctcccctcagcctcctgaatagctggggctacaggtacatgccatcatgcatggctaattttttaaaatttttcgtagagatagggtctcgctacgtagtctaggctgttctcaaactcctgggctcaagcaatcctcccacctcagcctcccaaagcgctgggattataggtgtgagtcaccatccctggctctatttttattatttaaaaaaaaattatatgtatatataaattccagtgaattgatagaggcagtacttcctatttgaagcatactagaatggctgaactctcagttgctgatgcctgaaattttatattggagttcattccttaggttaacaatttaaatcttaaatatctaatgaagggataatttggggggccttagcagtcattttcacttagatctttgtctgaaggtaggttcttaatatgcgggaaggcagagagagcttgagggcctgcctgtaccccaaacccctgtcttctcactcaggccttatattatgaagggtctggactttaatattatcttcaaataaggccatgtatgtagtcacaggaaaaaaagaagttttaaaagatgttgttcatggccaggtgtggtggctcacgttgtaatcccagcactttgggaggctgaggtggccagattgcttgagcccaggagttcaagaccagcctgggcaacatggcaaaaccccatctctattaaaaatacaaaaaattacctgggcatggtggcatgcacctgtagtcccagttactcgggaggctaaggtaggaggatcacttgagcccaggaggtcaaggctgtggtgagccgtgatcgtgccactgcactccagcccagacaaaagttgatcatgcaattaaaatattaaatgtaagcacttaaatagaccaccatttttatgaacctgttttggcatttcttcatttttaaatatgatggacttctcagactgggaagtgatctatgcctttcttgatgtctgaaagaccctgacaggatgggaagggaagggaagatctcaacaagggctaagaaaagaggaagaatagccctgacaattgattttgcctgccacataattatactggggccagactggttggagatgacagtgagggaggtgctgggtgcagtggccaggtggagaaaacctcactgaccagattctcatgttctcacttccttccctccacctgtttccttcccatctcccaagtgtcgtcgtagccttgtttgatcagatatgtttgtgggctctgcaacaagctctctctctctaatacagggatcgtggtatgtaaacacctgtttccttgggtgtgctccaggaactgcgacctccatgaaataaaattttcaagtgttctgttccatagtacttcactcttaggcaaacaatgcatctttttgacagtatttataacctaaaaggctatactgtctaagatcagttttaatttttttgtttttattaaaacagtgaatgtgatatgagttacttccactcctccccaacttttttttttttttggtgggagtgaaagttgaacgtgaatgttttcaagtgctttccagttttaatttatggaccatatgtctaaatagacttaatcacaccatttcctttatattattttgtctaaagctctcctttccacggccactaaaccagtgagctgacataggatgactgctttttacagaagtagattgagattgtttggctttagagtgagctacctgcactttgtgatggtagactgccctccctagtccaactagaccgattgcaagtgcatgttatttctcacagaaagggtgtgtgtgtgtgtgtgcgtgtgcacgtgcgtatgcgtgagagagagagagaaagagatctactggaaaaagagctcaaagagatgctgcaaagagaatcatctttataagtagtgctgaacttctcaaggcaggagcagtgtagttaccttctccatcgcaacattcctaacctcttaggtaaaaatgactcctccaggccaggcacggtggctcacacctgtaatcccagcacttagggatcacctgaggttgggagttcgagaccagtctggccaacatggtgaaaccccatctctattaaaaatacaaaaactagttcggcatggtggcgcatgcctataatcccaactactgggaggctaaggcttgagaatcacttgagtgtgggagaggcagagtttgcagtgggctgagatcgcaccactgcactccagcctgggtgacagagcaagactccacttcgaaagaaaaaaaaaaaagaaaagaaaaaatctcctcctgcttttgcacccatactttttttttttttgagacggagtctcgccctgtcacgaaggctgtagtgcagtggtgccatcttggctcattgcaacctccacctcctgggttcaagcaattttcctgtctcagcttcctgagtagctgggattacaggcatgtgccaccacgcttggctaatttttgtattttttaagtagagatggggtttcaccatgttggtcagattggtctcgaattcctgaccttgtgatctgcctgccttggcctcccaaagtgttgggattacaggtgtgagccaccgcgtccagcctgctggacatacttctaaagactgatttgtacttgtctcctcctaccaaggttcctcttaggtaaggacttttaaaaaatattcccatttctaggaatcatagcatgtaatagttcctcaatatattagatgaataaatatatgaaagaatttaaaggaatttaagattagtgactctgctgggcacagtggctcacgcctgtaattctggcactttgtgaggcaaggcaggaggatcacttgagcccaggagttcaagaccagtctggacaacatagggagaccttgtctgtacaaaacataaaaaattagctgggcatggtgatgtgcacctatagtctcagctacttaagaggctgaggtgggaggatcacttgagcccaggagttcaagaccagtgtgggcaacatagtgagaccctgtctctacaaaaaatataaaaaataaaaaattatctgggcatggtggcatgtgcctttggtctcagttacttgataggctgaggtgggaggatgacttgagtctgggaggttgaggctacagtgagctgtgatggtaccactgcactccaccctgggtaacagagcgagacactgtctagaaaaaaaatttagtaactcactttttctggatatagtctaaaagaacccttaaaaaggacttgcaggcagagtgtggtggctcacacctgtaatcccagcattttggaagaccgaagtgggtggatcacttgaggtcaggagttggagaccagcctgggcaatatgatgaaacctcatctctacgcaaaatacaaaaaaaattagctgggcatagtggcgcattcctgtagttccagctacttgggaggctgaggcaggaggattgcttgagcccagggaacggaggttgctgtgagctgagatcgcgccactgcactccagcctgggcaacagaatgagactctgtctcaaaaaaaaaaaaaaaaagaaaaagaaaaagaagaaaaaagacttgtggtagtctttttataatctctaaatggattttcctcttctttggcatacatttaatcttcttggttagtgataattgaaatcacatggaactgaggaatttgtgctctttttttcttacaaaataattactcatactcaaggtcttctcctaaattgtctcaaattagagtaggtggtaattctgggaagaatgtattagagggtcatgagtgagcatatttcgagatcccataaggctgtcattggtccatttgatatatagcataagattttttttctagcaatttaggttgaagattcaaagggagagagaagtactagttgattgatttaaattatctaattaaatattattagtatatagttaagatatacaattatttaggaaactgaccttatgcctactttcattctttaaatactttttaaaaattcagatttctattaaaatgtgcaagatcactttaagaagctagggagcttgaatgtttaaataaaatccaattttccatacacaagacagacttcttcctgtttctgactgctggttagtcttagtgggatttgtttggcttttatgaatgccattaaattttaatgtgcagatcagatgtcttattgtataaaaaaatggttcagtctctgttttggacctatcattttaccacacaagggaaccattagtgataatcaattttattcctgtaaaccttttcaatttcatctttttcagtttcctttctccataatggtcattcttgtcattttttttccaaatttgaaaaacttatacagtaactggatttcataaatagatatatcacaagacttgtagttggtgatgcttttgtttgttggctataatttcataaatgttcaagtttcctggaaacaatttctttaaatattaccctaccactaccttctctcctttggaaactttaattacacatatattaggttgcttggagttgtcccacagttcactgatgccatttgtttttcaaaatcttttttcaccctgttttattttggatagtctttattgctatgacttcaatttcactattttttcccctgcaatatctaatctgctagtaattcacagtgtatttttatatctcagacatatctttcgtatctagttgttctatttgggtctttttctctatcttccatttatctaactagggtaaccaatctacttttttttttttttttgagacaggatcttgctgggtcactcaggatggagtgcaatcacggcccactgcagcctcaacctcctgggcccaagtgatcctcccacctcagcctcaagagtagctggggctacaggcgcacaacaccatgccattacattttttatttttattttttgagatggggtcttactctgttgcccaggctggagtgcagtggcacaatcacggctcactgcatcctcaacttccctgggtttaggtgatccagccacctcagcctcctgagtagctgggactataggagtgcaccaccacacatggctaattttttattttttgtaaaaatggggttttgccatgctgcccaggctggtcttgaactcctgagctcaagagatcctcctgcctcagcctcccaaagtgctaggattacaggtgtgagccaccatgcctggcctgatttttttttttttttttttgtagagatggagtcttgctatattgcccaggctggccttgaactcctggcctcaagcaatccttctgcctcagcctcccagaccatggtattaggcactgtgcccagctcaatctttacttttgttttttgaacatgtggagtacagttatgaccattttaatgttcttatatactgattctgtcatctttgtcatttctaggtcggttttgttttgaaatagggtcttattctgtcacccagtatgggatgtggtagtgcgataatggctcactgcagccttggcctcttgggctcaagtgattctcccactttagcctcctgagtagctgggaccacaggtacttaccactgttcctggctaatttttaaattttttgtagagacaaggtcttccttggccgggtgcagtggcttacacctataatcccaacactttgggaggctgaggcgggtggatcacttgaggccaggagttcgagaccagcctggccatcatgataccccgtcgctactaaaaatataaaaattagccagctgtggtgtggtagcacacacttgtaatcccggctacctgggaggctgaggcacaagaatcctttgaacccaagaggtggaggttgctttgagccgagatcgcaccactgcactccagcctgggcgacacagccagactttgtctaaaaaaaagaagacagggtctccctgagttgcccaggctggtcttgaactcctggcctcaagcagtcctcctctcatcctcagcctcctaaagtgttgggattacaggcatgagccatgacaccaggcccgaggttggttttgaatgattgacttttctcttcattattggcggtattttcatgccttcttgtatacctgataatttttgactggatgagagtttcctcttattgctgtgacaagtcaccagaaactttgtggtttaaaacaacacaaatttattatcttacagttctggaagccagaagtccaaagtgagtcagcagggccacattctttctggaaactctagaaaagactctgtttcttcaccttttccagcttctagaggctgcctgctttccttggcttgtagccccacattactccagtctctgctttcattatcatacctccttctctcctgcttccattgccatgtcagtgaaataatgccctcagtttgctaataaaataactgtcaacttagaattctgtactgctataatagtctttgaagaatgaggacaaaacagacattatcaaacaaaaactgatacattttgtcaccagcagacttttactagaggaaatcctaaagaatgtacttcagacaagtccgctgatcccagatgtaagcctgaaatacaagagggaatgatgagccaagatactggacagtttgttggtaaatgtagataagtgttgatgtatataataatgggatgtttttactcaacgcttctgataccagatgtatggctttttttttccacaccaacaaccagtcttccaactcttcagacaccaacttggtattcagcagcgcaattcaattctgacactaactatccagagttagtgtcagactccacaggtttaagtgcttagtcccataaaactatcctcacttcagataccagtcacaagtattgggtgcctggtatacccacacttctgtctgactttactacaaagttgggagttcctacaactccccgctttcgggtttgttaattcgctagaatggctcacataactcacagaaatactttactcaaatagttaccagtttattataaaggatacaacccaggaacagccaaatggaagagatgcatagggcaagatatgatgaggaagatttcatgctgcctgggtgcaccacctcccagcacccagatgtgttcaccaactcagaaactctctgaccatgccttgatgtttctggaaccagctcccgttttgaagctatctagggtcccccagccactagtcatcttattagcatacaaaagacacttttttttttttgagacaggatccagctctgtcacccacactggagtgcagtggcatgatcatagctcactacagccttgatatcctggactcaagcactcctcctgcctcagcctcctgagtagctaggactacaggtgtgagccaccgtgcctgcctatctttttaaaatttttagtagagatgagatcttgctctgttacccaggctcgtctggaactcctaagctcaagtgatcctcctgccttgggcttccaaagtactgggattacaggcatgagccactgtgcctgtccacaaagacacttttaagtgtcaaaagacacttttaggaaaaatatttttcctaaaatttggatcactcattctttttaataacacatagaaaatttataaaaataaatcatatgttaagccatgaagctagcctaaatatattttagtgccttaagaccacattttctacacaactcatttgaatgataaatcaatgatcagaagataagaggaagagtcctttatacgtagaagtatattttaaaattcccaaacaattcattgttaaataaatcacagtgacaattaaaaatgaatgacaaaaacactacctatcaaaacccatggggccagtaaacagtgaaacaaacaaacaaacaatcctcagttttattaataaaagaaaaatgcagggctgggcacagtggctcaaatgtataatcccagcactttttttttttttttttcagactgagtctcactctgtcgcttaggctgaagtgcagtggcgtgatcttggctcaatgcaacctccgcctcccaggttcaagcaattctcctgcctcagcctcccaagtagctgggattacaggcgcttgtcaccatgcctggctaatttttgtattcttagtagagacagtgtttcaccatgatggccaggctggtctccaactcctgacctctagtgatccacttacctcggcctcccagagtgctgggtttacaggtgtgagccactgtgcctggcccccagcactttaggagtctgacatggatgaattgcttgagcccagaagttcacgaccagcctgtgcaacatggcaacactccatcgctacaaaaaataaacataattagctgggtatgatggtctgtgcctgtagtcccagctacttgagaggctgaggtgggaggtgaccaggaggtcgaggctgcagtgagccatgattataccactgcacctgccgcctgggcaacagaccgagaccctgtctcaaaaaaaaaaaagaaaaaaaaagcaagttaaattcacaatagtttatcgtttcacattgaccagattggcatattaaaagttcagacgatgaggatcaagtctgtatactgctggtagaagtattcaattgataaaaccattttggaaagcagtttgtcattccctggtaaagttgaatatatttattttctgtaatttagtatttccattactagatatataatctaaactctgttcatgtgtaccaggagccagaataaaaattttcacagcactattattcatattaacactaataacagaaacaagaacctagaacacctctaacatccagcagaggtagaatgggtaaatcaattttggtatatatatatatatttttttttttttttgagatggagtttcgcttttgttgcccaggctggagtgcaatggcacgatctcagctcaccgcaacctccgcctcccgggttcaagtaattctcctgcctcagcctcccgagtagctgggattacaggcatgtgccaccacgcccagcaaattttgtatttttaatacagacagggtttctccatgttggtcaggcaggtcttgaactcccgacctcaggtgatctgcccgcctcagcctcccaaagtgctgagattacaggcgtgagccaccacgcctggccaattttggtatattctcacaggggaatacaacatagtagctacagttgttaacatgatggactgaacattataatgttgaacaaaaagaacagtcacagaagcatgcataacggtatgattccgcttaagttccaatataggcagaactcaacaaaaaattgcttaggtatgtatacatatataggtggtaaaagtataaagaaaatcaagaaaataattaacaacattcagagtaataattatctctggagaataggaaggaggatttggttaaggtggggttctaaagtacctggtactattttataaaatgattttttttttttttttgagactaaatctcactctattgcctaggctggagtgcagtggcatgatcttggctcactgtaacctctgcctcctgggttctactgattctcctccctcagcctcctgtgtagctgggattacaggtgcccgccaccatgcccagctaatttttgtatttttagtagagacggggtttcaccatgttggccaggctggtttcgaactcctgacctcagtccgcccaccttggcctcccaaagtgctgggattacaggcatgagccactgcacctggcataaaatgattattgacttttaggtagatggtgtttgtttgaattaaaatttatacaatcttttacatgtgttattttattttgtaacttaaaaactatgaaaatcctcaacctcaatggaaattaacactatattgaataaagataacctacagactgggaaaaaaacatttgcaaattgtatttctgatgagagtttaataactagcttatctaagaaactcttacaactcagccccaaaagacaacctaattgaaaaatgggcctaattgaatagacatttctccataaaagatgtagaaatggacaacaagcacatgaaaagatgttcaccatcattgatcattaaggaattgcaaatcaaagccataatgagataccacttcacacctgctagggtggcttttatttaaaaaaaaaaaaagataagcattggtgaggatatggagaattaggagcccttatgtgaaatggcacagtgctggaaaatagttttgtggtttctcaaaaaatcaaacatggaattactatataaactagcaattcctcccctaggtatataactaagagaaatgagaacattatagcagcattattcataattgctaaaaggtgtagacagctcaaatgttcataagtagattaatgggtaaacaaactgtggcatatccatacaatggaatattattattcagccataaaaaaagaatgaagtattgatacaggctacaacttggatgaacctcaaaaacatgctaaatgaaaggagccagacgtagtgtatgaattcttttgtatgatgtttccacaataggcaaatccagtgagacagaaagcagattagcggttatcaggggacgggggaaggagaaaatagggagttattacttaatgagtattgcgtgttttactgagataatgaagagttttggcactagagagaggcagtggttgcacaacactgtgaatacactaaatgctactgaattgtacactttgaaatggttatttgtatgttacatgaatttcacctcaattgaaaagaaactatgtttggatccaattttggtttattattggtgaagatccaaaatttgaattggtgagaaggtaagaactgtttagtataacttctgcagattgcaatatggcaacatttgttaaaaattatacatatgcatacctttgactcagcaattttatatctagaatgtatcctacagacatacagggtaaaattacatgtattcaaggtgattcatcacagcaggctaataactattagcctgggctattatgtagctttataaaagtaggaggaggctctttatgtacttttctttctttttttcttcttcttcttttcttttttctttttttggagtcttgctctgttgcccaggctggagtgcagtggcatgatctcggctcactgcaacctccgcttcctgggttcaagtgattctcctgcctcagcctccccagtagctgggattacaggcccctgccaccatgcctggctaatttttgtacttttggtagagatagagtttcaccatgttggccaggctgatctcgaaatcctgacctaaagtaatccacctgccttggcctcccaaagtgctgggattacacgtgtgagccaccatgcgcggccctctttatgtacttttaatagaacaacacataaatgtaaaaagcagaatgcagcgagtgaccatatatgatcctatttgtgtaaaaaagtggggaaatgtacatttttgcttctttgaggcctgaaatgttttatgaagacatttacatacagaggaaatacaacattggaggaaactcagtattggttgcaagtgggatggaatgagtgcatggaagatagtgaagggaaagagatttctcattgtatgcccttttggttttaaatatgtgtatatgcttgtgtaatatgtatgaatatatattatatatttaaaataaaattaaaaagaacaaaatatccagtcctttaagcctgatcaaaagccacatcaaacaggtcttgcccttcactgatatttattatatactgccttatgtttttttttttgtttgtttgttcgtttgttttggagacagagtctaactctgtcacccaggctggagtgcagtggcatgatctcggctcactgcaacctccacctctgattctcctgcctctgagtagctgggattacagatgtccaccactatgcctggctaatttttgtatttttagtagagacgggctttcactatgttggccaggctggtctcgaactcccaacctcaagtgatctgcccaccttggcctctcaaagtgctgggattacaggcatgagccaactgcgcccggccatgtattggcttattctgccaatgtttgtgtcttgccttagtaaagtatgctcctcgagagttagaatagtgctttttacatctttatatacatacctacagtgtccacagcccagtgctttttatgtagttgaaattcataagttggtttaattctacttgttaacaatgtaatactgctttaaacttgtggagtttctgtattacttcatttatcctcaaaagaacctggtgagataggcttttatttgcaggtgacattttctatgttttcaaatgagactgtataattctggctaagcattttaactttaagcagtttgttccttatctttgtaagttagtcagtcacaacataatggctatattgaatatgagactagaggagatgatctattaggttattttcaactctgtggggatgagtaattgaatgaatgaatgaatacattttattagtacaaggaaggcaaactgaatacttggtgtatgcattttgggttcctcttttaaatgaatcccccgcccagctccccttccaccactcaacctttggctgatctggttacttatattaatattaaactattaataactggcttagttactaataatagtgacctttaattaacaatatattttcattttaatttttaaatttttgtttttattttcttttaacaatatattttcaaatggtccaatggatttatcaaacaaatttatttagctagatgaatgagtgagaaatttatgcattgcctcatactttttctttgtgtttcttcctattcctttgctttgtttagttattaaatttcacttaacaccatgctttggcattttatttccagatgttagatctgaaaatgatctaacatttcagcaaagaactgaaggatttcagttctttgtgcagtgtcttttaatagcagtgtgtatagggtggggaggaataaggaaacaaaggcattgcagagatagagcaacctgaagtcaaagagcccagatgttttctcgtcattttttgttgtcaggaaataaagaataagggcagtgcactgaatgaatgtgctgcttttacctgtaattttgtaattttctttttgaaacagggtctctcaaaatgctgggattacaggcatgagccactgtgtcctgcctaaattgtaaaatctaaaaacgtaggttctattatcaattggtcttggctatttttcatgtagggaaaaaaactgtgaatttacatgcatattctctctttgtatttgcatatggtattcttctgtgtggttctgccggtgtgttaacctgtgttcttccctatagggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtaggcaatctgagacaaaaagcctactcttgaagataataatggaagattgatgattgtttagaatgaaaatatgttgaatgctgcacatctgtgttaccgtgtttgctagttgtccacccatgtgattgaatactctgaaatattttttcaggtccgtaaaattattagagtttgcaaaggaattttggaatatcttacagtggcagaggtggtggagactatggaagatttggtcacttacacaaagaatcttgggccaggttagttttatccaatttctataacattttttaaggattgtccatgttggagccaaaggaaagggtaccctcttcctactttttgcagaagataggtgaagatgcattgggctttcaggtgtctgctctgttgatggagatgatgctgtgctttgaggtgatgtcattatctctggtatctgaatctgctttctatatattgccttgtcaaatgaattaaaccaaacattgcaaatactgctattggagaatgtaggaaatacttttctgttactgtaatgctgaaggccatcctgcatcctgacctctccattccacattacacagcattccttcactgtctgccagctggcctgtagttctttatgacctcttagcttgctaattagcctgcctactattatggattcatgccctcacccaaggctgcataatataatcagacctaggagagaagagctattgtggttaaatcttattttgaaatgattattcaggcatctgagcattaaatattcaaaatatataaacggataccagcttttgatgttacagacatataacatgaacttgagggtctttaaagtatgaatgagaccaatgacaagatatgttagatgtttaacctgcttaacttgattgttatcactttataaaattcatttgttttatgtgaaatgttgatttttaattaacagcatttttatgaggttccagtgtaggtgttctgtaaaacttaatggcagttaagaatttgagccatcactgaagatcacctggaaataggtttctctggtggctttagagtagtcctcttaaaatttctcataatactggcgaaaattatatttccccaaatggaatcttatgcagaatccccaaacaaaaaaagacaaaatggagctactttaggtgaagcaggagcagccccacctctgcttctctttggtcttgatggtctgtgagacaacttgagaaatcctaggagtaatttgaaaatcaaagctttagagaatcacatagcgcctttgaataacaaccaacataaacaaaaagtgctagcagagtgattccaaaacaccagatgctttcaaacactgtcatccctataattatttttataatatttctatttgtttctaattataaaactagtacatgcttattttggacaaattggaaagtacagacaaatagaaatatgaaaacaaaacatatcattgttattcttagaacttttttcagccactagattcagtactaggctcatgtgagatttttagcacagagttcagagacatggcatgaaacctgtatgcatagaagcctggcaaaatgtttttcccttacctgtgaatttctttttaataaatatatatttattcatttagatgtttaatatttgtgaatatatttatatcaaaatatgaaaatgtttatcacatttagtgtttacatttaatacattactttcattgaaaagagtaatgttgcataaattagagttcagtgatggtgtctgttgtttaaataagtgagcaatcggtttgaactttcatagtatttcataatggatttagactgagaaagccagacccgggattgtttcactactcaccctgcacaatttcttctttgtgccccaggaatgactaagatggccaagatgattgacgagagacagcaggagctcactcaccaggagcaccgagtgatgttggtgaactcgatgaacaccgtgaaagagttgctgccagttctcatttcaggtacttcctgcctgtactttattttataggggggaaaaatgttagcatgttctaaactctgaggttcattttgttttcttttgttttcttttcttttttttttttttgagatgaagtctcactctgttgccaggctggagtgcagtggtgcgatctcggctcactgcaacctctgcctcctgggttcaagcgattctcctgcctcagccttctgagtagcaggcactacaggtgcgcactgccatgcccagctaatttttgtattttcagtagagacggggtttcaccatgtgggccaggatggtcttgatctcttgacctcgtgatctgcctgcctcagcctcccagagtgctgggattacatgcgtgagccatggctcctggcctgaggttcattttcttttgtggcttcactgcatgtccttcagcctaggtaaaaatgagacccgattgattggttatcacatgatggctgtagctgattggctgagaaccagtcttcttctctaatgctgtccttctcctgttctttgtttgaaattgcctttctgtggcctaattctgttctcctaaagctctaacaagcccctttgctgggaggtggactctcctctataaactctagcctaggatattaaattttcacacctttgtgttatagaaaaataattaggagctggaatggatattatagagcatcatatgataaagacatgaactcagagccctttttagtgtgtattaatccaatttttcctaaaagatatttaactgttgtttacatcatgagtagatcagttctttagtcaccagctgggactaccttcccattgagtagtgctctgaaatgcaaacatggtagctgctctctcgactagcaaaagggagtagcacttattgagtgtctagtatatgccagacagctcatggtttatatgaattatcttagtcaagttgtgggttaattagttatttctcagaaggcaactttattataaaaatctggtgactcatgtcattgtgacttccagctacctgctttggtgtttcaagtagtagctaaaaaaggacatatgagtataagagttcaggaggctgggcacagtggctcactcctgtaatcccagcactttgggaggccgaggtgggtggatcacctgaggtcaggagttcgagaccagcctggccaacatggcaaaaccccgtctctactaaaaacaaaacaaaacaaaaattagccaggattggtggcagacggctataatcccagctactcaggaggttgaggcaggagaattgctcaaacccaggaggcggaggttgcagtgagccgagatcacgccgaaagtgttgggattacaggcgtgagccaccatgcccagacattatttttttcttctttatgtttgggggttggcaaatccaagctacatgttgagagaaatctcggatgataaacttgacatcttgggatcttctgctgggatcaggggcagcaggatacgccattcagagtattactgacagttttcatattgtcccattaggtttgtagtagatggagccagggtgagggccaggatgataactgatttagaaggatattagatattttgtgattgcaggtcatcagcatatgcaggttaaattagttacttaatcatgttgtgatggtgtctttgtaccttgagttttctttttctttttttatttttacaataaaggttgttaatgttggaactttattgtcaaacttgtagtgtttgttttgtatactcattttaggatcttaaaagcccaaaacatctaaagtgtagaacatcttttgtgaatattgttatacaacaagattaaattccaagcttactttctgatcttttatttttacagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggtacgtgttcttagtggagaaataagcaaaatccccaactctccctggctgggggttttgattggcacctgtctcatactttatcttgtaatttttgtagcataagagtactcagatattgtgaaagtaatttcttcttcatttctgtttcataggttacttgctatctttgctaatttcctttgttctaaggtagaacaagtaaataggcatgtggggtagatactggtttaaggctgagatttatagcttttccatcaggctggagtcttattggttggactggtggaagagtatattcccgtggatgggagctctgccttgtatatgggtggttcttcccagctgactaagtaagatacagatatgcctgtaattctgaactttatggaaaacttttctttaaccaatctttgatccagagaaatctacagaggaaactcttggcatttctagatgtgtcccttgatcattccattttccccaaggaaggtttaattaaaatattagtcttcacattggtcagttagtttgagggatcccttcaccctttttctggaatctcttttaggaccccagaggggctggcagattccttctagagcctgttagcagtggttttgtgttgctgctgctctggtctgctgctccctgtttaatgactgtgaaccaagctttcaggtctgggggaacagagatacttgggttcatactttccttgtaggagcccaagatgtaggcagtggggggaacacactgtccccaagatctagctttcccatgtgtgaccccaatgtctccagggccagccagaaggctggtagtcaactaaagaagggattttgttgtatgacttccattgggtgctcagtagaacggtatgttctccgggatctgtaaggtaatgtaaaagctggggcctgaaatcaccagccctctctcttgttgccctgaaagctaatttaattatatagagtaagttagcttattttaactatggatttatttacagagacattttctcattgatgtgaagttcttgaatagattctaagactgtattttaaatctatatggtaaaatctttttaactctgatattttatttaattttgcttttgcatagttgacaactttcacttccctgttatgacttctttatgcatctttttttgttcttttgttttattctttttctcacgtttagaaggtaagctttctcttgccctctagtttctttttcgcttaaaaagagaaaagcatgtctgtgaggtttttttgtgctgtgtgccgtgccttattctgtgtataacactgtgcttgaatgtgcgtcagaatgtgatttaatacgggactctaggcagtgctggggagactgactgtggctcatattgagtgatttctttgggaaaagctaaaggaaagacattactgtgggctatcaggctgcctatatttggtgggtgccttcagttctttgggtaggctcctgggatcttttttggcctggtctttcccattgacttcatttgaggagcaggattccccaggtagctgggagacccctgagttacctgtggaccctgctgttgggaaaggagacttccagctgatgctatctctgtacctgcctctcccaccagtcttctttgcgggctctgaaattttgcttttggagatgcatcattgaggttttaagccataatgaaagagggtaggctagagagcttagatgaggcacctgtccttcataataatcctagccttcaaaatccaaaggaaaacagaagtgaagtgtgtctaaaggtcttcctaacttcattctgtggctcactgcatgttttgctgtccaaactgaattagctgtagttctccatgacctcatgttcccctaacccaagctcttcgcttattctctttcttttgcttctagcagatgacaaaaagtaataaggaggaacaggcattttaaccttaatgtttctctattttcagaagggaaaagctatccatcatttagtgaataaatgttattgaactttattttgtgcaagtgccatcaagagctgcttctctcattaaaaaaatgtagtcagttgagttttcagggctaggattaggcacttggggatacaagtgaaatagacctggtactcaccgtgtacagtcttgtagctgctcccagttttatgctgaggaaaaccaatttgttaggatgctacaaaactaacttcatctgaaatgaaagaaggtaaattaaattagctcaactcaagtacacgatgacatcagaatgaacaagagatgtttatgttttaatctactgaccataagaatgaaaaagagatgcttattttttaacctaatgacatcagaataaaaaaagaggtttatttttaacctaattttgcttttgttttacatttatgtggttcaaatatcaaagtgctgcaaaaagatatacctgataagtcttcctcctaacctggttcccatccactctaccgctcctcaccctctaagagtaatcatttctattggttatcaaaatagaaaaaaattttaccctgaaaatagaaattggtagctaggattttggctctttttcagttttgtagcattacgcatctttcattgctccactgtaagcagtgaattaatcagaccttttgtctgactgtgactgctgggttcccattctgtttaatgcatacagtgtctttcacctcttctcgcccctaccaataaataattaactttgtcttaccatacttgtttcatgcctccccattggtgcagtattcttctggaaagtgatgattcctctagaaaagtgggggaagaaagtaagtggaaaaaattcttggtaaaagtgcgtcttgccgaataagttaagattttaaagaggcaatgcaataactgattattttaccttttatacctatattcaaattgcacatttacaaatttaaaagtaactttgactttaaacacttcacttattttaaaagtaaaaagtttccttttcttaaatcaacaatcattttatagtgatcattaaaaattaggttagcatttttttctgaaaatacattatttattaaaagaatttgagttaaacacaattctaattctaccctttgtaaatttagtgctctacatttaatttttttggtatttatattacttgtatcttgatgcatgctgagaattaagaggaagtgagataaaaaattaaaaaaaaatttcactgctaagactttgaaccctacataggcactcctgcagctttgcaccgtgaatcattaaattctattattcagaattagttcctgtggtgggtctctccccactgtggtcctgggctggtggtgggtaaaagtagtaagtgactcagatgccttatacagaagattagcaaacttaactaaggcaggaaatgttggttagaacttgtgagtgtgtaatactacccccttacttgcagaccactgggatttaagagttgatttgttaaattaaaaaaaggtcatttgtgggctttctatgagcaagtgttctagtgttttgtttttagcagctaatagaatgaaagatctctaagagcttgagagaaatagttaattcaggcatttatgatattttatctccctgctccccatgaggagaaaatcccaaaataaattgatgtttcccttctgatctaagttatctttggctagtacatctgatcatgcactcataggtagcatagatttttagagccaggaaggtattcttagagatgaggaattgagacccagagaaggtaacttgcatgaagtctcaggactagacaactttctcttgtttaaatgtagtttgtaagattttgttctactgcccaatctatactttccagaaacatcttaaaccagaaacatctggtttaaaacattgacttgcaggtggaaatgaggttagaaaggggatggagtgggaagacaggtgttggtggagggagaagggagagtatggtgggcagtcatggagagaggttcttattccccatatttaaaattttcaagagcctaggattgcaggactttacttttttaaccgaagttcctcttgattgtccatagaaggaggtcattattattcacaggtgttctgaggcctaaatctatgtttaatttaaggagtgtttcagttcctaggaaagcacgtacaaatggtttagcttgtcgttccatcttttggtatgcagggaagagtgccaaggcactgtatttttttcatttaaaacatgaattcataagaattttatgttaagaaggagcataacatggtgggggaggacccagatagattcaggccagctgtccccaaagccacatgactagacctggtctttttatacttcactctttcaacacccacaaaccccctgaaaaacaaaccaaaaacagataagaaattggtagagacttttctttttcccaaagttgagcttttacagagaagaatactcaaatgaaggtgcagtttttctctcttctatttcatatctgaattatactgacctgaaatatacagacctacatgacaaggtttagcaaaatggtttgtggtacaaagcatggctgaccacaagggttacgattattttcaccctttataaatatatccccaaattgacttctgtcctagttgtccagtgaatttgtttatgtcatattcattgtttgtatacttacatgcttatgacagaattctgtcaattctataataaatattgcctttcaaaagaaatatatatgaaagtcttaggagaaaaaaattcccttagacatgtttgtttttactagatatgactaacataaaatggttacttataacctactgttttccagaaagaatttaagatggctctttcagttattgttttaaatctctgaaattgtctaaaattaatgctgttaaaaattttggtaacttattgaaagtcgcagttattaaatgcagcttcattcaaaattggctattggttccttttaggggaaaatgaacatctcttaattttaacttcttgacggtgtcacacctcccactgagcagtaaattactcacttcctgagaattacattctttccttgcagtactggccattagagctttattaaggagaaaaaaagaaatgatttttgaggatgctgaatagacaaaaactattttttccattgtgtttcaaatcatttttgggcattggagaataaaagcagtcatttttgttagtgtagattatgaatttgatttctggagcttattttctctgcagtattaaccaaagtcaaaactgacaaggcagagatttgctgactattgttggagattagtagaatctttagcaactctccttggtaaaagaaaaaaaaatcttgtttcatttgataagcaatgaggtttggagtcaacaaacctgagatcaaattaggtttgtaggagtcagttcctgtttcttaatttgtagtattatttaaatgacatttaaatttgagattcaatgaggtaaggagggggaaagtagctaaaacagaacctaacatgcagggaatgcatattaaattcaatgcatgtcagttgaatttagtttcctaactagtagcctttaatgttagagtagacataaaaatttctgaccttcgtttccctttgaatttagatttttgaaatgtaataaatacctattgcttttctcactgaaaataaaagtgtgttaggaaaatggtttaacaggttttaagtgaaatatttttacattgacataattattctccaggatgtccacacacttcctaagtaagagtttgtgattaaaagaaaacctatgcctagataacttgtgttagatcctgaaggctacccagttctctgaggttaggagttgcctggcctcaagtcttttaaaaagttattgattcaggccttgctaatttggaattaagctaaagttgacctttgcattaattttgaaggcaacgttttctgcacaaattaatttaagacatgataggagagatttgctgatattcaaaccatttgagaatcaaagcacttaaaaataccacatatcttcttctaattacaagtggattttgaaatagatcctcttatgattctgccttttattgacagctaccatggttacatataacttgataataaaaatattttgttttcaatttttttggtaatttagttcacttctttttcattgctatagctgagaatttgctatttagagccttagatagccaaggattcaacaggagaatcatctgtgtctgtttagaaggggaaggagggattccgacagttgagagatctgtcttttgaatagggggctttggaacagttgtggaccttgagcctaactatgggtgctgccaatgcttatttgtgatagtgctgtatctttttttgaattggaagtggggatgctcctggtgcccccgtgtggaaaactagtggtgcaacacctttaagaaccccagttgtgcaggattggaaactgaaggaagctaggacattgcctagaattttagaggttaactttgtgctttgatggcttaactctgtaagagtcagtttcctacagcaaaaaggaggatagatggtctttgaagatgctaaatagagacttaagagatggctggtgttatattgttctctgtgtttttatgtgtttaaaaaaatttacggaaatacttaaatacatttaaagtgattagtctgttgtttcagcttctcctggtgtatcctgggagattttatgctagtttcctgatagtcctcgtgaatcctggttgtaaaaaataagctgagacccatttattctatcctgcatcttcttccaggtgagggatagtaagggaactaagaaggaggaatagcagggaaggtcagaaaacacttctaaattatattactttgaggggtttatttgtagaattaaaattaaactgctagattaacattttcaattgtttcttccaaccagtaattccaagtttttcaggttaattgaatatagtgaaatatcatccagtgtgtgcatttcaaaacaagatgtaaaagaactgtgatttgtggcaccacatactaacgaggcttccctgaggtgggaagggctttggcaaggctgcagtagatgaatgttgactagtggaaaggctgacaatgaggcatgtgacaacagggctttttcctgctgaagacattaaacatattctggcttgagcaattttaccagttttcacagttttagcaatagggaacccaattccactctgtttagcaacagagtagaattaactgaatatttgcatgcaagatgctgcattttgacagaaatgagaattgtggtgtggtgacaatatttttaaggccttcgtaggactgactaccttagctatgtatgttaatgctgtaacttcttctctgtcttacgttctatcatggtatctcaacttttgcaaagaaaataatggtgggatttcttcccaaaaggacactgaagccatgaagagagcattggcctccatagactccaaactgaaccaggccaaaggttggctccgtgaccctagtgcctccccaggtaaccctctagttctgcttttctgatcaatacaacgagaagctaaaaaccaagcaaatgaaagaaagaaattttcccataatctcatcatctgagagaactactgtaacattatggggcataccccattatctgatagttctgagtaactgaagcaagtagtaggccttacaaggatgaagggaatagattcgatcacctctaatcacggaggagtaagtcatactgagctgggcattctttgcaaaatttttggttctccccttccctgaatccaaaaggtaattattttgaatgaaagttcttctcttccagttcccattgagcagacttccatttatgtcaacagagttcttaattaagcagattaaatcatgatgccaatgagaattggaaagttgactgtataaagataagacccaaataggttattgaactaggctttattgattttctaatctaatatttattctgttttagattaatatttgaatgaatgtgaaaaacctaaagtaggttggaggtgctaaatactattaaattgttagagtctgttttcatcatccatattcttaccacaagctacttagtatctccaaatagatacagttccaagtatctttttttgcgtgtctgttgttgaaacctcaccctatggtttaagggcactgcttggctgttagctatcagatatgttgccttctattcactcgtcttgtttaaaatcatccattccttggtgaatgaaatgacttgtaaagtatcctctctaaataatgaatgtgtcaacaatgtagttattgaatatctctttattttaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccaggtaaaagttcctctgtccttacagagcagtagtgggtaactcactcctaacagggtgattcagaaaacaagcctctgccagttttgagttatctctttggctagtagataacagagatattatagtctattaaattcttttgagatggaggtgaactttccctttgctgactttatttatttatttattattttttgagacagagtctcactctgttacccagactggagtgcggtggtgcgatcttggctcactgcaacctccacctcccaggttcaagagattctcctgcctcagcctcccgggtagctgggattataggcgcccgccatcacacctggctaattttgtttgtttgtttgtttgtttgtttgagatggagtcttactctgttgccaggctggagtgcagtggcgcgatcttgggtcactgcaacctccagctccgtggttcaagcagttctctgcctcaacctcccgagtagctgggattataggcgcccgccaccacgaccagctaatttttgtatttttagtacagacggggtttcaccatcttggccaggctggtcttgaactcctgacctcgtgatccaccctccttggcctcccaaagtgctgggattacaggagtgagccactgtgcccggccacacctggctaatttttgtatttttagtagagatggggttttgccaggttggccaggttgggctgggattacaggtgtgagccaccatgcctggcctgactttatttaaaacatgtttttatttatttatttatttatttatttagagacggagtctcgctctgtcacccgggctggcatgcagtggtgcaatctcggctcactgcaacccctgcctcccaggctcaagcaattctcctgccttaacctcccaagtagctgggattacaggcatgggctgccacacctggctaattttttataattttagtagagacagggttttaccttgttggccaggctggtctcaaactctcaggtgatccacctgccttggcttccaaaagtgctgggattacaggcgtgagccaccatgacctgccaaattttttctttttctttttctttttcttttttatttttttgagatgggagattcgctcttgttgcccaggctggagtgcaatggcgcgatctcggctcactgcaaccttcgcctcctgggttcaagtgattctcctgcctcagcctcctgagtagctaggattacaggaatgcgccaccatgcccggctaagtttgtatttttagtagagacggggtttctccatgttggtcaggctggtctcaaacttccggcctcaggtgatccacctgccttggcctcccaaagtgctgggattataggtgtgagccaccatgcccggccaaattttttatttttaatgacatggccttgctctgtcacccaggctcaagtgcagtggtatgatcatagttcactgtaactttgaactcctgggctcaagcaatgttccttcttcagcctcctgagtagatagaactataggcatgtgccactatgcttggctagtttttcaatattttgtagagataaggtcttgctatgttttgtggtctcaaactcctggcctcaagtgatcctctcaaaagtgttgagattaaaggcgtgagccaccactcctggcttgaacttttaaaatacacaaatgcctaatagtaaagttgaaacttgttccgtaattgaaactgaaacacaaatctagtttctaatttactagccataggcttatgaaaaataaaggggcagtggtgaagtctggcatgggtaaatacattttacggaggatggggagaaagaaacatagcgtgaaaacattggaattatttcacctcataaaaaaatcatttaactaggttatcctctaagttggtaatttctgggcttttttgagtttccttttcatgattatttattcggattcataattatttaccttccttttaccctcctaaagccttggcctttagagcttttctccccataaactaaataaacatagtttgctattgagaaaactcaatataatataaatttgtttggaattcatacagatgaactcatccatagtgataatgaagttctaaaagatttttatagaattttatggtatggacattacgaaaacttggaataggatgagacactcatgaaacatcatgagataattaggatacacagggtctacatacaaacagggctcagaaacactcctctacatgcagtgcaccattatacctggtctccaatattagtgcaatagacataagaatgcagatcttatttatttatttttattttattttattttatttttttgagacaagagttttgctcttattgcccaggctggagtgcaatagcatgatcttggctcactgtaacttccgcctcctgggttcaaggcattctcctgcctcagcctcttgagtacctgggattacaggcatgcgccaccatgcctggctaatttttgtattttaatagagacggggtttcaccatgttgatcaggctggtcttgaactcctgacctcaggtgatccgcctgctgcggcctcccaaagtgctgggattacgggtgtgagccactgtgcctggccaagaatgcggatcttaaaggcgtggttcttaaccttttgtggaccaagatcacttctatcatctgatgaaaacattcatccttacctaaaaagatgcatataaacatgcccatacaatattatgtataatttctagaggttcctggattccctgcagccctggaagctccaggactttcaggttgcgtctctatgttgaaggggaaagaaacagcttaaataaatgtgatcccattgagttcagtgaatcttttctcctgctgagaagcagtctcctctgtcatgagcatggtaagaactttgcaaaaaggacaaaaagaagttttgttctcattcggagaaatgccagtgcagtttgataggattcttggctcttctgatttctcacttttgtgtcttttgtctgcaaccttttcccagtgtggtagccagttttcacttggaattctcaaatacacagttgtatgtgtttagagaaagatgagtatgagcaagagaatgaggtagttattgtaggggttccaccattaatctgtaaagagaaaaggctagaacagtgaagggtaactatggtcctgcttcacagtggagcctgcaatatcctttcctgatgaaagattagaaagttatctccctgtagtcctttcttaagtgtacccagctgtttaatattttagtggctgaaatgcggtaacaatttcttcttgatattctgttcagtcacacagggtttctaggttgctagtatatatttttacccccatgagactcaataaaatctttctgttttgaatgaaaaaactgtgtagcccataaatagttttactttttcacagttggactcttttttaaaaaaaaaatttctaaatttccagcctcagagaagttattattttgtaatatacagttggactcttttaacaaaaagatctctcatcatgaagtagtagatttgaagaaaaaaagcacattaaatcctaaagactatgtttcctaaaagtcttcccctcttctgccacataaaaggaaggcctcaacttcaaggaaaaagtgtatatataccttttatatacccggcaataaatgaatgattcattacctcaagttttggtatagatgaaaaacagaataattttatttatttatttatttatttttttttttaggtttttcttttttttttttttttctttttttgagacggagtctcgctctgtcgcccaggctggagtgcagtggcgtgatctcggctcactgcaagctctgcctcccgggttcacaccattctcctgcctcagcctaccgagtagctgggactactaggcgcctgccaccacgcctggctaattttttttttttttttttttggatttttagtagagacggggtttcagcgtgttagccaggatggtctcgatctcgtgacctcgtgatccgcccaccttggcctcccaaagtgctgggattacaggcgtgagccaccgcgcctggccgaaaaccagaagaattttaaaaagaggctagataggctgggtgtggtggctcacacctgtaatcccagcactttgggaggctgaggctggtggatctcttgaggtcggaagttcaagaccagcctggccaacagtgtgaaaccccgtctctactaaaaatacaaaaattagccaggcatggtggcacatgcctgtaatctcagctactcgggaggccgaggcaggagaattgcttgaactacttgagaggctgaggtaggagaattttggctcattgcaaccactgcctcccaagatcgcgccacttcattccagcctggaaaacagtgagactccgtctcaaaaaaaataaaaaaacccacagaggctagatagatgaatgacagatcaatactattatgaagggaagcaaaggtgttttggagtttatcctaaaaatagaagttctgattaggataatcagccatgccattctaccaaatggtaaagttactgcccctatcattgagtttaccagcctgcttggattaaaacaatctggattgtaaaatgagggcaaatcatactttgtgacttggaaagtaaataaggaaaacaagtaaatagggaaagtaaatagagaaacaagtttccatgaactcatatcatttttagtagtaatagcatatcatttctgagagaggaaaatagtgaaatcagttctttaggaacttgatgggaaacagtggtttcctatcaccatgtgctcagtattagctagtttcgattatttatatatttataggttgcctaggaggaaggtaggcatttaagattatcattaggttcattataaaaatgatgataattcagtaataatgatagatttttattgccagtgttttcaagtatattattttgatgcttgaagccactccataagataagtggggaaaatgtattacctaccttcattatatgttaccttcactatataagttagaaaatggaaacccagggaggttaaacatcataaacaaggttccacaggtaccaagagtcaagatttgaacacagatctgcttgttcccagtctggtacactttcattaacactatgcgtgcttcctcctgaaacattttcaatgtatacttgcccataagaagacaatttaatggactatttatttcagaagcacacattactatggtaacaaagccctccctagcaataagatcaccagcacattttcccactgaagtttagattggattatgtaatcactaccaagaggagaataattatcaaaatttgctggcctggtcttcaaagtggttatgcagttccgtgaagctaatgtgcatttttaaaagaaaaagtacttgatttgggcgtcttgctttgtttatgtctgttttcttgtgctgtcccagatttactgggaaaaaggaaaaagccaagcatgttcatgaaaaccacatgtactgtgctattgggaatattttgtcattaagtatttgagggtgtacaatgacagcatgtgtctgttttgagcagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcaggtagtcacagtgattttcaggaggggtgggaaatatttcataaatatcctaagtcataaatatcctatctttcttctctgtctcttatcatttactgtggttggataatggtttctaagtgatgagtgacttccagcacttaccaatgttaacacctcctttaccaccacaggtttagacaaatgtttatctatattttgaaataaagatcttaatttacagcacttcagttaggtaaaagtaagctctcagagtaccaagggaagattgcagtacattggaactattccttgtcccagaattcacaactcttgggtcattgtaatgtttaggggttaaagttttccgatactgctctactgtaaaatgattttcaagcatttcacaaacacacatgtttgaggaactgaggaactaataaggtgtggttaattcagagatgagataaagcttgggaaaatattttatgctaatgggtgtaaaaaaattgattttaaaaagatgagagattgagtttcttatctaagaacctccatacaataataaagatcagaattataaaaatgattactggtatattacttttgaaatccttcttctggccttgttaagtttagtagaaaggagtgtgtgagtagatcacagcgtgctgcttctccgtttctatgtgtagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacagtatgtatttaacccttacattgccttttcatatcttttcttctctttctctctcccttccctctccctttctttctttcttcccccaagaacatacatatttcaattcccctaggttaaatgcacttatgatgctcttccactatattctcattaattctaggtcagatgttaatttgctgtatcagtgatgtaactgaggtttaatgatttattgctggtcacatagttataaattgataaatttaggatgctaagaactccttttttgagatgctttttaaatttctaagctagggctttctttgatacatcatgtttatgacctatctgtttcccatacataagaggaaaataatttttgtggctagctatgaaaagactcctatgtgtatatggaggggaagaagcgtaagaatgtactttcctccttccccagcaatgatattttgtaagtagcaagtataggagatacttaaattacatttcctggatgatttttcttgtaacaacagcctccccacagcctcctctcctaaagtctctcatggcacctactttgatgatatggaaaaggggtatttcctctttttttttttattttttatttttatttttttgagatagggtctcactctaccacccacgctggagtgcagcggcatgactatgcctcactgcagctttgaactcccaggctcaagccatccttccacctcagcctccggagtagctgggactacaggcacgtgccaccatgcctggctaatttttttattttttgtagagacggggtgttgctatgttgtcagggctggtctcaaactcaagggctcaagctatcctcccacttcagctttccaaagttttgggattacaggcatgagccactgcacctaactgctttcttctttcaatagatatttttcacttttaagaaaaaaacccctgcagcacatgctaaaataacactaaggaagggtttaatgtcaaatgtaaaagttgctctctatactcttaggacctaatggaagtccatatacatactaggtactctttaatgtttcttaatgatgaagaggtaatgaatggtaatggtgctaacagcagaccttcatgtgtggtcattcatgccatcattacttaatactatagcacacacataaacatacatctatgtaacctcttgccaggagtagccacgatcagaatcatgttaaagaccctctttgttcacctttataaaggagaatgttataaaaatttagaatcataaaggaactcttaagagagtatctaagctgggcatggtagctcaggcctgtaatcccaacacttggtgaggctgagggcgtgtggatcacttgaggtcaggaattcaagaccagcctgccagcctggccaacatggtgaaaccctgtctctactaaaaaaaatacaaaaattagccaggcctggtggtgggtgtgtaatcctagctactcagaggctgaggcaagagaatagcttgaacccaggaagtggaggttgcattgagctgagattgtgccgctgcactccagcctgggtgacagagtgagactctgtctcagcaaaaaaaaaaaaaaaaaaaaaaagaaaagaaaagaaaaaaaagagagagacagagtatctaaattagctgttctggcgcggatgggctattatttttatttatgtatgtattttatttatttatttatttatttttgagacggagtcttgctctgctgccaggctggagtgcagtggcgtgatcttggctcactgcatcctccgcttgccaagttcaagtgattctcctgcctcagcctcccgagtagctgggactacaggcgcacaccaccacgcccagctaaatttttgtatttttagtagagatggggtttcaccatgttgtccaggatggtcttgatctcttgacctcgtgatccacccacctcagcctcccaagtcctgggattacaggtgtgagccaccacacctggcctattatttttatttttacagatgagacagataaagttagcctgaaagttacctttctatggctgagaggacctgagatggaaaatgagtcagattctttgtatttttataatggttagaatttgaagtctttggaataaggtgttgggggcagtttttttctttgtgatataattgtggttgtctttttatttctgtgttgatacttggttgaggttctttggttggaaggacctggtcaagtaaaaagtagaggattattgaaaatagaggcacctcatcaaacccaatagcttgaatgtggccagatcttgggcaactggaagcccctccctccacctcttagtcgctgtgtgggatcctctatgtctgtttcaccctgtgtgttgacttagtttatttatctgggggttttgtctctggctgtgagctaccacggcccaggcttaatcactttccagctccagataccatcactggttgactatgcagtgtttttgaaatatggacccaggattatctgcctaagaatcatctgagaaggtcgttaaaaatgcagaccccttgaccccaccgcagacatacttaattggaatcgcttttgatggtgggtttaacaatctgtatttaaaaataagatctccagtgacttttatccacactggactttgagaacccccagaatctaattgagtgccttgcctgactgtgggtatgttgtccttgaggtagataaccacccagtttaatcagttatggcaaggactggggattatgtgataccaaatgtatagtagtttatgaatgaaggctgggcacggtggctcacgcctgtaatcctagcactttgggaggctgacgtgggcacatcacccgaggtcaggagttcgagaccagcccggtcaacatggtgaaaacccgtttctactaaaaatagagaaattagctgggtgtggtggtgggcatctataatcctagctactcaggaggctgagacaagagaatggcttgaacccgagaggcagaggttgcagtgagccgagatcgtgccactgcactccagcctgggcaacacagcgagactccatctcaaaacaaaacaaacaaaaaaaagtgtggcgactctgaagtcacggtgctgggtttgaatcctgactctatcaaagtaaataatgggacattgggcaagttatccaacctcatacctccattttgtttctttaataatgaggataatactgttatttacatcatagggttgttgtaaggattaaataatataaggcaactgcttatggctgggtgtggtaggtcatgcctataatcccagcacaggactctgggaggcccaggtggtaggatcacttaaacccaggagttaaggaccagcttgggaaacatcgggagaatgtttcctatctccacgaaatatttttttttttaattagccaggtgtggtggtgcatacctatagtcccagctacctgaaaggctgaggcaggaggattgctgcagtgagccctgggaggtcaagcctgctgtgagccatgatctcaccactgcattccagccagggtgatggagcaaaacccctctcaaaacaaaaaacaaacaacaacaaaaaattgcttgtaacagtacctggcagaattaggactcaaaagatagtattactactagtttgactataactgtttcagctgctcctacaacaaacatggctgcctgggcccacccagttccagaggaaactggtgttttcagaggtggcaggcagagggtgccgctaacctagtgatgattgattgagctccgctaaccaaatgattgatctgagctttactgatgcaaactcatatttaatgtcttaactaggacaaaataatctgaatgtaaattattaatttcttatgtaagggccaaataaataaaccactcctttcaaaccaaattaatagtaatcaggagcaatttgtcatcctattagcatttgtcattagcagctaagtgatctcaatgtaaatagtgtttatgtgtgacaggatggctgtctttttctctgtagggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtaagggcagcagtgcactataacctcattaaattggtctcagtgcaaataagcaagttgttgataggggtcctgtaacatctgtaattaggtaagggttctttagctgctgataagtaactgtgattccatttccaaatgcagccagtaaaattcctgtgatgtaatcaagaagcagaccaggcatggtggctcatgtttgtaatccaagtgctttgggaggctaaggtgggaggatcacttgcgcccaggagtttgagaccagccaagcaacatagcaagaccctctctgtacaaaaataaaagagtaaagaattggctgggcatagtgatgctcacctgtagtcacacctttccagctacttgggaggctgaggtgggaggatcgcttgagaccaggagttccagtctgtagtgagctatgatcacaccactgcattctaacctcagtgacagagagagaccatgtctctttaaaaacaaaacaaaaaagaacaaaattctaagttagttatgcccagtgttgtgaggagttggagaattgggcacatatataatttactggagaaataaattagtacaaactttctaaatttggtattagatgtcaagagctttaaacaaagttcatacccattgactcaggaaattaagggtttcttccctaagaaataattagagatctttctaagaagttgcatacaggaatatatgcatacagcataaatgtttaataataactgacttgtgaaataattattgttaatatgataaaatattacatagattttagatcatgattttaaaagatagtgaaataaaaataaagtgttaaataaaaagaactggctgggtgcggtggctcatccctgtaatcccagcactttgggaggccgaggtgggtggatcgcctgaactcaggggtttgagaccagcctgggcaacatagtgagaccctgtctctctaaaaaaaaccaattagccaggtatggtggtgcacacttgtagttccagctacttgagaggctgtggtgggagggattgcttgagccggcaggtcaaggctgcaatgagctgttgttccactgcactccagcttgggtgatagagcaagacgccacatcgcaccacagaatggcattgcaattgtctcctctgggtcttgtaagtttcattgtttttctcttggtccaggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggtagaagtcaggagcacatatcattttactttttatgcttcctattattgaaagacgagggaaggaagagagagttttgaaaaatacataatttctggggtctagggaaaatgaaaagagtgtgaccaaagatataaggaaatctagagcttattaggaaaaagcttgctggtatatagtagcaactaaatttgtgttttccaaattccactcagtcaagagccctttcgtgatttttgctctatccacatatcatctgtacttttatttagccaatatttttcttaaaatggactttttttttttttttaaatggacttctttttaaaacttaaatttatttaagagaaaactctgtgggccgggcatggtggtacatgcctgtaatctcagctacttgggaggctgaggtgggagaatcacctgaacctgggaggcagaggttgaagatcacgtcactgcactccagcctgggtgacagagcgagactccatttcaaataaataaataaataaataaatgaaagaaaactttgtaatcctgaaatcttgggtttgataagctagttgtattttttctattatcctttaaaagaaacacataattattaaaataaaaacatttgcccatgtaacacctaaaattatctcaggtatcaccagctagtttatgctgcccaccttgcaaaacaatgagggtgatggagacttctttgtatatatccagaaaacttaaattggattaaatgtgatgactatgaaaaagagcttgttcatggcttctaagaatactcttatttagacccatgttgagaaattgatacagatatttgttattgagtttttctagaaaacttaattgaaagaacctggattaaaaaattcccattcttgatttctttcctcttaagacaataaattgcttagaatttggcactacatccaccaaacaatccttacagttactgtgatcgttatcaggccccgccagcactggcaatggtgtggaactctagcccatctctgggccttctttgggctcaacctcatgattctcagtatcatttcatggaggccaccaaaaaaggaagtagggttccttgattgagtggaacagtctctagggacatgtgggtcatgtcttatttctactacaccactaatgtcttacagggcaggattcataaattacacctgttctgtgctagctcagtgctttgtacacagttaacaaatatttattgaatgaaagactgaatagatgaatgaatgtcagtgaagtaagggcattagtagatatgctttgaggatgtatctggacattttcatatgtaaacaatgtttttaaggatctaaaagctcggatgcaggaggccatgactcaggaagtgtcagatgttttcagcgataccacaactcccatcaagctgttggcagtggcagccacggcgcctcctgatgcgcctaacagggaagaggtgggtatctgaggtcttccatttttctgtcagcctgtgctataggtatatgtaaaggtgaaatgtgattacagtggacatcaggatcagtggttgggaaactgtagatgaagggtggaagagcagaacagggaaagccctaccacctctacttttagtctccacgtatatcagtgaggaatatctttagttgcaagcaatagaagacctgaccatcagagatgaaaacaaccgggtttgttttcatcacaaaccaagaaacatggaagtaggtggctttggcattggttcagcagctaaatatcatgaaagctggcatttctatgattttctaggtcattttctcagggtgtgggatggcatcatgttaaatgcaggaagaaatgaagaatgggggtactccagtcacaactgtgcctttcgagtcaggatgatctttttaaatcaatcgatgtcattcttatactcagacccttccaatgactccccgctatcccagagtaaaaccagagtgctaacaatgaagaaaattgccagcgatgtgctggtaagccaactctccaggaaaacgaaaaaccttgatttgtaatgtttgttgatttccattatgtaaatactcccacggtggctgtttcaacatgaagtcactgaaacctgagttgggaagagatggacatgtttcgctcctgtgagctggcacgagtcggtacaggtggctttagcacaccactggatctggtccccatccatttctttgctctcgtgtggtaccactcttccccctcatgctacatctgtatgtacctccttgaattgtattcctagtgtgtatttatatgttctaatcttggggcctttgcactcgtttgttccagtcttctccagataaccatatctattagttactgtctttcttcagctttctactgaaatgtcactttcgggtgaccactaagataacaccaccaccccaactactatccccatggatttcttcatctccatatcctactttttcacttagcatttatcaacatttaatgtatttacccatttttcatttttggtttgtctgtctccctcccactaccatgaaagctccatgcagggagggactttattctgtcattgccttattcccccttcttggaacagtgcctgccacattgttggtgctgaatgagtgaaaatagaggctttcttagaaattgtccaggagagctttgctatgcctcattggcttgaactctgtctcatggccaccctagctgcaaaggagtttaggaaagcaagtatttggttttccagcctttatagtattggcagcgaatgagaaggggtttgggtcaggtacccaagacagtgtagaactggtaggtggaggtttttgttattatgtgctgattaccccagttttctttctgtaacctgagttactaggcagttcagctgattgttcccttaggctgagatgatttgctatttttttaattccagacttctctttcaggctagtagatacatctaggtgggcctctccacctacagtcttcctagttacctcagcatatgttgtccttctgttctctctcagaaatttgtgagttgtcattgacttttcccttccccacacccgttcatacaaataaacaactaaggcacactcatttaatctcacatccattttctgttcatattgccagagctctaattattttcctagtcccctagtccccctagagctatgactgcatagctctaactggtcttctttgactctttcactaggccatcaatcaaataaaaatacaacctgactctgacattctcctgcttaaacccttcagtggggcctgtactttcacagaggataaggccagggctctgtgatctagctctgacacttcccatacctgtttcctacaaacccctccctctcatttctggccctagctatacctagttgcttgtggtttcctgcacagtctgtcttttccatgtctttgttttttctgtgtaattatcttccccttcttttttggtgaattactatttatccttcatcctattatcctttgtttcctagagaggttaagtgctttttcttttgctcctacctatagtatcagtgcttagctctattattgtacatagcacactgtattgtaaatctgttttcgagtgcttttttctcactgggctgtgagttccttgagatgaggatattgtgttttactcatttttgtgtcctcagcacctgtctcagggtctggcacatagtaggtgctcagtaaattttggttgagtgacgagaaaagcaagttaagcagttagttaaatcagaaggagcagcagtcatggtctggcattgagatggtcaaccaaggatattaggtaggtaaaagcccaggagatccagagtgtgggagaccagctagggtaaaagaactgaggccacgggaaggaggctaggagatcagggattttaggcagagattctcagcattaaatggcaggaacccatgtagttaaatccaaacaagaggctggcgtggggaagagacttgagaagatagacacagaacactggcaatgatttggaacctgctattgaaccaagagacctttagagattgtctagagccagaactgatctccaagttaggcagaagttgacaaaaaagaggacgcattccactaggcagctccagacatgttcgtgtagtgtataaacctgacccagtgctgttgggaagcatcagttctaataatgcagtaagtaagtaactgaatgtgaagactaaataaaccccattctccaaagcttatcttctagtttgaagaagataagcttttgcaagaatctattctaacaaatgaccaaagatctcttgctactttaagtttaatagtcccctccacagtatgcaaccttgcacagtatccctgttaaaggaaacattaacttttttagaatttgagagctgaatgaacaattaagtagatgattttgcatttggggttaataaaagtcagtcatccttgccctgaggcctgagtgtgagcaccagctatcatttttcccttggaggtcaatggcagagtttttacaacattaatggtaatgggatatatgaaggatgctgctctggggagcctggagctcaatttaggactgtgtggatgttctgggcttttaatgtacccagctgcctacaatagagcctggagtgggcttgactgtcttcttcaaactagaagataagcttttgagaatgggggttgtttagtcttcacattcagcaaattactgcagagtatataatgctcctgcttgtacctggtaagcactggttgaactggaaatgaaggttatgtgcgtgtgtgtgtgagtgtgtttgtgtgcatttgcacatgatggtgatggctaaacgtctgaggagatccatcaaggccaggatttggagtttgactgttgttttattaactagggtttgatgtcatctctaaagtctttgagcagttgctgcccttcttaaaggatgaaactttttcttaggctgcctgacccattttattgaaataaatgttcttaatatctgttttttcctcaaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggttgggttttgctcattcctcatacagtgttcagtaaagaaagttaattacagaacagtttctatacatttttgaatacttaccgtaagatggcataaaaaaacatatacaggccagcacggtagcacctataattccggcactttgggagggtgaggcgggaggactgcttgagcctgggagtttgagaccagcctgggcaatacagcaagaccccgactctaccaaaaaaaaaaaaattagctgggtgtggtggcgcatgcctgtgaacacagctatttgtgaggctgaggtgggaggattatttgagcccagaaggttgaggctgcagtaagctttgattgccccactgccctccagcctggggtgacagagcaagaccctgtcaccgtctttatacattttcataacatttgaatttttttttacaaggactatttattagttttttttttttttttttttttttgagacggagtctcgctctgtcgcccaggccggactgtggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatcttagttttgaaagtagaaaaaattagtaaagcaatccccttgccacatacacacataactaggaaaatatttggataatcttttttttttttttttttgagggacagagtttcgctcttgtcacccaggctggagtccaatggtgtaatctcagctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccgcccacctcggcctcccaaagtgctgagattacaggcatgagctactgcggccggcttggataatcttaagaggctactttgttttgattttggagtttatatcttttctccacatctttgtgagagttttttttttttttttaaattgatctgtttctataactttcttttttctacttattgtgtaacaaggcatggctagtaagtttgggagcaaaggaagattgggaaaaaaaaccaaactgtacagttattaaaagtttactatgtgataggttttcttaaaaatattagctcaacattatttagtgtgatgtttgtgcaatttttcttctattcaaattatagaaaattcattattttttcatttatttattcagacatttactgagtgcctatgatacattcgaaactatgctaggctttataaatttgtgatactggcttatgtgtgaacttgtgaggagatatgggggaaataaacatgtctctgaatcattaaacttttgcctgtgtggcgtgttaataaattagatcctcttgtccaactttttaacttgtccaacttttacacaatttttcataagctacaaacatgtctaacactctttaaaagctcccataaaacatggaacataaaatacaatttcaatatgaaactgagattcctaaaaaggaggaacaggaatctaggcttataacaccaattatagataaaatgaggactctggagacagatttggacttgagacctctgtgagtttttttttttttccgagacggagtcttgctctgttgcccaggctggagtgcagtggcatgatcttggctcactgcaacctccgcctccggggttcaagcgattctcttgcctcagcctccccagtagctaagattacaggcgtccaccaccatacccggctagttttttgtatttttattagagatggggtttcaccatattggccaggctggtctcaaactcctgacctcaagtgatccacccgcctcggtctcccaaagtgctgggattatgggtatgagccactgcacccggccgactcctctgtgctcttgatgcttagtctctcatctgtaaaatggagctaactccttcctaatggactctatttggattaagaatatgcatgtacagcctgtatcttaccagatacgtggcaaatgttaatccttttttccccaaatgctgtaactgactggccaggacctcttgagcagtcacttaaattttctgagacttggtttttgcatctctaaagtagagatattaactgtcctgtctcatggggttgttgtgaggattttttcttcatattattcataaatcagttttgagtacttttcggtatccttcttaatggtgatttttaagatggaagagttgacatcaagtgtttaaacatatgccagttttgtgtatgttcttctgaagtatcaagtggacactcatttactttgtcactttattaccttcttaaaatcaggctgtgatggtaaaaccttcctgtgaagggcccattctggggagctgtttattgagaccaaacctcatgtattcagcctgaaaagagacttgccactttctggctttacagtgccatctgtaggtaaagaggagaaagcttggctgaaggtttgtatctggagagcaagggtgctctggtgtttaaaggtgttttgtcattgtcaggtggtctcggctgctcgtatcttacttaggaaccctggaaatcaagctgcttatgaacattttgagaccatgaagaaccagtggatcgataatgttgaaaaaatgacaggtagagttttctatacaaatcttgttgtctaatccatgaagaatgagttctgagaaattggagcgggactggttctgttactcagctgtaattggataaagggccggtcacgtgctgagcagtgtacttggctctgcttaaggctgctgagcagtggcggcttctcattcaagccttgcaactttgtcagaagagagactctttgagtctcttttattttaatgctgccctcctggcgtgatgtttattgtcaccactcctatcttctctttgaatagtgtctttgcccagtccgagcccgagtttggtttcagaggctgggaggcggtgtttgtggatacagtaagtgtccctgtcattttcagtgggttcacatttcaaggaaccacaatagctaccatttaatacaacttgtctcaaagtttcctccaacttatcaactacgtagtttttttaaaaaggagaaaccaaccaccagcaaacctgtgtctgtgcaattgaagtggcacctctgaatcgtcttcattctctgtaaagggagagataggaaagaaggaatgaggaatgtaggctttttgctgtccctgcagaacctgctgtgactggggtccatggcagcccgagatgaaagtggaactcctgaggtgtctgaagagaggtaacaggaataagaaataggctgttagggttattggaatcctccgcatggctcatcttgagcactacaagctgccaacaagcaacagatggctggggagtgagagggacagggagaaaatattattcacagataacgtggtggtgatgcagtgatggtttcagacatattccttgtttcctcccgatgttgcatttctggttgtctggggtggatacaagaaggctggcaaccacggttggtataaatgctgcaaatccagatgggcttttgggctatgtcctcactgttttttttaactgtggtgtttacctggaagcttttgattatgtaggaagagtttgagctgaagaagagaattctggatgttatactttctcatgagaagtttgagtggataacagtgttttggagtttctgttcttctaaattgaaactaaattccatttctgttttcctaacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggtaagcaatgcatggcactatgtctcacctccactgagaggttaactcaggaaaggtcgtgagggaatatgtaccccacaaccaccacatacaaagtctgggggcaaaaactatagacacttagtttgagaatgctagattaatctttttccatccaagtctctgcagttatcagcaggcttgttgtatgttagtttttctggaccaacttctctgtgctttcttttttttttgagactctcacccaggccagagggcagtggcatgatctcagctcactgaaacctccaccttctgggttctagcgattctcctacctcagcctcccgagtagctgggattacaggtgtgtgccaccatgcctggctaatttttatgtttttagtagacagggttttgccatgttggccaggctggtcttgaattcctgacctcaggtgatccacccgccttggcctgtcaaagtgctgggattacaggtgtgagccaccgtgcccaacctctgcgcttttttagtgctgggattacaggtgtgagccaccgtgcccaacctctgcgcttttttttttttttttttttttgagacggagttttgctcttgttgcccaggctggagtacaatggcacaatcttggctcactgcaacctccgcccccgcctggattcaagtgattctcctgccccagcctcctgagtagctgggattacaggctcccaccaccacacccagctaattttttgtagttttagtagaggcagagtttcaccatgttggccaggctggtctcaaactccagacctcagttgatccacccgccttggcctcccaaagtgctgggattacaggcatccagcctgtgctttcttaatatggtctggctaaatagctcctcgccttgttcagtcattattttggaaaattttcaaaagatgcatgataaccaatttaccatccatttagtttatgtaactggtgttaacttctcttgggcttttcttaaaatgcttttttttctttgtaaagcattctcagtttctatcaaatctggagggcttaagttgatctgtgggtctcctaggccctacacctaaagaaaatctgggttttctttaggtgaattttgatcatatttttggtactaccatggcagatcataattggagccgctcctttggttgaaatcatctgaattccttcctgttttgaacatctgatgttttcagtcttgtctatgagtagaatgcagtcaatgcaagagagtaggaaggaggggctcccctattcatctctggttcaggcagaatctttctaatatccaaaacccattatcactaaggacatgcttggtttcctaattggagtttctaatagtagagtagattcctgaattccaggcaactgaacagagtagcgcagctcagcataagggttaacatactgaatgccaaggacagcaaaggagtagagagaaaggtgagaagtacttcagggaatgtatgtccaatctgaaactgacatctcccatgttctgagttgggcaggcttatctcttgactgcctcatcataagagaggtgatggatgccacctgagcccaaagtgttcatgcccagggatctcctgggtactttttagttgtacagccaagaaggcaccctgaacactaaaagaacagctggtttgtgatgcttccaatgctctgcaggcctcagggcatctgccttgtcctgcctccccccttcttcaatcactgcccgtgatatttactggcagcttcacatccagcttttgttcatggaaccagttctgctgctgcacagacagtgctttggggcactgacccacccagctgaaagtgaggatgtcttgtgtttaggactgcaaaagagcttcctggactcaggatatcggatcctgggagctgtggccaaggtcagagaagccttccaacctcaggagcctgacttcccgccgcctccaccagaccttgaacaactccgagtaagtaaattcagatatgcagagaattgagcaggaaggtgttgagacttcagcaagagagaggtagattgtgttttagagcctccatcactaggtggcttcgtttagctttcatttgaagcttagtgggaggcagatctcgattttcattcctaaatccagtggagttataacctagtgcttatatgcatgggttgtgtgtgtgtgtgtagtactggtgtgtgtggtagtggcttgctgtgatggggagcggctggagcagaggagctggctttggtaagtgtggatgtgatgagtgatgaggtagtgcattgtggtaaaataatctgcacagcttggagtaaggagatttggtgtgttcttagttgataatggtagaaccgaggtggttgaaatcttgtgttggttctttcctttatttgacttttttttaagtaacaagatacatgcttttaaaaaatttttccctaactataatttaagatctttagataccttccccactaccccccgcaagtactgtgaatatatttttacatggtgtaggaagaagctagctaggcagtatgttgcagacacaaattccagaaacagaaatagtgattatttctagacacttattccaactaacagtattagaaataccttgactttgtaaataacttatcaaggcaataatctgatttactttcccatatttaatgtcagtaaaagatgttaagtttttaagttggttgagtacaaaattgtgtcatcgcacacacagctaaggaacagtgtttcccagccttcaacgcatcttagattcttcccagctgggtgcttggtgggtgtttagagctgggagagagggctattcctgggaatggcttcttatgtgagcaacagagttatgtcatttagaatctggatcttagaggtcatttggtctagctacccctcagtgacagatgaggaacctcaggccaaggggagaagttacttgcctatgtagctgctttctggtagaaccaggaccacaacttacatcttctgtagggactttttgagaatccttcatctggtagcactgtgtatacttccctgggatgcaaccaaaacagtagctgcaagccttttttttttttctttttttcttgttttgagatggagtcttgctctgtcgcccaggctggagcgcagtggcatgatctcagctcacggcaacctctgcctcccgggttcaagcaattctcctgcctcagcttcttgagtagttgggattataggcacatgccaccatgcccggctaatttttgtgtttttagtagagatggggtttcaccattttgggcaggctggtctcgaactcctgacctcaggtgacccacctgccttggcctcccaaagtgctgggattataggcgtgagccactgcgcccggccactgctagctttttgtagagaaacctgcttctgttgagattgaagcaggtggtccttgtggctcagtgtgggtggtcttatgtggagtcaatatgggtgggttttctagggatgctttttagaagaaaggaaagaattccaggggggagtagttttaggactttacttacaacttgttttctcttttttagctaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttacctgtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatgatcagagctccaaatatgaattgtgtgggctgtgctaaagctagatgaaatgtttgcattttctttttttttccacagaagcaagtagattggtatcttagaagccatgtgcttttgtcctttctcagaatcatttcacctgtcaactcaagacagctccaggctgtctcttactcagcaaatctgaaggtgtaaatattaatgtggttggtaaaaatatggatgctacagcagtcttgccctatgaataacttttgcctattttcccctaaatgatgaaaagtgagcagtagcttttctagataagaggaatattattgctaaccctgcagtgaaaggtagctcttagttctaaactgtttctaatatgaccctagatcttttttttaatgtttttatgaccctagatctttattcccaccacctatttgcctttattctttacacatcctcaaagctttcaagctcttgtgtcgattgtatttcctcagggacctcctgcacctgcagctgatcttggatttttttcaggctgggaaattcacattggtttttaactctgtattttgctgaactgttagctgtgagcccaggttctaagaaggaagggagactttgctggtgttggacctgacctgtagaattatttataatggtatctctccaactgcatgtggcagagccccactgtgcatggggagtgggggagggtgacagtgaagattttaaaggaaatttaaatttcattacaatgaaccaaaatacactatgcagaacaaaaaatatacatgaattatttaaaaaaacaaacaaacttaaaagcagacagcattggcccacattacttgccccactctgccatttgtggccagaagtcctgaggtctatctcctgaagtgtgcaagatcaggagtttgctgactttgagttgtgtgaagtcagaagctacttgaaccatgtgtgtactgggctggggaggaatatctgttcgtgtgtctgtcaacctatctgtctttgtacactgtgggactctgagccttagcagcagtgagctggcttttcttctgagcagcagagatgggtcttggttgagtttaggcaaaagagtttagatggtatctgaaccccttgttggccctgaatcctccaacatcgtcaccctttggagtcaggtttcatgtgcaggttaagacttttaggagtggtaacaacctcaaagaaaattccatataaactacttcctcttgagtacagatgtttgatgtaaagaacctgtattcatcattctttgtataaatggtttggcttcattgtggcagtttttaattttctttccatgttagtctattttcagcatctggcttttataatctccatccctggttctaaattcatgttctctccatcatgattctcattcttaaatgagcaccattcttctgagcttctgtgagctcagctgcagtcacttgccaagttcacatattattctatctgtgaactagataagcagagtttggggtgagtgagaacctattttgcaagcaatttaggttgtacccaaggagaagctttctgaggtggtactagcaatggatgcaaaaagagatggtagaagctttgcctcagaagaccttgaggggatagagagctggtctgatgtgtgggtgttccctgagatgggcggctgacgaggtggcttcttgaggctccttacagctgggtgacagtggggtacttaagttctcttcagtcaccattgtgtttgtttttcctgcctctttcctagtttggtattcgttacctctgatgtatcatttttaattctgggacttttaactcatgaaggaaataatctatgtctggcagctgcagagctgacccaaattgcctcctgtgtcccaggaaaatgtagaacagtgaccatatgatccagcagtgttcactttgttctgtacaaagtaacttgtgtggctgcatttactttttctctccggattccttttaaaggtaatttgctactatcgtttggttgtttggctcctcagaaatattctcatgtgagaatcactcttgtcaagtttgactttagtatcaagtatattaaagaaatggatgccacttgctttcttggtgtaaagatttctctagaagccctttgccattggagtgagtcccttttcttctctcaccacacagtggcttgggctgagtggcgctggaggctgagaattcccccttctgtgaagcttggtacacaaggctcctagagaacatgtttctttctcatcctaggcaggctttggttactaaaccagctgaagcccagtttcccaagtcgtattgctcttactaacactatccctatttctcatccttcccgccatcgacaaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaaggtactgataagcacccccagttgggggctgctccatatgcatccggccatgtgcagccttgacacattgcatcactcatgatctgtgctggtcctgtgagtctgagcagggcgggcatctgtctgtctgcaccatgttgttaggactggcttcacaagtttgataggtctgctaacgccagattaattggactgcatttatgtttaggggatgaagagagatggggggggtcacttttggaaaggattccttttcttactgattttgtggccatcgctggaaaccccttgggaagccgtgaatgcatctctcaatgacttccaggtcaggaaccatggtagaccattacgaggtcacctggcctgaccattgagctttgcctgctcccaactgacccctcactgatggctcagggagagttgatgagggggagaggcagctttatagggcagggtctctgggggaggactgcttgctgccctgcacttggctatgtggcagatgctggccttgatgggagtccacagaaaatggggcctcactgactgcttgtccaggtatctcagtgggagggaatgggagtgggaaatggagtactcaaggccacaagacaggccgccatagaactttggccttggggaatgaaccaaagctagtttggagagtagggtgattggggtgatcacttttccctttaaaggtggcatgctgcaagaagaaaggctttgaagagtgatgggtagtcactaaccatggcactatgctatcttctaaccaacgtgatggggtcctggaatgatcctaggtctgcactagaagaggtagacccagaggaccttgtctaacataccccttgcttcttgacttcttcccatacctgcgttctctccggcctcaattactgcctgagatgttacacccttccagcataaatgatgaaccgcttcatggtgcctgtagaggcctcttgcagagcaccctgcagtggtatggtttgtgtatgcctcactgcactgtagagaaatgaagagcatgaggggaaaaatgagtagggcctggacttttagctagttttgaacactgcagttgctatgacttggggttgttagcagccaaaagaggagctttcatgagagggcacagaatacataacttgtctgtttctttactatgacccatgagggttttagtaaaccaaaatgccaagtctaagataaactgccattccttggagtgagggttccatttacagcctgaatcacgacttttattttcctaatgccttctcttgcatcctcttagctgaaggttcctttaactggagtcttcacttagctgaggggactgaagaattgattctttacccttttacgtgggaaaaattaaagcaacatgttcgttcaggctgacaggacaaataagaggcagtagagggatagccagagcaggctagatcagaaaatatcttttttttttttttccctcacccagctgagaatagttacttgggtttgaaattctagttaagtagcaagaacgcttggctgctatttgcaacaagggtaagcatgaagagggtgatttcagcatctggaaaggctcctctgtatttttcccctcaggccagctctactgctttctccctatagaaatgaaagtgcctgtttaaccagctccttggccctgtccccagtttattgatatgattaacctggagatgccaaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaacatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgtgtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaattctgctgcttatttatcgagtgccttttctgtgccagccactgggaatacagaggtaggtaagtcttgccttcaaggagcttgtgggcaaggcaaacagagaaacataccaaattaaactttctctttaggtatgtgagcgaatcccaaccataagcacccagctcaaaatcctgtccacagtgaaggccaccatgctgggccggaccaacatcagtgatgaggagtctgagcaggtatgtggcagctgtttttggtttctggctggcagcttctgtgccgttttgcagtaatttaactctgctttggggaaattttaccccttaattgagtatcgagtattcagtatgtgggatgcactcagactgtctcaggaggggaaagtctgtgttggatagatacatcagaaatttggaattggggccaggtgcagtggcacatgcaggtaatcccagcactttgggaggctgaggcgggagaattgcttaagcccagaaggtcaaggcagtaagctgtgattgcaccactgcactgcagcctgggtgacagagtgagactcttgtcttgaaaaaacaaaacaaaacaccaggaattgggagccaggtgtggtggtgtgcacctgtagtcccagctactcaggaggctgaggcagtaggatcatttgaaaccaggagttgaagactagcttgggcaaaatagcaagaccccatctcaaaataaatagataaataaataaataaataaataaataaataagtaaataaaaggaatctggaattgctcttgggcaacttttgtcattttacagataggaaactgaggtctagagaggttaagtgtctgaaataacactatggatcagtggcagttaggactctactcagttccttacccttggaataagtttggctcttttgaggcctccagtgcctgttcatttcaactcactgtatgtttctggctggagagaaggtccgctttccagctctctgtgtgttagtgcctcagggaggatgaatagtgcaggcttttccggggcatgaggtagttaggcctgtgctgaaactgaaatgacagctcaaaggaggtgcttctcttatattctctttaggtttctctgatagagatagaaataaggatgctgagaaggttctcttaaccactgcttcctgcatataccttggcagtcacccaagtttgtcctccttcccaaaatcttggcccaggtctttcaggaaaccctcatttgagcaccccttactctccttatttcccctccgggaggccctgctctaagcaagattcccacatggactgcccacacagggctcctcacacatggggtacatagttttgttggactagccacacgaggctcatcacacatgggctaaggtgaagcactgtattaggtgttaagggagtttaaaaaattaagagacacaattccccccacccaacgtggggaactcaaaaatagtctgaaagaacaactgtttctgatctctaggccaggagatagggcactggggcactttagaggaaataaggcggccattcttcttggtgccattattgttgcttctgctaccatattctaatccaacaactctcaccctaatcctctcttctcccaaaccatgggaactgtatcttcacacctaacttccacatattctatgaagggtttgcacacttcgctgtttctatgtcatgtgatctcttctgtccaaagaaaggtggaaaaaaatggggaaggaagggtaagactgagattcaggcctaatcagagacttaatcaattaaccactaaaaatatgccttgagaatatctattatgttccattaaatattccagttttaaaaagggtagaaattgacagtatggtagaatggaaaaaacacaggactgtttgggaggctgaggcaggagaatcgcttgaacctgggaggcggaaattgcagtgagccgagatcgtgccattgcactccagcctagttaacaagagtgaaactccgtctcaaaaaaaaaaaataataataaaataaaataaaataaacaacaacaaaaaacaaaacccataggactataagtcagaaatcctgagtcctaattctcactctatgaatgtctctgggcctgagtccctttgctgaccaagtgaaaagaacaactgatgaggaattccagcccacagttacacttatcagagcctgtgaaactgagtgtacaaattttatgcaggtgtgcattttttctgggggagaattcaccgccttcattaaatcctcaaatgatgtatgacttaaaaatagccaagaattactgagctgatgaattgccaagatccttccttgactttctatggtagagtaccaatgtgatttcagtcttataagtttgtgcgtttgtttgaaagattaacgtatttagattttcatgggtttaaagtggttggttgcttggtttgttcatttggttgtttttaaaattcattaattaaatatttatgaaatacctcctgtgtgccaggcaccatcctaaatactgggggtatgacagtgcacaaaattgacaaaaatctactctgtataacttaaatgttagtatgaagacagaaaaaaccctcaaaactcccaaacaacctaggtaaaatacgtagtgtatcagttcgtgatgataggttcaatggaaaaaataaggccaagcgcggtggctcacgcctactgtatgtagtcttagcactttgggaggctgaggtgggcagatcacttgagcccaggagtacgagtccaacctgggcaacatggcggaaccccatctgtacaaaaaattaaaaaattacccagatgtggcagcatgtacctattgtcccagctgctcaaaggctgaggcaggaggatccttgagcccagggggcagaggctgcagtggccgagatcacaccactgcactccagcctggatgaaagagaaagaccccatctcaaaaaaagaatgagcagggaaatcctcaccaaggtgacaagtgagcaaagatctgaaggtgaggggatccctgggatccctggggaaagagcagtccaggtacaggaaacagcaagtcctgagggagaagcatgtttgaagaccaagaaagaggacatgctgtaagctatctgaagccacagtatacaatcagcgatggccagttttgggttctttttggtgatctgggaaaacccctagtgatgcaagcaaatatgggggatgccaggtaccagtggggttagctgcatcccactcctggctgaaacctattttagagacaggcctgcatcagggaccctgggtaacggaaagtacctttttccttgcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtat

SEQ ID NO: 35718 - DNA, 122041 bp, Homo sapiens; identical to SEQ ID NO: 35717

SEQ ID NO: 35719 - DNA, 17058 bp, Homo sapiens
gctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgtgagtacaggaccggccccggctccccaggaccgcgcccccgacctcccaaggacccccagcagaaaccagcccgcgacccctcccgcctgcagcccatcctccgcccaagggctcccgccgctcgttctccgatcggcctcagcaccccccgaactcttctgacccgactgggccgggccgccggacggcgcaccaggccccctttccggcagtcgccggtagctcggcccagaaatcgactccgggtactgacctcttgtgcctgagtttttccaccatccgtgtcaacgcctcccatgtcccccccaaatctctccataagaccccatcgctaccccagacacacacaccagaccacttaacgatggccttcatcctgccaaggaagaggttctgccatctggcagaaccctcttgtgccagatggggagctctatccttgagggaacctatgccctcccccagcccccactcccatgacaatcctggcgtgtaccttccttttgtgctgccctgcctgcttctcaaggtgagggttgggacacaggaccttgagtactaaggtcctgagtcactctcaatccttgtgccagggtggtggtgtacggggcctaattggaggatagccttcaccttctttggcaatagtgattgccaaggacctgcccgcctctagatttagggtaacatcgttgctatcacttacactcaccgtttactgtcaggtcccaattgtttccgctgtcatccctaccccttgagacatgggaactgacatactgttgactcacggggcaggtggaggagaaaggacagaaccctgacatcacaccccgccttctctgttagcttattcaaatggagtgggggaaggggtgttgttggatgctgggtagtgaggttgggtggtcactgcttctacctgcaggccaggaatgagccagatgtttatgaaactagcgacctacctgaggatgatcaagcggagttcgatgcggtaagaatgtgtgctgccacagactcctccggactctgacctttctcccctagacaggtccttccctttctcgggggagctacagcaataagcgggtatgccaaccccagcctgggtggtatataggttgcagggcttgcaaagaccttgctgggcttgcagccaccaatgagcaatggcaggagggagagtcaagtcagcggaattacagctaacaacatctgtttgcaaagccctgattcttgggccttttaaataaaattgaaatatctcaaaacaggtttggagctagtgacttaggcccctgggttctaacccatggaaatgaatcatgaagcctgggcacttgtaataaactgctaccaagaactagactttgaaatatggagaaatactttttccatatgaatatccagtatccattgggcaaggaattaagaaagtgattccaagattttagagcaaaacaaatttgaggaagaatgtaaatatttcacatcagcggatgtgagactgtggttgcatttttagatccgagaattctgaggatggagtaattaggtacggatacattttaactgtgaggggaaacatttagtatggtttattgagtgtgttcattctgtggttttttttgtgcaatgcagaggaagaaatgtctctgcccccaatgagccccagactaatggggaattaggatacatataggaaacatatagaaggaaaaaaaaattgagtgaatggaaatcaacatagtaaaaactctgtttaagtgccaagaggtgtgtttataggatgtgttttaggttctattatttctgaagacagctgggctgggatcacattgatgatgtgagttctcagtaaagatgtgtccaagagtcattgcaatatgcaggctcagtatgcttgtctgtaagtcctgtggctatgtctgtggggctggttaattctggggaatgctgactgctggcttacaatgtgtggcttggcgtactcacttatttcttatttgactcccccatgtggaagtggttcttacattgtgggaaacaccttctctgtcccttctcccagtggtgtgttccttgtggcttctgtatttgctggcatgccaatctatcccctaagcttgagtatcttggagataatgcagatgatgttgttgctcaaggacctgggtgtgcacctgtcactccaagaggcatcttataggaagctgcctctgtcctcacagaataggagtgtatacaatcggttctctgtatttatgggttccaaacccatggattcaaccaatcacaaatggaaaatattttttaaaaataaaaaataggcccagtgtggtgattcatgcctgtaatcccagcactttgggaggctgaggcaggtggatcatttgaggccaggagtttgagaccccgtctctactaaaaaatataaaaattagcaaggcgtggtggcgagcgcttatagtcccagctactgtggaggctgaggcaggagaattgcttgaacctgggaggtggaggttgcagtgagccgagattgcgccactgcaccccagcctgggtgacagagcaagactccatctcaaaaaaaaaaaaaccagtacaacaataaaaaaaaaaacaaaatttaaaaatacaatataacaactatttacatagcatttacattgtactaggtattttaagtaatctagagatgattcaaagtatacaggagggtgtaggtaggttatatgcagttactatgccaatttatatagaagatgggaacatatgcagattttggtatcaagggaggtcctggaaccagtctcccacagttgccaagagacagctgtatgctgagaactttactgcactaccacagttcagactgttcaacttaggcctaggcttctgcccttcatggtgagataatgaatagaactcagtccttttgtcgctgtgatacaaacaggtagtttcacagtaatcctctttctaaacaaaaaaatacatattgtcattcccttttgaagatactgggatatctcttaataaaaaggagatgacacccattccaggtgtggaagaacctgactgtgcagctctgattggctgtttctcccccagagcctgaacagcctattttagtagcatctagtggggtggctgatgaggagaggatactgtgagtgttcatttcctgtggcatgttgcccaggatgccagtatagaagtgcatatgagctgaatggcaaatacaagaagagctgaattgtttctgtcacctaaggctcagctaagtgactctctgtcactagggaggaatggggtgggcagaccttcagccacttcaggggcccgaagagccaagatgtttcctgatgtcagctaatgtctctggcccccgcatgtccctatggggcttgcagcttttgggaagtcagctgagtaatggctctgccactgcttttaatactgacgtaaatatgcaatttgaggagcagtgaattgtatgcttagataatctagaaatgtcatgtccgtgaggcctgggatctcaccagcagcctgtctgtttcctgcctacctgcccaagacctagtacaagtgacagtgcacatgacctgtcttgtggctgaaccatgagattttcagtcaccttctttttttttcttttttttttgagacggagtctcactctgtcgcccaggctggagtgcagtggcgtgatcttggctcactgcgagctccacctcccgggttcacgccattctcctgccttagcctcccgagtagctgagactgtaggcgcccaccaccacacccggctaattttcttgtatttttagtagagacggggtttcatgtgttagccaggatggtctcgatctcctgacctcgtgatccgcctgtcttggcctcccaaagtgctgggattacagacgtgagccaccatgcccagcctcagtcaccttcttaacccctgacaacagcattctccgccttaatcttcagtttattttcaactttaattttatcagtttttaaagtaggtaatgtatgcacagggaacagaggattcaagggtaagtagtgaaaaatctgcctcccacctctgcctaccaccactcagttctcttccctagagacaaccaatatggatagactcttgtggaacctttcagggggtctccagatttctttttggtttttgagacagagtctcactctttcccccaggctggagtgcagtggcacaatcttgtctcactgcaacctttgcctccccggttcaagcgattctcctgcctcagcctcccaagtagctggaattacaggcatgtgccaccacacctggctaattttctgtatttttagtagagatggggtttcaccatgttggccaggttggtctcgaactcctggcctcaagtgatccatccatcttggcctcccaaagtgctgggattacaggcgtgagctaccatgccagccgggtctccagatttctgtctaaaggaatagtcaagttgtgttgaccctcactgctccataactttcttcctgtgattcctccactgtggaagaaattgggctactaaaggaaaaatgtcctcaaacatcccttaaagatttaaattgctaatttaacttaaacataaacattttccgattcccatagtggggaggatgggggaggaaagcataaaagatttaaattttgctacagatgatcgtgaatttttttttttttcaagatggagtttcactctttttgcccaggctggagtgcaatggcgtgatctcagctcactgtaacctccacctcccgagttcaagagattctcctgcctcagcctcctgagtagctggaattacaggtgtccatcaccacacccggctaattttttgtatttctagtagagacagggtttcaccatgttggctaggctggtctcaaacccctgacctcaggtgatccactcacctaggcctcccagagtgctgggattacaagcatgagccactgtgcctggccaatcctgatttttctactatccctttaaaacaattttagcaggaagtaaaatcttctaaaacaggaatggaccaggaaagtgcacgggctgtagccctttcctcctcaatctgggaagatctctttgcacttcagacactcccaggttaattggggcaataggcttgcttggagatttttcttaaaatgtttggaaaactaattcccaaatagaattccacccacacacacaccccgaccctaacccctgggcccacagcctgccttgggtcagtgaggctttctgctcatggcttttgaactgctggaataagggaagtaaattaagaaaaacctcattagaaacaatttagcttctctctttatggcataactacccgcagtaaaaggggaaaaaatgacctagccatagtttgatggggccctggcagaggcttcatttctccaaaaggtagatattactggacactcctgagatgagaaacagtacttccttacagtttagaagatcctggagtatgcttgattgtgttcattgactgttggcgcacttgaacttacctgagtttttcctaatgcttcccccatcctccctcctcaccaccttgcctggacactagtttgcacaagtaagaccattcaatgcttcttctctgcatgtttttttcatctgccatctcgcatgcaatgctctgccactgtgctattgttgtagctaatcgttttaaattccagtgagtccctggctgggtcactgaggggcctgctggccttatgtttaaagatcattaatcaagggttagaaacagctatgatccatgaatcattgtctcttccccttgtgaggtctgcagagtaaaactgtccagtggaggatgggatagaagcatggaggctttaaatgtttttgaacatgaggcatttaggggctggagttagaaggcagtttcctttctcctcctcagactaagatcaaatgaagatttttttatggaatgacttttagctattctagacaaggatagaaaacaaaagggatgacagccacagtcctcagttcttggctgtatgtggattatctctgggaaaaactcattttaatattcccctatgctaggtctttagagaaatgtaaatgggatgagaaggaggtttatatgcaattgtaagataacttggattatttgtgcttttgtgagtctttctgtttctgcacccctccttttgaaatggatggatggtcagcaatatattgatccatcccggacagttttactctacagctctgtccatcttccttgtcatcatggttttgaagtaccctggctgcagtgttggcgtacagcctgaataggctcagagagtaacagtggccactttccctgtctgatttagaacctcagatcttgccctctgaggcacagccacttagccaaacagccctggggggtctgggagtcccttagtgaaagagactgggagtcacgtactaggtaagctggcacccggggccagggcacttgaaatcttccaatcaaggtgactagtactactccaggttatgcaggaatcatgcctaaaatctcatcaaccttcaacccacccataggacagacctggaggtggtatatactatctgcaaactaatataccacttttccttttatttgattttctgtcctccctattctgcccaatccgcatggtttgaaattgagcttatggcccattgtcttctttctctccttgagtttctcccaagctggttttagcttggtgggacaaatcagagaaaggtatagtgtgtgtacttctcctttgtgtttgcatgtttgcacttatgggtgcttacacccactctatgcagagacatcccagcctcgaccacaggatctggagccacctctaccctgagctgaaagaggaattttttttttttttttgagacagtctcactctgtcacccaggctggagtgcagtggcatgatctcagctcactgcaacctccgcctgccgggttcaactgcaacctccacctcccgggttcaaatgattctcctgcctcagcctcccgagtagctgggattacaggcgtccaccaccatgcctggctaattttgtatttttagtagagatggggtttcaccatggtggccaggctggtctcgaactcctgacctcaagtgatccacccacctcgccctcccaaagtgctgggattacagatgtgagacaccgtgcctggtggaaagaggaatcttggctgggaccctagcatcgtctagggaacagagaggttgtgattaagaggtatctggatgaaatcttggtgaaaggaagcacttgtttttaatcccaccatggtttttcatatgcatacaaccatcctcaaccatctgcccatcagcagagctcctagaaaggcaggacataccactggatatccccttctggcagttctaaaccagccttgcccggaagtgggagccttatctatgtggcccagactcaaataaggcctcttggaaatactctcacccttcccctttgtttaccctccaacccctgtgaatcttgtgaacagagggttgaagaaacatgttctgcacatgtgctagtacctgtgaatcttgatgtcccctggaccctctgtgtaagtacatcatggcagaattgctctagatccttcggagctgcagggtgagttaccagccactcaaggtggaggcaaacatgccaggctgcacaagggaccaggagcagctctgcctcttcccttgcaggaggaaatgagaacggggctatacttaggtacttcatcattcctttaactcaccatctgtacctgacatattttgttttgtctcacctaaagtcatatcagacttcctacctgatcactctcattgtgactgattctgccatccaaatgtctaatttttcacagctagagaaactaagagataggaagacaagggccatgaactaagaaggggaactcctctcctgagaattattgaccctctatcagctacaagtctaagaatttctaacttctgcttcatcttctaccatttctaatagcttccccaccacctcagccttctctccccagtttcttattccatgccactggctggtaacatctaactcctagttttcagatgatcctaaactgctgctgttaatggcaaagcttcatgacatcctcaccaccagagggaaaagggtctcatgctcttctttctcttggggtatatggtgaccccagctgaaatttcttggcccctaaatttcgctaggctcccctggggccctgtggtgcagtgtgttggaagactgtcatgtagtgcatgtgacaatttgctaataacaattttgtcttttttttccctccctcatccccattcccccactccctttccttttaactcttttgattttctcacctctggggaaaccacaaggagctggtaagaagcctgacctttcatctgctttttaacggggtgtgctatgatgagcagttgtttctctgtcctttagactctactaaatctttcattcatctattcagtcccacacccagccttttcctatctcacaagtcactgtaattatactgcccccaactcatgccccagatcttcaagacactgctggagtaggtgctactggaggactagagtgtgctcccgggccacagccttggagaggctccagaggatgccagcgccaggtagcccaactggcccaggacactctcccacagcaggaatgaaaatgctctctgtccctgtgactgtccagaacctctgagactcaccgtctatgtgttgaccctcttctactccccgctttccctacttaggaacgtaaataagaaagtaggttccatctgcatagtgcccgcccataataagggcttaacaaatggtagctatgattaatttttttcctgggtctgtaggttatgcctcccattcctcttttttaagaggattaaacaaaagaggatgggtgggattggcctggattggggctttcacagggagaagtggcatattcctgagtatgaacttcagagaagatggttgtctatccttagcctgagcccttcccagttgataagaggccagagatcacacagctattagatgggtgggtgttctggccgtaacatttcagaacaggttaaagagataatcatttgggactcaaatgtctctccccccgggcacttgcatatgggacattgagtccttttgttttcccttgatctatagctcttacccctctgcccagtaattccctgaggaagaggtaaagatcaaagttgatactttgtcctttccttccttcttcccttatttttaaagctgtcacccacactgattcctgctctaatagcagagcagagatgaaggaaggagcttccttctatctgcttttctttctcaatgatgtcccaccatgtccccctcacaccctctccccacatacctacacacaggcagagattctcagtcctggctgtaggttagaatcacctggatatctggccctaccccagaataattcattagaatctctagaagtgggcccaggcctttttttttttttttttttcttttctctctctctctttttctttttttgagacagggtctcactctgttgcccaggctggagtgcagtggcatgatctctgctcactgcatcctccacctgccaggctcaagtgacccttccacctcagcctcctgagtagctgggaccacaggcacgtgccacaatacccagctattttatattttttgtagagttggggtttccctatgttgcccaggctggtcttgaactcctgagatccacccgccttggccgaactttgggaggccgaggcgggtggatcacttggaattaggatcctcccaaagtgctgggactacagacaggcttgagccaccattgcccggctgtctatttaaaaaaaaaaaaaaattataagtgattctaacatgcagcctggggtgagaaccattgttctaggtgaaagaaggaaggctcattttgccttcctcccatagaaggtagagatgtcatccccaacagaaaaggactcctgggtctccctcctacttccatcagtactctgttgggagctgtcaggcttctgacaattgaaaaagggacatgcagtcaggagtgcttggtgcagtcttggtgttgtcactggaatctgaacagcatgtagatatctagtaaggagggaacctctctgcttcagtttctagggtgaagtctctttcaccgcctacttgtgtcccctgtttttggaagagcttcagtgcttaaagcatagcagaggagtcagggagaaaaatcaggtgctgcagcgtctctgaagagatgctggtttatctccatttcagagcttacatgtggctcttgcccatggatactcttggcaagcagatattgcctatgtttgttgcttctaagatgtcccataaagataatccagtaagcccttgccccttctccctgtccctgagttcgctggcctcatggcagcctggaaatcaggcttctggtcaggccctctgtcggccttctttttgtactaagagcttgtgtcttaccttcaacaggtttaaagtcctaatattcacactcagtgttagtggcctgattatctgccttccctcctctttccttctagcaaggatgggaggttagcattaaaatggacttgctcagcgggcaagatttacttttgggagggggaggttaaaagaggtcaggttggtttcttgccttgagtgcatggcgtgtgccagacaactgggaggggtagcatggggggatgggaaggcttatgtacagagagggtggggaggttatgctccctctgctcccagttgaatgagggtgttaatatttatacaactgaggctccaaatttaccaggaagcttcagtttcctaggttaagcctgggtaggcgccttggaatagagccacccttctttccccttggacaagtagggcccagtcacctaatggtttggggattttgtggggtagagtaagttctagagtgggaatgagtgtgtccctggcctaaactacctgttcttgcaggaggagctgacaagcacaagtgtggaacacatcattgtcaatcctaatgctgcctatgacaagttcaaggacaagagagtggggacaaagggacttggtgagactgggctggaagctgggtggggggaagactggaggataagcatgagaagtggtttcctgtcctaaagtcttagtgagttgtgcttgggggaaggggtccctcatggagatattttatggaagccctcacagtcacctgagaccatgactgccttgggcctagatcaggccctcagttccatcttcttttcttggcagatttctcagatcgtattggaaaaaccaagaggacaggatatgaatctggagaatatgagatggtttgttgtgtgtgtgtgtgtgttgatgggaatggtgtagtgaccctatctagcagacatgtagtagggagatcaagggatacaggcgggattctgttcctcctctgttcctgaggaagcagcaggatgcagccagggaaactctgccctactgctgtttgttctggagagcctccagccctctagctgtcctcagttctttggtactagggtgttgtggattctcaattggatatgatacctttatgacttaggcccagggtgtggatgaattcttgaggctccctgtaatgagacatataacattaccctctgtgcctgctctctagcttggagagggtctgggagtgaaggagacaccccagcaaaagtaccagcgcctactgcatgaggtccaagagctgacaactgaagttgaaaaaatcaaggtaactacaaactctcttctcccttctctgctgtgacttacacagtagaggaagacctcaagcaagaagagaaagattccctgcctggctgggtgcggtggctcacgcctataatcctaccactttgggaggccgaggcaggcggatcacctgaggtcaggagttcaagaccagccaggccaacatgatgaaaccccatctgtactaaaaaaatacaaaaacttagccaggtgtggtggcgcatacctgtaatcccagctactcgggaggctaaggcaggagaattgcttgaactcggaggcggaggttgcagtgagcccagatcatgccactgcactccaacctgggtgacagagcgagactccatctcaaaaaatgaaagaaagaaagattccttaagctcctggataaaggggctaaggtttccagagtttacaaatatgcatccatctgtatgcagtgctacatacaggtgggcagtctgtcatgctgaaaaccatcccagtgacctccagctacaactacctttaaagggcttgacctatttttttgcttcttgattcattcttgccatcccccgatttctaccttttttcatactagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagtgggtaccctactttgttgaaaaatcattgctgactggggttgtggatggactcagccagctactgacaggggtgctaagtggcagagaagtggcttagatgtttcttaatgctgattatgaggcaaaagtgagggagagtgactggcccttctccttccagtcatgatattattactcggtctcctaactaggcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtaagtgtggatacagtgttggttgggaagccaaggggagatgtgaccctagagattttcctgcctctctccaaggagagggtgctgggaaggcttctgattcctctgattcctcttgattgattcctcttttgattcctgattcgttgttctctatgtttctttcttttttttttttttttgagacggagtcttgcactgtttcccaggctggagtgcagtggcgcaatcttggctcactgcaagctccgcctcccgggttcacgccattctcctgcctcagcctcctgagtagctgggactacaggcacctgccaccacgcccggctcattttttgtatttttggtagagatggggtttcaccatgttagccagaatggtctcgatctcctgacctcgtgatccgcccgcctcggcctcccaaagcactgggattacaggcgtgagccaccgcgcccgacctcattctctatgtttccctcgcccatctacctttggttaggattttaagattgtggctaggtatgtattccagggaaaggaatcccttggggtggtgagtggcaggcagagtagagcaggatcgtattcctcccattgcagcagcagggaagcagatggcaaatctcacctccttcctcccactaggtcgcagaacttgaaaagcgcctgacagagctggagacagctgtacgttgtgatcaggatgctcaggtcaggtgttctcctgtacataatctgagccttagatcctgcaactctaggccttaaggtctacaacattccacataagcctgggaggagtcatcaaagggcttcagttacagggatcagctagtgggttcccagctagaaccaggaaagatgggagaagacgataatcatggagatataaggaccactcacttcttcccttcctttcccaccagaatcccctttctgcaggtctacagggagcctgtctcatggtgagtttggaagaaactggagtgtttggatcacagaggggatagttgggtttgggtttgctttgaggattatttttgagtttgtagctatatattaatttagtggaatatgggaggcctcttgctagtctgcctttcctcttcatgatgcttgtcccaacttccatccccaggagactgtagagctgttgcaagcaaaggtgagcgccctagaccttgcagttttggatcaagtggaggctcggctacaggtattaaatggagggaaaattaaattatggatagcttgggactctggaagccctggatgccctatcaaccttaaaatctgtgttttcagagtgtcctgggaaaggtgaacgagattgccaagcataaagcctctgtagaagatgcagatacacaaagcaaggtcaggaagacaccttccccatctcctttccactccctcaggttctccgagtggcagtgtcaaagcatgagaacacactgactcctcaggtccccatcttcataagctcttatgaagagcttatcagcttggaaagtcagggcactgcttccctctgcccacttgatcctttcccccattacggtgaaatagcagtctgtacatactgacctggctgcctcagccatcccctctgggccccattgtgtcccttcaggtgcaccagctatatgaaactatacagcgctggagccccattgcctccaccctccctgagctggtgcagagacttgtcaccatcaagcagctgcacgagcaaggtgggaggccagctgccaggagtgctaagagaagttgaaaaatgggcaacttttggtcccctcccttatcttggattcaagtctcaaccatacttttcttttgtagccatgcagtttggtcagctcctgacacacttggataccacccagcagatgattgctaattccttgaaggacaataccaccctcttgacccaggtgtgtgcccctttgttgatctgtcctcctttctccagcatgtgcaaactaggttctccagtgttatagggttctgccttagcctattttgtagcatggtgttgtggcagggggttggtctggagtctccatcctgctttcaatgtgaaggccctttgacaacttatttaacctatgaacctccatctttccatctgggaaattatacctccctcagagttatgtagatgaggtgaaataatatgggcaaattgttaggggctagtgaacatgttttcttataaaaccccactctttccctttgtcgtctcaactttactctccctgataagcacagtacactggaaggaatccgggctttgaagtcagaagcaggccctaatctcgttctgtcgcttcctttctggccctggacaatgagcctcacctagctccttcattcttttagtaatgcctggcacacagcaagtccacaatttcttattgttttttatttttaagacagagtctcgctctgttgcccaggctggagtgcagtggtgtgatctcagctcactgcagcctccacctcccgggctcaagcaattctcatgcctcagcctattgagtagctgggattacaggcacgcaccaccacacctaatttttttttttagtagagacggggtttcaccatgttgtccagggtggtctcaaactcctgacctcaagtgatcccacccatctcggcctcccaaagtgctgagattacaggcgtgagccactgcacctggccgcaagtcccaatttctgttggaggcactgttctcagtgctggaaggagcattaaagtcgagagaccagcatcaatcacaggatcactgagataaatgaaaaaatatataaaggacttagaataatatccttttcctccagagcagttttctaacattttgaaccagtgaaaccctcatttcaacaaaatcttatttagctctcattacataaaacagattttaaaaaactgttctggctgaagtcaggatgggaattctcgagtcctacctgcttgggctcaccccaagcgtggtctatgtactctaagggtagcttgaaaattggtgctataaacatcccccctctgtggcccacaaattgtgcttccatttcttgtcttctctctcagagaattccttcaggtcctcatccagttaagcaactggacctgacaaagagtaaaacctctctaccactttgtaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccag

SEQ ID NO: 35720 - DNA, 44379 bp, Homo sapiens
gggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtgagcgtcggccgggccccgtcccgccctccctgcctcccctgcggccctcccctccggcctcctgccggtgcggggccgctgctcagcccagcccagcccagctggagcgggccgggtccccgcccgggtcaccccgcctcggatgtggccggctctgtggatggtgatttttccgccttaaaatcatcatgcgattggcctgccccctcccccgcgccgtcaccccgggcctctgtatatgctgatcttgcatgcagagtagacgctgcaccggtctccttttggtcccggtgtctgtgtcacacacggcgggtcctgccgaaatgcacttctaggaaagggaatgacctgcccgtgtgataatgcctcgtcagtgttcttgggcttttgtgagtctcccctaaatgcaagctgtcaaattattttctggtatttgttcactcctgttccaatagtgacagatgatatccgaacatagaaaatgacttggcttctaagtttgaaatctagacagttttattaaccaaaggaatttactaatcacgcgttaatcgtttcaattaagtaattttcccattctgacaagttctgttttataccaaaaaaaaggaaaaacacaaaaaaatcacaagcaatgtaatatctctgacaaataaacacctggcgtcctgacagtaaatttacaggttgtaggctgcggatggccagccagccaatggaatgaaatagctctgggggtgtgtactggtcctggctagccctgaatttgagcttcaggaaaaatatagtacgtgaagaaaggggtcagataatgtttggtagtcactgggttatcctgtggtttaaatcatttaatgtctgtagatttggcctctgtagtcagattgctttcttcgagcaaataagagcttttttccccccaatacattgcatcatacctctttagtaacataaaatggaaaggacaaaccacttttgtctactgtaaaaaagaaaaattatatggaataaagagcccagggaggcgaggagtcttgttggaggtggattggctgagaagcacagaggatgttgggctagacccatgtctcagtaaacctggttctgtggtctttcagttatgcccgctgacttatgaggatttttagaaatcctctctgtaccggaaaaaacttgagcggtgctggtgttcccagcaggggggacaaaggttgtttttaaagatttactaaatttgcattgaccccgcccacttctaggacttaactttggagcttaattatcccctagctctggttgcctcagccaaaaccaatgtttgaaccactttgacctctgatttcctttctagcttcaaaattgtataaaatgtacacaccgtcagtctcctacatttgcctgccttcttcctaccactcccttattatccaaaccaggaaaacaagttcagactccaaagaaaggcaaataaggatgttggaggaagttcaggcaatgtttagcaaatattgagttgcatcgttttcttaaaacggacatcaagtttattttttactatcttgctggcagcatttgccagtcctttaaaaggtgtacagataaatcagtgtatgtggttttctgcaggatgatttggtctctgaaatcctttttcttcgattcttcagatgcccagctctctcctgtttttataagtcgcagctccgcaaactcactgaagcaactcgtttaccatagtttgtgagtcctctttctcttgttgccacagcagttttaatgccaaaatattgaacctagcaacaaattgggtcagccataccaaagcactgttactgtagcacttgcttgtactagagtgtaagatacaattttctgttccgtttatcccatttacaaaaaaacatgctattaacccccagcatataaacagggagaaactgaattgttactagtaaactgttgcaagcattgatagaacatcaaagaaaattggcctctacaaagtgacaaatttattatcttcaggaatttgaaaggctttctggattggggaagattacatagctatgaaagcccttaaatattttagtttgcttaataaacagtatactaaacagatgatcagcaaaatttgggtactatagccttccatgctttgtgttcaagacatccccagatctatctacccatttatcacccttgtttgcagagaatgtgcattgtaagagagacaggtcttctttcttaaagcttttttaacgtctaagaaattgttaacctttgtagtcccactctagtcttagaaacacagaatatattaggtgattgagatttttttaaatgctttggataatccctatgaaattctgtctttccctcttaaacatattttaacacgttcttcttacctctccccactaacctgtcttctctcccattggttctttgccaaaaaaaaaaacctcatctgcctctctccacccttttaccaaccttcagctttctgtatctcattttccctcaagaacaaccttatccctgagttttctaaattaaaattcttgaggttgaagcaaagcaacaatctagcaataatctctaagggaaacagatggttataagacttggtggctgatgtgtactttttccaagtaaatatttaataatacacactgtttttgtgcttttcttttcccagttactacatgtacctgaggccgttagatttgtctgtgttaaggatttgaaagggtaagctaaaggatctgaagggaagtttaagtgaggccttaaaaatatttccagcaaaggggcatagtgtgagaatatgcgactgatttgagaagactggttcaaaagttctggtgggtttggaaatattatcaaagattgttctattaactttcccagagtaaattatctgtatttcatttgctatggttctgcctgagaccagtctacctttttagaaggaagtttattgttttaaagtcagtttggagggaaagtacagattgataatagcaatttattgatggtaggagtcaattaactttctcttccagtctgcccccccccagttgtcttgatattaaaactattaaaattccctatcactgatgctactatcataaaattttctaaaattatcataatttacatatagttgatggaccgtagatggagttctctcatacattgaccctaagtcttttaattacaaatattagtacccaaaaaagtgtaccctatattaatccagtaactagtttttaaaagtcaaaatgccagaaggaaacagtggaatcttgatgacataatgcaagggaagaccggagtcaatgcagtgttaaagacgccctcagcctctgggatgtcattgtttagcgcttaagggaagactatagaaagcactgatactgatttaaaatgagatatttctctgccttcactgggggaaaaaatgtttctgacttattttgctgtgctcaattgacaaccatcaaaacttaggtaacttttaataaactcacagtttctaatatttttaagtggctgtgtgtctgcatctgctgccacagataaaatataacctttgtaggtgaatttaatttaggacttttctgaaagttcagtcagaggataggtaatttgtgtgtcttttaaaagcacttagccccgaggttgttgtttttaatacatcttatttaaatacggaaatgtgttgcccttatgcctttttatttcatggaagccaaatgcgtcttttctcccaaagtatactagaaaatgaagacgcttggtaatggtagtgatctgtacatcagatttcagtctttctgtcacttgcgtgtatgaatccatttagcaagtttgcttttggcagtaaagccccacgtgcaggaagacaaacagctgctcactcattatccaaagtatactttgtaagaattagggcatcaaaaattggatcctaagcaccaatatatattaaagttcagtacaacttgtagtgtttaagtacaagaaataaaaattgagcctgaacttttggcatatagtgggaagaaattaggtttaccgctgttaataattcagagtgcttaggaaaatcggtttttatttacttatgttaaaaatactaagggttctgtaaccattaaaaactaaaatactaacctgtagatgttgaaaaaatcctagacactagtctctgccacgtgactgttcttcttttctatttattttacccaataattaggcttttacaatgtaagtaataaagagaaaaatctctagtatcactttagagcacattgattcataaatagcccataaattttgtactcagcaacccataaaatacacatgcatgattcacataatcaaatagtaacgaaagttacaaaatgaaaagtgaagcagctctaccccaagtccttcccccaatataaccatgaacagtcttaaatctaatgccgctgtctaaaactgactagttattcaaatgaatcaatattttcccctttccagaggcagaaattaatacagattcaagtgttcactatcaagtcggaattgttaatatgtgaaatactactgttaaaggcaggaaaggctttattaaggacaagaagacaaactaggagaaggagctactcaagaccttccgattatctttacaaaaaggcaactacacctagaagattctgcagccacacacattctgccttcacttgaggtcaactgccttcaccaaggtcagatattagcaaaggctaacatttattcagctctgtgtgtgccaggcattttattaagaacttttcatgcatcatcagttctatgccttatagcaacaatgcatgtaagaacttttcatgtatcattgcttttatgcctcatgcaatacactgttgtccctgatttccaaatgtggctactaaggttgaggagtgaagtgtcctttggcagggtgacacagctagtacgtagtggagttgaggttcagattctgggcatctgattccagcacccaccttaatcattgttgtctgggatttatttatgcaaaaagttacaaattgtatcttaggcttttaattgtaagcgctgattgagaaccacttcatgccattgacacaatgcttcctaatactttggatcatagatacctttgaaatttctgttaaaagctattagaagacctaccttcttcctagaaaaatacatattcaaacagctttgcatataaaactcagcatagatgatatctctagaggtccatttattctaattgctaaggaaatgaaataacctttttcccctacacccaactccgaagacctgaaataacattttaaacagttttccatcaaaagaggtttgaagactttggtgtttaagagattaatgtgttagccagaacaactcatttctctaccagtgtgtagtccatttatctttaaagattttctattgaataattttgaaattactttcttagttttcttcattaaaaactaagaaaatgctttgtttattatgaattgctatttctcttgattattattcttggagaaagtctatcagacgtaattcttctgatttgcttctaggctagaggaaaatgtgaaagatgacaaatgaaaatttcaaaggttgtcagtagtatgacttcttttatcgtttgtcattatcacaaatatatcaacataggacttttaaaagatattttgtacatattgggccttagtaggattttgcatgaattttttttttcttttatgccaagagagaaagagcaaagaaataaccaagggtgatgtactcgtattgaaggtttaccaaataaggactgcttttattatgaactatagtctatattctaagtaaatcaatttttctattatgtgttttttgttcctgcaggcaagatctctgaactttatgcagagggttcttttaaaaaaacaaagttgaatttttttatttcttggaatattttttttcattgatttctcccaagtagagcagattcaaatctcctttgtaccctatgtcttttttgttttgctataagctcagtattccatttctacattttcctttcctagaaccagtcaataaatgacaaaaaaaaaaacaaaacaaagtaaatcatgtgttgttgcagtaggagttcaaggaaaccaaggacaatcttgtttgtttatttgtttttttgtttgttttttttttgaaacagagttttgctcttgttgcccaggctggcatacagtggcgcgatcttggctcactacaacctctgcttaccaggttcaagcaattttcctgcctcagcctaccaagtagctgggattacaggcatgcaccacctcacctagctgatttttgtatatttagtagagacagggttttgccatgttggtcaggctggtctcgaactcccgacctcatgtgatcagcccacctcggcctcctaaagtgctgggattacaggcgtgagccaccgtgcctggcagacagacagtcttgatgtgggaacagagaaggctggataggagttggataaggccatttcagataaagagggggtggcttcacccaaggcaggaagtggaactgtgtgtaagggggtcatgaggacaaactacatttgtaaataatgagaaataagggcttgtgacagtaaatatatttggtctctttgcctggttcccaacacagagctcctgaatgtcgcaaattcctgagtgataggagcatcttttgttctaactaggacactcttaatgggcttctgggtagcttcaaggtggggactagtcaccaaaaagaccaagccataattagaaatttggaactttcagtcccaccctttgacctctggagattggaaaggggctgaagattgagtttaatcagcaatcagtcatgccctcataatggaacctctatacaaaccctaactgatggctggagtatggggagagttcagagagcttccaggttggtgaatgcatccatgtatgggtagggtggtaccctccaaattccaggggaacagaagctcctgcagtggggacattccagacatggccctgtgtacctcttcatgttgctgttgatttgtatcctttacataagtaacgtttccctgagtcctgtgagcctttataacattattgaacctgaggagggggccatgggaaccccctggttggtagccaagttggacagaagtgtgggtgccctgggcacccaagacttggaactggcatctgaagtagggaacagtcttgtgcgactgagcccttgagctgtggggtctgtgctaaccctggtagtcagtgtcataactgaattgcaggacacccagtttgtatctgcagagaactggagaactgcttagtgtggaaaacccacacatttggtgtcagaaatgtgtgagaaaaaacaattttttcctttttttttttttttttttctttgagacggagtctcgctgtctcccaggctggagtgcagtggcgcgatcttggcttactgcaagctccgcctcctgggttgatgccattctcctgcctcagcctcctgagtagctgggactacaggcgcccaccgccacgctggctaatttttttttttttttgtatttttagtggagacggggtttcaccatgttagccaggatggtcttgatctcctgacctcatgatccgcccgcctcggcctcccaaagtgctgggattacaggcgtgagccaccgcgccaggccaattttttccttttatgtttgttggatgaataatgatgaatctagcagggcacagaaagctaggcagcagtggaactgagaatgaagttatagttaatagcagagaatgaaaaagaaaagacagataaaacattttgaagaaaggacagtaatgtattcccaacaggtaggatttacaggatgaaggagagaagaggcaaagataaccacaaaatttctagcctgagagactggtagaaaaaaatggtggtatcagggacagatggggttattaaggaaaaggattggatttttaaaataaagaagatctggtgtaaaattatccttagggaaattggaaatccaggcacgtacttctctccatcatgcccttgaatagtgcagtccctctgcctgtccatgcctcacttccccctccctaggattcctctgcctctcttaagacccatctcaaattatcacgtagacttgtaaataatttatatgaaactggatagctgaggtttcaagcctttatccctttgaaactttttaataacaagttattgttaccttttactaaatccaactttatattcaccattttaactagcatcatttccgattccaagacctgtttggtgtgaaagtgcagctaagttactgttaatcaagatcagaataaaagaatctaccaagaaaaattaacaaaatcccccttttaatgtataatcttccatctgtcaggctgtaagttaaataacacaaaacaaagctgtatgttttatggatatgtacatatataattgcagggaacatgatttggaaggatatacacttacattgctaagaatagtcacccctaaggagaagactggggtcataagtggaagtcaagggagtcttcagctttctttttgtatttaaattttgatagaaatacatacatatgtgttataattttaaatttttaatgaaaaaagtattcttccgttttttctttgatgtgtcaataggttatatttttctaatatcagctaaacatttgcttcccagaaagcttagttacctcttcaaaatttattcaggttaaaataaaagatttagactggattaaaaatctaagatggtatttgcctactttatacaaaacagtacattgatgctgctaaagcaattaaagtataatttttctggtttttttttttttttttggagacggagtctcactctctgtcgcccaggctgaagtgcaatggtgcaatctccactcattgcaacctcggtctcccaggtttaagcgattctcctgcctcagcctccccagtagctgggattacaggtgtgcaccaccacgcccagctaattttgttgtgtgtttagtagagacagggtttcatcatgttggccaggctggtctcgaactcctacctcaaatgatctgcccacctcagcctcccaaagtgctgggattacacgcgtgagccaccacgcccagcctaaagtgtgtactttttcttagctcctatatgcagtgctccttcccatgctgaatgtctgaatttttatctgagacgtagtatttcaggtggtcattacttgtgggtggtcattgagagttcctccctgcttctaaccttcctctcttcattttaaattaagttacgctacattattgtgggttagaaggtacattaatattaagtgaaaaaatataatctgatgagtaagtggcaagagtgttaacttataaatattaagagttgttctgaggcatttttgcttttctggtggttctgtgcttctggtagaactcttggttactgaataaatagttcctgaaaagtgagagagtgcagctggaaattagatttctgatgaataaatcaaaccctattaagagaaccaggttcaagtaattttaaaaccacttgaattttcataaatgttttgttaatgactaattataaaaaacagtgactagctggaggcttttgtgtttgcttttgagtcagctaggaaaaggaaaaaaaattcaagcttagtcaattgtggttttcactgaatcttttttaaagtaatgagctggtttgttttcttcatcactatagcaacttaagctagtttctgcttttgatttttatttctcctagagaaacttagcatgtactgctcattagacttgagcatactaaggaatatctgtggtaattaagttaaaaatcagatcagtgctttgtactgtatatagttgcagatgtctgcatttcactaatattctttggaaacatctggataccagttaacataaaataactgtttagtcagtttctgttcagaatagaaggaatgatttaaaagttcccattgtagtacatacgtcattctatcccctgcccttcctccagctttactgagattgataaataataaacgtcatgggtggtgtgtctttagtttcctctggtgagctgagtgcacagattactttgtcagcagggtggccttgatttttaggccatgtttctaatggcatcagttctgtggctgacacctgtgtaccaagcccattcactgtctagcttagccagccgtggactcctgctctttgttaaaagtatttaccttcattcctactagcacagttgaccaaagacccagttgatcccaaacactagtaatgcatcaatggagtctaacagagttttaagatgcggtgtgtgcgtgtgtgtgtgtgtgtgtgtgtagagatgggatctcactatgttgtccaggctggtcttaaacacctgagctcaagttcttctgcctcagcctcccaatgtgctaggactacaggcatgagccaccatgcctaactgtctaagactttgggatacaaaaatataatttactttcctccatttctggaataaaacatctcttccttcctccttctagtttctgttctgtgcccctgtttgatctctgttggtcctgttcaccttcagccttctctgctgaaggaggaaaggcttggttttataaaaagtgacaatattcagatcacataagatccttcttgcttcattttggcttaaatattttaagattttctgattttcttgtatgtgtatgtattttcctattatttgacttttttgaacaacttcaaattgagtatatttgaacgagagtaggcattcaaaagtgctaggctttccctgcctttcagaactttgaggtatatgtcacatcattttgtccttcacattctccagttgtgctaatttttcccaatccattgagttaagtagagtaccttcctttttgcagtcatattcttacttttttttttttttttaatttttttgagacagtctcaaactgttgcccaggctggaatgcagtggtacaatctcagctctctgtaacctccgccttagccttgtgagtatgggactacgggaatgtgccaccatgcccagctaatttttgtattttcagtaaagatggggtttcaccatgttggccaagctggtctcaaactcctgacctcaagtgatctgcccagctcggcctcccaaagtgctgggattataggcgtgagccaccacatctggcccctacataaatctcttcgtgtcccttagaatgtagttaagacttattttcaggtgacagtatatttttgatagttatctttggtttccaaacccagagaaggaagagtaactggcttcttctgtgtgtgggtacattgtgtcttattggagattgttttgtctcaagtattgctgcagagtattttattaatgggtgcactttaaaattttttgtttttcagactaccagtttaggtagcccagtactcaatatttgccaatttctagaattaaaaacatgtatgaatcactggttaactagaaatttaaaatgaaaatgtttcttctttagcccaggcaatatcacttgcattcatttctatcccctccctgtccctgttctgttggctctggggcttcttccactaagctggtactttctttatagctcctcctgtgcttccattcactaaacctttattggttcatagcctacagaaaatgcctgtggtgtgagaggtaatttgtgaaactgcttctcttcactgtttagcagttgagctctctaaatgggtgtagctgggaaagaaaacttaactttacaaacaagaattcctgggttccatccagcggaacatgtcttttgttatacacacacagtttctgactcatgtcattccatgacttatgataaaatggacattttgtttacacttgtgtggaaggaggggtctggtttctaatttttaataacatctatttctagaatattaggcttgccatttgaatgcttctgtttgatttatgaatatcattggttccagcagtttttagctccccactaaatgcaagttaaaatttttaagtttctaagttaaaagaaagtaacatttcctccacttaagaaagcaaggaaaattaaaaataatgtggtgatgacttccacaggctctaaaagagcaatggaaaaagtgatttatgtgtgggagaagaaatactagttcttttttttttctttttttttttttttttgtattgatcattcttgggtgtttctcacagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgttacagagagcacagggttgcggggtaaggtcacagatcaacaggatcccaaggcagaagaatttttcttagtacagaacaaaatgaaaagtctcccatgtctacttctttccacacagacacggcaaccatccgatttctcaatcttttccccacctttccccgctttctattccacaaaaccaccattgtcatcatggcccgttctcagtgagctgttgggcacacctcccagatggggtggtggctgggcagaggggctcctcacttcccagtaggggcggccgggcagaggcgcccctcacctcccggacagggcggctggctgggtggggggctgacccccccacctccctcccggacggggtggctggccgggcagaggggctcctcacttcccagtaggggcagccaggcagaggcgccccctcacctcccagaagaggcggctggccgggcggggggctgacccccccacctccctcctggacggggcggctggccgggcagagggactcctcacttcccagtaggggcggccgggcagaggcgccccctcacctcccggaagaggcggctggccgggcggggggctgacccccccacctccctcccggacggggcggctggccgggcggggggctgaccccccacctccctcccggacggggcggctggccgggcggggggctgacccccccacctccctctcggagcggctggctgggcagaggggctcctcacttcccagtaggggcggctgggcagaggcgcccctcacctcccggacggggcggctggccgggcggggggctgacccccccacctccctcccggacaggtcggctgccgggcggagaggctcctcacttcccagatggggtggctgccaggcggaggggctcctcactcctcagacggggcggctgccaggcggaggggctcctcacttctcagacggggcggttgccgggcagagggtctcctcccttctcagatggggcggctgggcagagacgctcctcacctcccagacggggtcgcggccgggcagaggcgctcctcacatcccagacggggcggcggggcaaaggcgctccccacatcgcagacgatgggcggccgggcagagacgctcctcacttcctagatgggatggcggctgggaagaggcgctcctcacttcctagatgggatggcggcagggcagagacgctcctcactttccagactgggcagccaggcagaggggctcctcacatctcagacgatgggcggccaggcagagacactcctcacttcctagacggggtggcggctgggcagaggctgcactctgggcactttgggaggccaaggcaggcggctgggaggtggaggttgtagcgagccgagatcacgccactgcactccagcctgggcaccattgagcactgagtgaaccagacaccgtctgcaatcctggcacctccggaggcctaggctggcggatcactcgcggttaggagctggagaccagcccggccaacacagcgaaatcccgtctccaccaaaaaaatacgaaaaccagtcaggcgtggcggcgcgcgcctgcaatcgcaggcactcggcaggctgaggcaggagaatcaggcagggaggttgcagtgagctaagatggcagcagtacagtccagcttccgctcggcatcagagggagaccgtggggagagggagaccgtggggagagggagagggagagggggagggagagggggagggggagggggagggagagggagagcactagttcttaattaatacattgttttactatttcctgtgaatttatgtagaagtaatgaaaccaaggtttattaagtcattttttcaaactcctgtcagtttagactttttaattgctttgttacatgccattactttgtaatacttgttatagcagtggtaatagttgagatttgcctgtttgaccacttgcagggcaccgtgccagattccccatgtgcgatgttcctcgcagtcgtgacacccatcctaggagagtggcattagcacccctccatgcaagcggatggtgcaggctgggtcgcctgggcacagcgccttaccatttccctggcttagtgtagttatcattaaataatatgtggtattacttagaagcattttgaataatttgaaaagcacattttagtgtttaaacaattttttttttcttttttctttttttttttgaggaaaggtctggctctgttgctggggtttagtgcagtgacctgagcgtagctcactgcagcctgcaactcctgggctcaagtgactctcctgccccagcctcctgagcatcttcgactacacgcacatgcccccacgcccaactcaatttttttttttttttaagatacaaatgattcatcttaatattatttacagtttttttttcccttttctgtgggctttatctgactggaaattctttttaaattttttattttttaaattgacaaattgtagatatatatttatgaggtacaaagtaattttatgatttatgaatacaacattgcataattaagtcaagctgattaacctgttcaccactggaaacaattgcaaataattatcattttttctggtgaaaacatctgaaatttactcagtgattttgaaatgtgcagtactttttgttgttgttgtagaaatgaggtctcactatgttggccaggctggtttcaaactcctaagctcaagtgatcctcccacctcagccttccagtgttgggattacaagcatgaactaccatgttgggccaaatgtataatctattattatttactgtattcaccatgctgtgcaatctatctcgaagaaacttattccttctaattgaggctttgtaccctttgaccatcatctccccgtcacccccattcccagttttgtatactttgagtcctttcatgataggtatggaggcttatggtaagttatttaaaacttaacatgtatgtcaaatatttttgtggccatagcttttctttcttttttaaattttaagagtcagaatattcgtatattaattcggcatgtatttgagtgcctaatatatgccattttctatgttaggaaccaggaattaaagcagtgaacataacaaagtctgccctcgtggtgctaacttgccaggtagggaagccagataataaacacatgtataatgcaaagtcagtaataataaacgatatgaagaaacaaggtaggagaggcaggaaagtgggagtgagaaagaggtgctcttttaaatacagtggtcaaggggagcctctcagaatgaagtttttaacagagacctgaatgaaatgggggagtgagctatacagatatctgctgtgtgctggaaaaattacctgtaattttgcattccaaaagtttaataatgactacatttatttcacaatttgagaatcagttatacacaagatatagttctaagcacatactcctctaaatatgatttgtttgtacagtagaccaaataagtatgttcagcttagaatatgctctttatggtcatgtgtacaataaataaattatcttaaaacattatcaatattaaggttgatgttttcagaaacatgtaagaaagctagcttttaaaattgactagggaagttctctcaaactgccagtccatgagatattgtatattttctatctgaaaaacttttaatctcagaattctttaaaagagctctccctggggctcccattacttacttgtgactcccagtggaaatcgtacccagcccctcgagaggggctgaatctgttgggagtgggagggtagaaaaaatgctgcagcttcttgtgggtatccttcacacacaaacacccagtgccccaagcactgtgcagtcaaacatcaaccccactcagactttcctccttgggattgagaagcaatggattatagagaaagaaaggtggattagcactccaaaactttgaagagtaattgaccaagacccccaaagccaaagctgtgggcatccccacttccagtataccctgtaccaacacgtaatggctactagatacaggggcactagtacctacctgtctgcttggctacctgccctctttgcagaagtggtgaagggaatcactcaacctcagaaagggaaaatggctttctcattttcagattgaaagaggttggcagtgggtgaggagaataacaggtaaggatctcttttaatatacccatttgaagccaaaacctctgtttagacatacggtattttgaacctggtgattattcattgcccatgtttgtgaattatcagaaagcagaattcttgccaggcatagtggctcatgcctgtaatcccagcactttgggaagccaaggtgggaggatcacttgagcccaggagtttgagaccagcctgagcaacatggtgagatcctgtctctacaaaaaattcaaaaattagctgggcatggtggtgtgcacttgtggtcccagctactcaggaggctgaggtgggaggattacctgagcctaggaggttgaggctacagtaagccatgtctgtgccactacactcagcctgagcaacagagcaagaccctgtttcccacccctacccccccaaaaaaaagcaacctgaattcttgaactccctgcaaccaggtcacccaaaccaaaggtaaaaggaacataaaaaagccttctggaaagtgtacagaaattcattgcagggtgatttttgtcttgtgaaatcatagttactgttattagcaggtttttttaacgttttatattcatttttcatggtgttctgatgtacaagctgcttcaagtgtttttggacatagcttggatgtaaaatgtaaaaagtggatattttcaatttgtagctttcttttttgaagcttacttaagtttgttctaaatataaccccttctttctcacccaccccaacacatttttttaaaaacaccaccaggtatccgttacagcactgatgtgagtgtagatgaagtaaaagctttggcttctctgatgacatacaagtgtgcagtggttggtaagtgatcgcctttcttgctgcctaatgagaactctggggaaatatgtttacacacatgttactgttaagatgctgtagaaatataccttatcagaactgattttttttcaagttgtaatctttaagacctgcatcatttttcaattagtctaaattaagatatagccttttttttttacatgggggattttttaaaataggagataattggattttaagtctagatctttgttttcaattcctcaacacattctgtaaataagaccaaattatagtagaaggagagtaaataagctattatcttttagaagtggtaaagagcactgattaaatatatattagaacttggctagccaattttattgaacaatttctgttcaacaaaatgttgtttaaagtacagtttagaaaatgatggtaggtttatttcttgaattttcagaaattcaagcttaaagcatcacgtttctctaatattgtgtggtgctttctgtcattttacttttttaacatttatatggaatagcaaccatcagccttctctttcagatgtgccgtttgggggtgctaaagctggtgttaagatcaatcccaagaactatactgtaagtatgaaagtgatatttgttttttattgttgttgttgtttttgtttttctgagacagagtcttcctctgttgttcaggccggagtacaatggcgcaatcttggctcactgcaacctccgcctcccgggttcaagcagttctccttgatccagtaactgggattacaggtgcacgccaccatgcccgactaatttttgtatttttagtagagaggggatttcaccatgttggccaggctgttcttgaactcctgacctcaggtgatccacctgccttggcctcccagagtgctaggattgcaggcatgagccaccgcacccggcctcaaagtgacatttgtgcacacagtgcatttatgaaggacttgaaattactgggcttctctgtatcccccactatcagtgagatcagtagtccccattgcttttcaaatggaatagaaaaatgtaaagaattaactcatagcgtgttttgccatataaagatcacctacttaatatctatatcctttatcattttctgtttcatttggttttgtttttatgagtcttttgttttacttttttgctttttgttttattattttcttacttagttaaaacgtaattaatatcttcacttatatacttatacccatatttatataatgtcttcacttagacacttatacccatatttaagaaatactgtgatctgattagccaggcatagtggtgcacacctgtaatcccagctactcgggaggctcaggcatgagaattgcttgaacccaggaggcagaggttggctgagatttcaccactgcattccagcctgggtaacagagcaagactctgtctcaaaaagaaaaaagtattactgtgatctgaagtttttatgtcaggatctgattctagtgacacatatcttaactaagactataaaaaccttactttttatccagtcagttccaagttaattcaaactgattgtcacaatgctttacataatactaaattatctatatacaaacataaatgcatgatttttattctctttaaaattcaccatttaaatggaatataattatatttaaattaatcttaattaagatttagtgtatttttcagtggggaattaatagaatgggaatttgagccctagttctactatcttgtttttataacctacttttttgatcccttattttgtcacctttaaaatggcaatgcctactttatgagttgttctaaggattacatgagaagacatatgaaaatgtactataaatagaaaataagatgctagctataatctcaagcgatttttatatcaattttttcttttgtttttgttttcttattttacaggataatgaattggaaaagatcacaaggaggttcaccatggagctagcaaaaaagggctttattggtatgtgtagccacatagtttttggtataaagtgggaacatctaaaaatttttttttttttttgagacggagtctcactctgttgcccagactagagtgcagtggtgcgatctcgtccgcctcctgggttcaagcaattctcttgtctcagcctcccaagtagctgagattacaggcatgtgccaccacacccagctgatttttgtatttttactggagatggggctttgccatgttggtcaggctgggcttgaactcctgacatcaggtgatccacccatctcggactcccaaactgctggtattacagataggagccactgtgcccggcctcctactatttgttataggagcttttgccaaacatacaacatttctgaagatattaatctttgtttgcttgatgtttttgtatcttactattatctgtgtttatattttctttgtgcacaatctgaatattctttttatgatatgtaagtatttgtcatgtaccctttaattttcaagcagtttaaacctatattttttttaatctagaaggcttctaatttgtttgaatagaatatgcataactacttaatagaatgcttgccctatcagtatagttaatagaatgttaatacttactgccgagcgtggtggctcacacctgtaatcccagcactttgagaggccgaggcaggtggatcacgaggtcagatcgagaccattctggctaacggggtttagtaggaatcccatctctactaaaaacacaaaaaatttgccaggcgtggtcgcgagtgcctgtagtcccagctactcaggaggctgagacaggagaatggtgtgaacctgggaagcagagcttccagtgagccaagatcacgccactacaccccagcctgggcaacagagcgagactccgtctcaaaaaaaaaaaaaaaaaaaaaaaaaagaatgttaattgttacttaataatagaatacttgtcctatcaatatcagtatagttaaacaaaataaggtctacttaaatagaaaataaagtgtatttttctctactttcctttcttagcatttcccccacaagttcccatgaaattaaactataaaggctgggcatggtggctggtgcttgtaatcccagcatttttggaggctgaggtgggaggatcacttgagcccagaagttcgagaccaccctgggcaatattacaagaccccatctctacaaaaaatgaaaacattatccaagcgtgatggtgcatgcctgtggtcccaactactaagatgggaggatcccttaagcctggggggttgaggctgcagtgagctatgattgtgccactgcactctggcctgccacactctggcctgagcaacaaaacgagaccacatctcaagaagaaagagaaatgaaataaagctattcggattcatttttaggaaaaaaaagtcatgaaataaatgtcatgaaataacctaatatagaaatacagtaagtataggtaactctaaaacttgactagatttggcctgtctttgataataaaaggcatttgggcctttgatgtgccgcatacccagcactactgtgaacttgtgcatccttacatggagtctgttaacgtaagttaatatgagttaactatctcgctcacacttttataggagtgcctactgattctgagatatggtgaattgaagtcatcttcagcctgttaatagccttcataatttttaaaaggtctttcctcttcccctaaatctcaaacacattttatagtcttgaatggtttcagactttattcagtcatatttgtcacccatatctgcaatatctccagcttaattttatcagacttgacaagtacctaataattccaaaggtcaaaaagtgattcattggaatactgaaagaaaacacagcttaaactctagtaatttgatttatttgcttaatgtgcaaaagcctcattgacccaggatgcagttaaattgacgtcttggcccagaaagctttgaagcctaggaggtaggcaaagggagttttttctctcactcctcggcaaaccttcaaatttgatgttatttatctgttatttcctgactgcccattccacagagagtgtcagattgaggctcagacctgagcctgaaccctgatcctgtcacatgtgtgtttagcatcagcttgtaaatttctgcaaaacaaaagaaaaaaagaggctgggatttttataggaatttcattgaatctgtacactaatttgtggagtattgccatcttccccaccctccccaaaaaggttttgtcctttcacccaggctggagtaccagacagcagtcactgcaaccttgacctcctgggctcaagcaatcctctcacctcaccctcccaagtagctagaaccacaggggtgtgcaactgtgcctagctaattttttaattttttgtggagacacggtctcatcacgtatcccagactggtctcaaactcctgagctcaagcagtcttcccacctcagcttcccaaaattctgggattataggcatgagccactgcacctgaccagtattgccatcttaaccatattaagccttccaatgctgaatatgagatgtctttccatttatttaggtctcttgatttctttcaatgatgttttgtagttctcattgtagaagtcttacatagaagtcttacaactaaatattttactccttttaatgctattgtaagtgacattggtctatagttttcttatgatgtctttgtctagtctttgtatcaggacaattctagcctcatggaatgagttgaggagtgttccttcctcttctgcttttggaaaagcttttgaaaggtcaatgttcattctcttgtgtgagtgtaaatatcacctaagttctgcaggaccctgatgtctccacccttctcatccccttatatctctgtgtaccaaaattaccctttcatctcctactctatagtcacatgctgttagaaaagttgcttttttaaaaaagattaacttctgcctcatacctgttctctatataagaatttatctgttaggccaagcatggtggctcatgcctgtaatcccagcactttgggaggctgaggcgggtggatcacctgaggtcaggagttcgagaccagcctggccaacatggtaaaaccccgtctctactaaaaataaaaaaaaattagccaggcaggtacctgtaatcccagctactcaggaggctgaggcaggagaattgcttgaacctggaaggcggaggttgcagtgagccgagatcatgccattgtactccagcctgggcagcaagagtgtaactccttctcaaaacataaaaattaaaaaaaaacaaaaagaatatatctgttattcaggaactacttgttttttgtttttgtttttgttttgagacagagtcttgctgtgtcacccaggctggagtgtagtggcacgatctcagctcactgcaagctccgcctcccgggttcacgccattctcctgcctcagcctcccaagaagctgggactacaggcgcccgccaccacgcccggctaattttttgtatttttagtagagacagggtttcactgtgttagccaggatggtctcgatctcctgaccttgtgatccactcacctcggcctcccaaagtgctaggattacaggcatgagcaccgcacccggcctcaggaactacttgtaatctgtgcatccctatacattagttttgtatggagtagaaaactcataagcctaataactaataccttgtgattttgttttggatggcagaagctgtttcacgtttagcatgtatagactgtttttgagaaggattttatcattacgtgtttctgatttacaaaccatgtgtttcagacttgccacttgccagagcccttctccaattggaattgttttttgtttttttgattttgagacagagtctcgctctgtcaccaggctggagctcagtggcgtgatctcggctcactgcaacgtctgcctccctggttcaagcaattctcctgcctcagcctcccgagtagctgggactatgggcatgtgcctccacccccagctaatttttgtatttttagtagagacggggttttaccacgttggccaggatggtctctctctcttgacctcgtgatcagcccacctcggcctcccaaagtgctgggattacaggcgtgagccaccgcgcccagccggttttttgttttttaaatgtattgtttaatcaagacaggatctcactatgttgcccaggcttgtctcaaattcctggactcaagccatcctcctgcctcggcctcccaaagtgctgggattacaggcataagccactgccccggcctagttggaattgttgtttgaggtaacaagcttatttaatcctaaagcaagcataatccttttgtagttacctctagaaagattcaggaccaatttgtcatttgtacattgggagaaaaggagtggttaaacaaagttgtgctgacctccagcagaggtatgtcactaaaggaatggaaagtgagcaaataggagctggagagcgccagagagcccttttgtcagtggatgaggctagaatatggcattaatctttccaagtgcagtggggattagacttcacaagattttgttgttgttgttgttgttgttgtcgtcattgacttcatgagatttttaaggtgactaagggaagggtgctaagacatagagttacagattaggtgggaggtggagagggtcagggtataaaaagcgatccttgaccatttcaaagttatcttatactagccctgtatccattacatcacagcttgttcaaaaaagtttattatttaggccttgggcccctgagttatagaaaaacattacaatatactgattctgttgactaaaaagtaaaatttataggaataattgggtacagcccttagaactttaattattttatggggagacataatagtttaatagtttaactttttttttttttttttttgaaacagagtcttactctgtcgcccaggctagagtgcactggcgcgatcttggctcactgcaacaccccccacctccattcaagcgattctcctgcctcagcctccggagtagctgggattacagacatgtgccaccacgcccggctaatttttgtatttttagtaaaggcagggtttcaccatgttggtcaggctggtctcaaactcctgacctcgtgatccgccctcctcagcctcccaaggtgctgggattacaggcatgcgccactgtgctcagcctaatagtttaaccattttttaagttgcgtttttcgttttgtaaaaacgagtttgtattttacagttgaaataatatagaaagttataaactatatatatggcagggaagagaaaaaaattataagtgggaacatgttatacatgctgtatgaaacctgcctttttccatatgtatgttcatgataattccaagtaatttacatggatataagttaccctttttaatggctgtttagtactttgcataggtataccatatttcatttaattggcatacaagataattaggttgtttttatttttactgtgtttgagaggagtatttctgcacctttacagatttgagtgagcatcacttaacatgtttttatcagagatcttactgtagccgtcagtagtagtatagtcagtgattcctgttattgcctgtaagctaatttattagcctaaacctttaatttcctatgatctgaggaactgaaagctaaggcctaaaaccttatatgtgctgaatgtcgaataataggtcacagccacattcttccacaagtaaaaataatatggggcttaacacaattgctttagcaatatgaccttctcccctttttctctacttgataaggagggcttatacccccactaagcagcatgttactctgctatctcatacatgtcaactccctaaccataataatcctgcttatatagaacacaatggtactgttatctctaattgcatgttagtgaaatgaggtcaagagaggctaaactgattaacctctggtcgcacactcagaaatcctatggagtggcttatatctgttgtgcatagctaacttccaaacatacagcaagtaaatgccagagggagaaattattatgtaatgttgtatgtgtctgcattttatagtgaaacatttaatgaatatttctatgactttgattagctacctaaatgagatctaaagttttctagccatggtaacttggttattacagagacttacaaggatctttgtgttcgagaagaatttttcttaaaaactggtgcactcctctttccctgtgcccccgcaggtcctggcattgatgtgcctgctccagacatgagcacaggtgagcgggagatgtcctggatcgctgatacctatgccagcaccatagggcactatgtgagtacccactggaagccccgaggcttctgcatttgctgtctacaagaattaacagtttgactgattatatcaaaagttgagaatccctgggtttttctctcattcaatcataatcttgatgtgcatattattttatgtctacttgtctattcttaaatcgtaatgaacacagattgagctttacttatatgctgccctatacttgtcactggaacaggaccagggcagcccactgtgctaagacactagaacgtacatcaagaagcatccaattctgatttttccctcagagggcttccatttaaagaggaactaaggtgcataagcagataaggtatggaaataatgtaatacaacagtggagattatgaattctgaaataagactttctagaggagatatttgggctagaccttgaaaatgggtagaatatgaacatttagagatttggaggataagaggaagagaaacaatagcgttcagtttgtctgaaggtaaggcatatttataaaggtaatagaaagtaagagtgagggctggatgcagtggctcattcccataattccagcactttgggtggccaaggcaggtggatcacttgagcccaggagttcgagaccagcctggacaacatggggaaaccctgtctttccaaaaaatacaaaaattagccaagcgtggtggtatacacctataatcccagctacctgggaggcatgcttgagcccaggaggttgaggctgcagtgagctgtggttgcaccacagcactccagcctgggcaatagagtgagaccctgtctcaaaacaaaaaaaaagtaagaatgaagaggtaaatgaaccaggacaaaaacaccaagccccagtgtttgtgttttacatggtagtcagtggagaaattttgctgatccttcctggggaagaataggctggcagcagtgtccagctgtgctggcgccaggagagaacctcctatggtgtcagtgcctttccaccaagtccaggagccagaggaccaggagaggagcattgcacatgtgaggcacatgacagagagactcagcaaaactggattggatatatgtggaattaaggaaagggaccaggctgagtcacagagaaccaggagaacctgagtctggggactgagcagaggtagtaccacagaactgaacatgagaggaaacttaactcctgtccctgaaaggggtgcaaccttaaaaaatgaaacatttcaggagtaggaagagaaacagagtcaaaaaatacatttatgcctactacatgcagggccatgtgtaagcaaggtattcactacaattgggataaattgctagaagttgttttgaagctatgaaaaagaatcacaggcccatccagtcctttcagtcctttcaaggtaaggtcagaaaaagcctcctaggagataaaaccttctggtctgcacttagacgggtgtgtggacatggactagggtaggggtagtggcaagtgtttggaacagaaggaattacctgagggaaggttctgaagttcagaagctgggtgaacttgggaggataaggactgactactgtggccagagttgagaaagagaaaggtgggataagaaaggccagtagaaaaaagggtcaggccaggttactgcttggtaggtgaccatgagaactttggtctttgtcctgaaaacacagggaaacagcaaagagctggtttcaagcaggtgtgactcagctaagtgtgcatttgaagacttgagggcaggagactactacaggggcccggactgcaaggggatatgaagagggaagcagggcatgaaatatagcctccaactaagaaaaatggcaccggagagaagcagaaagaagacagcttgaaaagtggctgttacccagagaaaaaggttttttttgtcttttggcatgtttattggctgtaagacacagatttaccggtgcaagagatagacaatgctgaagagatgcaggctggtagaggtagtgaagtcccccaggggaatgaaggcctggggaattcttttcatagtgaaaagatgggccttggagaagaggaagaatgtggaaatggggacatttcctgaagtgatgtcatgctgtggctgggaacatgggcagaccacctgaagtccaaccctggcaccttcacccatcagtgctgtgacttgggagtctctgtgcctccatttcctcctatgcaaaatgacagtagtaatagtacctactttgtgagactcatgagcattagatgaataataatctaatgcacctagaactgtacatagcccttagtaagtatcagaaaataaatatctgtaggtattacatcaggtaaattatacaaccccctgaaataaaacaggaacgatatagacccttcaaataattgtggtttcaactgcccttcccaaaaggacagttttccacctgtcacctttttatgcatccttcccttagcccttgattttagatttcttatcacttgaaggaaaactgttcaccagtatagttcaaggggccgtgcttcacaggactttctcttgctgttagcactgagaatgagctacaaataacatactgcccattggtttgcactattcaatatagtgtcttgcttaaaaagaacaagagaccagctgggcatagtggctcacgcctgtaatcccagcactttgggaggcggaagcaggtggatcacctgagatcaggagctcatttagcaatgagctctgggtgtggtatttttttttttttttttttttttttttgagacggagtctcactctgtcacccgatctcaggtcaccgcaacctccgcctcccgggttcaagcaattctcctgcctcagcctcccaagtagctgggattacaggtgcctgccaccatgcccagctaatttttttgtatttttagtagagacggtgtttcaccatgttgaccaggctggactcaggtgaagcaactatactggtgaacagttttccctctttaagtgataagaaatctaaaatcaagccctaaaggaaggacacagttgtttttgttactcatttctagatgtgaactgaaacgtgccgccctctttgtcctagccccacctagaagtgcagtgtaggtgggagaatgtattcttctctgggctttcaggaccattacgtatgctggggagcctggcagttggcgccaggcctgaccccagacagtatttccttcagctccagcatttgcattctcactgtttaaaagcatttggcactcggtttgcatttctgtattcataagtgttaattattcatgaaagcaaactgtgggaaaactactaattctattaatcactctactagactgagtttttcttccttgctttcatcctttttgttggtaattacacaaataatataattctaagttctctgtgtaaaaatatttaaacaatacagataaagaacagatcactttttaattcagccagctggaatgttagggatatgttgggagttaggggtttggtgtgaagtagggcattttattttgtttacatggaaagcaaattgcttcaacaaatttattattttatacttttgccactgacttaaaattttatatgaattttcattttatattgattgcctatacaaaataagactgtctctagtttctcctgctccaccgatgagtttactctgcagtgttctcgtggccgtgcttatagtatagttgatgtcttggaagggaagccctacttagcccaattcttcttttttctaattacacctgtttctgtttctgaacaagaatatacacacatcttcaattgaaagaggacaggccaggcgcggtggctcacgcctgtaatcccagcactttgggaggccgaggcgggtggatcacgaggtcaggagatcgagaccatcctgactaacacaggatgttactctctactaaaaatactctactctactaaataccccatctctactaaaaatacaaaaaaattagccgggcgtgatggtgggtgcctgtagtcccagctatcgggaggctgaggcaggagaatggcgtgaacccgggagatggagcttgcagtgagccgaaattgcgccactgcactccagcctgggtgacagagcgagactccgtctcaaaaaaaaaaaagacaaagaaagaggacagaaagatggatggtgaagactgttaacccccatctccactttgcagagctaaccactgctaccaaagatactctgctcacacagaagcacaggactcttacccacacatacctttttaaaaatacttcattaaatactttcgttactctactcttagatgaacttgaatgtcatgttatattaagtatcaagttatattaaaaacttcctttttcaaaagtggcagaatacaacattgagtcttcccatccaagacaattgtaaagcctcttcctgtctcaggctctgttttggtgacatgctcaagtcttatagtagattttaagacactcatgaatgggatgtgtatgtaccttgatttagtagtgcttaaatacttgttgaaggaatgatagctttaggctgagctagctctacttttgtgatgttatttgtacttacttgatgttcaatccctacactcttgttttttctgtcagaaaatatggtctactttgccgggcgtggtggctcacgcttgtaattctagcactttgggaggccaaggcagggagatcacttgaggtcaggagtttgagaccagcctgaccaacatggagaaaccccatctctactaaaaacacaaaattagccgggcgtggtggcacgtgcctggaataccagctactcaggaggctgaggcaggagaatcgcttgaacctgggaggtggaggttgcgatgagccaagatctcaccattgcactccagcctgagcaacaagagtgaaactccgtctcaaaaacaaacaaacaaacaaacaaaaaaaaaaacagaaaatatagtatattttattgtattttctaggaacagaaagctgaaaaagtgagtcttgtctctattggtaaaagtataccttaaatacattcatacacacactcctaattagcatatttttgattaaatgagaatgtgctttgactttaattcattatgttccttcaacagagaaattggacttgacatttcattctttcaattaccccctcttacaggatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcaggtaaaaacaaaaacaaaaaaagtttccttaataactgatagacattaagtaaagttttcaatgtttttagaattgtaattttaaaattaagttatctcaaatctcttaaattttagagtggtggttttcagagtaatagatattttgttttttgaaccttggtatgattcatgtaactagaactgatttaagtatctctcaagtacatgtgaaactgttaccaacttcaaccaaactatcaccaaattcaaccaaaatattggttagtattcaaacttgaaattatagctagaagggcaagtctcttaacataattttctaagttttgtaagtatatagaaaggtttacacactgacccaaatttgtttcatgtgttaacatgtattttacttaggagaatcttaattaagttgaaattacttgaaaatagaagtggtggctggacacagtggctcatgcctgtattcccagcactttgggaggccaagacgggtggatcacttgaggccaggagttcgagaccagcctggccaacatggtgaaaccctgtctctactaaaagtagaaaaattaagccgggcgtggtggctcacgcctgtaatcccatcactttgggaggccaaggtgggcagatcacgaggtcaagagatcaagaccatcctggccaacatggtgaaacccggtctccgctaaaaataggaaaattagcagggtgtggtggtacacgcctgtagtcccagctactctggaggctgacgcaggagaatcacttgaacccgggaggtggagcttgcagtgagccgagattgcgccactgcactccagcctgggtgacagagccagactctgtctcaaaaaaaaagaaagaaaaattagctgggcatgatggcggcacctgtaatcccaactactcaggagactaaggcaggagactcacttgaacccgggaggcagaggctgcagtgagccaagattgtgccattgcactccagcctgtgtgagagaatgagactcggtctcaaaaaaaaaaaaaaattgtatttctccaaattagtgacatcccttttcacaacataggacatctgatcatcaaggactgaggacctggtggtgtacttaacaccactgccatttattgattgattgagatggagtctcaccctattgcccaggctggagtgcagtctcggctcactgcaacctccacctcccaggttcaagtgattctcctacctcattctcccaagtagctgggattacaggcacggaccccatgcctaatttttgtatttttagtagagacggggtttcaccatgttggccatggctgatctcgaactcctgacctcaagtgatccacctgcctcagcctcccaaagtgctggaattacaagcgtgagccaccatgcccgctcatcacattcttaaacagagaattttattgttgaagagaaaccagttagtacattgtttcttttggcaaaagaattttgagaattgcttctaaataaacagagtatggatttacattggtcaaaatatgactcttgctgtctataccaggactttaatttttgtgttatgggtaattgttcttcacagggatttggtaatgtgggcctacactctatgagatatttacatcgttttggtgctaaatgtattgctgttggtgagtctgatgggagtatatggaatccagatggtattgacccaaaggaactggaagacttcaaattggtattaatacatttttatagcatagacactaaatataaatatttaaaactctggtgcagctattaattgtgattttcaatcaatggcagcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctgtaaaaaaaaaaaacaagcaaacaaaaaaaaaacctagataaatagaaaagtgaaaggtagttttatacacttggcagagaaaaataacctctatttaactttaactgaaactgtgcttctccccacagccccttgttcatatatgcacatctcttgccctcagtggaggggatttgacggtggtgttcgcatttctctatgttcctgactctcttgcagatcattgctgaaggtgccaatgggccaacaactccagaagctgacaagatcttcctggagagaaacattatggttattccagtaagtcatctatatttattaggctttatatgtacttagaatcataatagtcttttgcaaggaatttggaggaagagaggaattattagtctccaagctctagtgaattcatctttttcacttttgagaaaatatagtagaagcatggttaattctaagcctgttaattttcactttgatcgaaacatttattccaatttcaggctctttactgaatgtctttagccttctaagagtctggttatataaatgtgtactgtgttagaaacactattctaactaaagctcttaagattttctatatgattcctaaccttatgcatttcaagtgccctttccagctttactcagaaaactaatatgaggaacacgtgctcaggttttttagcaagtaaaaatgagtctacaccaaaaagttactagaaattaatgtgggcttggaatatattttaaagaaccccctttgctgaaagcacttaagacatttaatgtaactgaaatgggctacccttaggtaataggagaaagaatcctgtcttctgagaggccctgtggacagtccagtccaactggttggtgggcaagccatttagtctgagaactaacttctggtagagaagaggctccaaccaaagattattaactttccttgattaataagccaaaaaatgattttttttttttcctaaatagaaaaagccttagatggaattgggtgggatgggaaggagtgttaattaagtgtgaaattcctgatactggctaaaatatatttgcgatatttaaagtccagtctaccttggtattgaaattaaggtcttaggttcattttcagcttttacgaaaaccatcatcttctaatttctttgtcttatttttgtgcataggatctctacttgaatgctggaggagtgacagtatcttactttgagtggctgaagaatctaaatcatgtcagctatggccgtttgaccttcaaatatgaaagggattctaactaccacttgctcagtgagtatcgataatcttgttcgccaaaactcatcttttgagccagctgaaaggctgtaaaaaggtccacttaagagaactgatccctttgggaaagaattgagtctcagaaaagaaaataatattttgtctcatgaaacttagaccaaaaatgcacaatgtctttctggatattaactctcccatatattatatccagagttttattctgtgatgtaatattcacagaatataatctacattttttttttctttttttgagagggagtctcgctccgtcgccgaggctggagtgcagtggcacgaactcggcttactgtagcctccgcctcccaggttcaagcaattctcctgcctcaccctcccaagtagctggggctacaggcactcaccgccacgcccggctaatttttgtatttttaatagagacggggtttcaccatgttggccaggatagccttgatctcctgacctcatgatccgcctgcctcagcctcccaaagtgctgggattacaggcgtgagccactgtgcccagccaataatatttttttaagtgtgattttaaaactccactgtcgatactaatttctgtctctggttgctcttagtaaaggcctatctagtgtcaagaattgtttttgagactcctgatgagaatacttgtttttctttgactagagtaagctccacagttaagagtagaatttctcatctagttgaaataagaccaagacctcctactgagcttctgtactcagcccactgtgagaatctgggtgaagtgttccatctatttccttttctttttcccccagcgttttctttttaatagagccaaggaaaaaccctggtaatgggtgttatggaaacagagcagtgacctaaattcacatttatataggaaattggcaatgtgttttattccttcctgactgagttttaaatgattaacccttttatgtcattaaaactctgtataaggccaggcgcagtggctcacgcctgtaatcccagcactttgggaggccaaggcagatgaatcacgaggtcaggaggtcgagaccatcctggctaacacggtgaaaccccgtctctactaaaaatacaaaaaattagctgggcgtggtggcgcgcacctgtagtcccagctactcgcaaggctgaggcaggagaatggcgtgaacccgggaggcagagtttgcagtgagctgagatcacgcctctacactccagcctgggtgacagaccacgactctgtctgtataagtttttgggttacagttatagtttgggactacttttgattctacttttttttttttttttctgttagcaatatcttgatctcttgttatttttttgtagtgtctgttcaagagagtttagaaagaaaatttggaaagcatggtggaactattcccattgtacccacggcagagttccaagacaggatatcggtgagtgtggtgaccccacagttgtacttcacacatgctccctgctctttccttcagacagagctggttagatggatttcatctgcggcatagtctttgtaattagcttgacagtaagtgcgtgacatgtgtgttttgtacctttccttttcattacattctaaaactggagtaagaatcctactgactactaacaaatataaaataaataaatttggtatttttcacgcacgtgttttaacagtgaaggattattatgtattttaattattttaagcttcagagaaataggaagaattgaaaagcaagcattagattgaactatatgggagtccaagagtttgagaccaacctggggaacatagtgagtccccatctctacaaaaataaagaaagaaacaagaggccaggcatggtggcacacgcctgtaatcccagcactttgggaggtcaaggcgggtggatcacgaagtcaagtcatcgacaccatcctggccaacatggtgaccccgtctctactaaaaatacaaaaattagccaggcgtggtgctacacgcctatagtcccagctacttgggaggctaaggcaggagaatcacttgaacccgggaggtggaggttgcagttagccgagattgcaccactgcactctagcctgagcaacagagagatactccgttcccgccgccgccacccccctccccccgccaaaaaaaagaaaggagggatggagggagggaaacttctttaccagtaaatgatggaagacaggaaaaacaaaagtccataacacataagcctgggggaaaaatttaacctcattgttaaagaaatacaaattgaaaaagagttttttttttttaatgtattaacaaaaacaatggatcttatgttctccatatatgtggtgaaacagttgtacctttattctagtgacggtgtagattggtgcagctctttggaaaatgtgaagttattaaagtgttcctgccctttggtgctatgacaatctcccctctgggaatttatcctaagaaaataattcaaaagaggaggaaccactccatgcacgatgatgttattgaaactatgtgtaggccaggtgcggtggctcacgcctataatcccagcactttgggaggccaaggcaggtggctcacctgagttcaggagttcaagaccagcctggccaacatggtgaaactccgtctctactaaaaatacaaaaaattagccaggcatggtggcacgcacctgtagtcccagctactcgggaggctgaggcaggagaatcgcttgaacccaggaggcagaggttggagtgagccaagaaatgcaccgctgcactccagcctgggcaacaagagcgaaactccatctcaaaaaaaaaaaaaaaaagaaacggtgtaaacagtttttaaatttggttttatttaaagtttaggagcagggaaatggctgacttatatcttataatacatcttaggtaatattcactcatagtttaagaatatattacaatgggtaaattatatcttctttttttttggtttttttttttttttttttttttttgagacagagtctcgatctgtcacccaggctggagtgcagtggtgcgattttggctcactgcaacctctgcctcccaggttcaagcaattctcctgccttagcctcctgagtagctgggattacaggcgcccgccaccacacccagctaatttttttgtatttttagtacagacggggtttcaccttgttggtcaggctggtctcaaacccctgacctcgtgatccacccgcctcggcctcccaaagtgctgggattacaggcgtgagccaccgcgcccggccgtcaatatatctccttatgaaatattcagtgatggaaaacagttctgagactatattgcaacatgggaaaaagttaaagattttgttgtaaagaaagaaaaaatgctttacccattctaggtactaaccgttcccctcagtaaacttcctatttcctagagtgatgtctttgttctggtccttttatctggaatacactgatctcctccctgcttaagtgtcactgcagttctgtggctctctctgaaagtctcctgtgtgccactgtttcgtacataacatccatcccaagtggctagcagtgcatcggaaggacttgcgctgctactgtccctgccagagggctgttcacccctccctttggtcaccccactgcccagcatatgccttgtcagttaaaaaaataaaagttttctcaagctctctccctctagtttccccctgcccctgtttggcactatcaggacccacatcatgaccctgccatgtttccactgtccctcatccccccagtgccctcacttccctccttatctaacttaaattccgtgctccatcattacagtcactccccagtcttgtttcctttgtcatactcctttgttaacacctaagccctgattaaatcccagcagccctgattaaatccctgattaaatcccgtgcctctaccctgtaggaggccctgctggcagttcacaccctgaccactaacctcaagtaggcgctcagagctgcccagcagtcatactgcttttccgtgtttcattcattctccccgtctcctgagtgattacatcacattttctcctcttctcactgccctgcattccagctcatgacctgctatctgttcacagataaaactgatgcagcctgggagcttccgcatctacccagctcctggtacctgtacccagtcctgtgtcatctctcttcgaatagatcagctctttgtgctttcatttcttaggtccagttcttgttgtgggcattggatggtttttcctcagatacactgctctagcaagtctgctcctctctcctacatcagcagtttccctctgagtcattcccctcagcttaccaaatgctgttttaaaaaatgtataaatcttaatcccacttccccttccagtattgccatttgtttcctgtagagcaaacctccttggaagagttgtatatactcagcctccaattcttctttacttgaacctactccaccaagactattcttgtcaagacagccagtgacaccagcattgccaaatccagtagctatttttcagtcctcatcttgcttgacctatcagcagttcttgttacaactgacactcccaccttgaaacattttcttctcttagcttccaggataccacattctcctggttttctccctacctcactaaacatttcttctcaattgcctcttgctggtatctcttcaactcttcactctcctaacattggaaggcctgcgtccctaaaccacttctctatctagattgaaaacttcaatgatccacttagccttgtggtttgaagtccatgtatatacactctcttcccactacaatataaagtctgtgagaacagaattttgattttattctctactatgtcccctagtacctggaagagtatgtactcagtaagtgtccaaactatatcagtgacccattttaagtttttatcgggcatatgtgttttgtagctctgtatgtcaccttaagagtggtagtgagttaattgtccttaattttttagaaagcattccaagaaacaaattaggaaagagagaactgacttgatggtggaggccctgagtcatatcccagctctgaaaatagctatctgtaaccttggccatcttctctggtccttagtttcctcatcagtaaaattaaaacgctgctgagatctacacagctttaaaagttgctggcactactgaatagatacacagaattctaccccaaagccgctatggggtttaatcagattcctttctgtgttctgtgtggtgtccctgttctctggggagctgaggcgaacgcaccgtggcatgaacagtgtaacacattgctcagtgcatctgcgtctccatgagtggagggtgctcatctcactccatgccctcatgtctctaggtccaaaaactgtcttcattgttgtactataatcttatttcatgagtatttgtttgctgtcaaatataataaaaataaattgtgatcaacaagcaactgcttcagtaagtatcaagatactgtatctttgatactgtgcagaaatgacatatcttagctaaaagacaaaaaattctgtctggttgtatattgacttgagaatcctttgtcatcttatacagggacacaaagcaggtctttgtggttttgttaaacttgtgttcttttccctaatagggtgcatctgagaaagacatcgtgcactctggcttggcatacacaatggagcgttctgccagggtatgtgtgcagatgctgtttgccttccagctagtcacatgaagtgcaactcaaccatgctatctcagccgccagactgtatgtgctgatagaaaacatcaatctgttcaatggtcctcatttgtgtgtagcaaaacacatgttttttcagtctcagatgataagcaattttttagagtcttcaaatatgtttttgaggctttggaaagaaataataaggctgatttaggaggtaatgatgttggcagctagcccagtatggagtagttagccaaactggattgtagctccatgtgccactatgttatagctacgggagtctaccttactatagaatttggtataagcaaaacttattttgactgcttgatccctactttaaggcctcaaccacagtttgagtccagttttcctaatttcttcttgggttcagattctatctgcttggatttatgatgaaatagcataagcagatattggtgaagaaggtggtgcttcttagggctgttgtttttcttgttaatttttgatcgagatagggtgtatgtggtataaattcatcctttcaaagtattaaattcggcatcctttattatatatttgagccatcaccactttataattctagaacattttcatcactcccttttttttttttttttttttttttttgagacggagttttgccctgttgcccaggctagagtgcagtggcgcactttcagctcactgtaacctccacctcccaagttcaagcaattcttgtcccttagcctcccgagtagctgggattacaggcatgagccaccatgcccaactaatttttgattttgttttcattttgtttagttttttgagatggagtttcgctctgtcacccagctggagtgcaatggtgcaatctctgctcactgcaaccaccgcctcctggcttcaagcaattctccttcctcagtctcccgagtagccgggattacaggcgcccacccccacacccggttaattttttgtatttttaatagagatggggtttcaccatattggtcaggctggtctcgaactcctgacctcaagtgatccacctgcctcagcctcccaaagtgctgggattacaggtgtgagcaaccgcacccctgcctaatttttgtatttttagtagagacagggttttaccatgttggcaagtccggtcttgaactcctgagctcaagtgatctgcctacgtcggcctcccaaagtgctgggattacaggcgtgagccaccgcacccagccaccccattgttaagtccagagaattaggccctcctgcctagaggttctgctgctagagtagtttgtctttggctgcccaagtcctgccttgaaacaatgagagggtaacttggaccaggcctgtctgggccttgtgtgtttatggcctggccacttgagtcaggatcatcttcactgcattttctctttcatttcagcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaa

SEQ ID NO: 35721 - DNA, 40378 bp, Homo sapiens
tcagccgctccctctgggcttccgtcctccgcccgcgcccgacggagcctgttcgcgtcgactgcccagagtccgcgaatcctccgctccgagcccgtccggactcccccgatcccaggtaacggccagcaggggcgagcgtctcaccctgtcggcctctcttgtccaggcctggcgccggacttgccgcgggggcagtgagacgggggctcaggccgcggggccccgaggctgaggcgcggccgggtctccctgccggggcctcctgagggggcggggatcccctttctccgtggatcccctgcagcttttctcaggatgttcgagctcctagccgcctccgatgcccgaattaacggccccttctgcgcccccagggtcctacttgcacctctgctgggggcatttgtcaccgtctctaaaattgtgtcaagtaggaggatctcccgtaatcgagcgacccgcgggactattcatctctttagtgtctagagtcgatccctgcatacagtaggcgcccataggatgtttgcctgctctctagggcagccctcaatccttcggttaatggggaaccttctcgatctcgagaaaaaccttctcccgagttcttttaagatttccctgcatgagtaccgccttcccccaagtcaaaattgcacccttctcggcgctcttattcatttagtggaatcttttatgccagtcctggcaccaccactttgttgagtgatcctgggaagatgcttctctgcgcctgtttcctcatctgcaataaaaagattcttaccgttttgctaagaatcaagtgagcttatttgcataaattgcttagaatagttcctggccgagagtaggtgatcaataaatattagctattattactgcttctgggcattctatgcatatccgtcttcctttccttttctatctcctccactctccccaaacaccaaccctccagacttgaagaccagaatggtgtcagccttatttatgtttctagccccatcccggtatttacaacactgctgggaacatgataggcacttaatcagttatagcttagaatctttgattataaagccatctgttctcctgcagctttggaaccttctgtctatgtcaactcgtagcttaaattgccgagattatcttagttctgccctctctcctcaattttatctagtcttgtggtttcacatagggcctgggttttcaggtatctaaaaacagaggaggggcatcagtcaggaaggtgtttttgtcctgttagggagtgggtaactgtggttgttgtcttccttttttttttttttcctgcagcctcgacctcctgggcttaacagatcctcccacctcagcctcctgagtagctgggactacaggcgtgtgccaccacactgggctaattttcatttatttttatttacttatttttggagatagagtctcactctgtcacccagactggagtgcagtggtgtgatcttggctcactgcaacctccacctcctgggttcaagcgattctcctgcctcagcctcccgagtagctgtgactacaggcatgagccactgcgcctggctaattttttttttttttttgtattttttgtaaagacagggtctccatatgtggcccaagctggtctggagctcctaagctcaagctatcctcccacctcgacctcccaaagtgctgggattttgggtgtgagacaccacacccagcttatatggctattttctcccacaaagtattcagagatcttctggagttcatctgttaatcacagttaaaggaagggaccatttcggaaaactcctattttggacgcggagtggtgatactttgatctagttgtctcatccaatgctgaaacaaatcctatataaagaagtttaaaatggtctgctggtgaggctggtgcctggactggagcctgtctgaatgttgaggagggtgtggtgaccttgttggagtacttgatgttgctagattggctaatgagagtgattaggaactaggtgaatcacggtcttgaaaactgaccctaaacaggggacagaaatgcccacttttgtgggcattttcaagctccaaaggagtagggccaagaatttatagcatatgtcaacgtttccaagctcagaggaaactaactggtgggttctatggttggtttaaaagccttgagttggccaggtgcagtggctcacgcctgtaatcccaacactttgagaggctgaggcgggtggatcaccaaggtcaggagtttgagaccagcctgaccaacatggagaaaccccgtctctactaaaaatacaaaattagccaggcatggtggcacgtgcctgtaatcccagctactcaggaggctgaggctggagaatcgcttgaacccgggagacggaggttgcggtgagctgagatcacaccatttcactccagcctaggcaacaagagcaaaactccatttaaaaaatagaaaagccttgggtcaaagggagaaagggaacctgctggcatgtatttcaggctaggctctgtactacttgctttcacatgtctcatttaattctccttgtgatctcagtggtatatccactttacagaagaaaaaaatgagatttagagatatcaagtgacttgcccagggtttcatagctagtgtgtgtcaaaagccagggttcaaacccagcctcggcttcagagcccatggctagccatacatcagaatgactctgtactcagtgatagataaagaaaaggggtgggggccgggcatggtggctcatgcttgcaatcttaacactttgggaggctgaagtgggcagatcacttgagcccaggagtttgagaccagcctggacaacatagggagacccctgtctttacaaaaaactaaaaaattagcagggcatagtgatgcatgcctgtggtcccagctactcaggaggctaaagtgggaggatggcttgaccctgggaagccgaggttgcagtgaactgagatcacaccactgcagtccagcctgggtgacagagcaagaccttgtctgagaaaaaaactcagagagagagaaaagggatgaggggggagggagggaggaaaagaaaagggatgaggggcagggcgcggtggctcacgcctgtaatcccagcactttgggaggccgaggcaggcggatcacgaggtcaggatatcgagaccatcctggctaacacggtgaaaccccatctctactaaaaatacaaaaaaattggccgggtgtggtggcgggcccctgtagtcccagctactcgggaggctgaggcaggagaatggcgtgaacccgggaggcagagtttgcagtgagccgagatcgtgccactgtactccagcctgggcgacagagcgagactccgtctcaaaaaaaaaaaaaagaaaataaagaaaagggatgaggagttcctggcatttttatttgtccccttttctccctctctagctctattaagacaaagcttttcagatttcacttaaacattaaccatagtttagaaattataattatcaccctatgacagaaggtaccctttcttggtacataattcaagctattaggaatttcttctgcattcactgggtttcatgaatgcaagtggtgtttgctaggtgcattctaaatttgacaaacatgagtgttgtcttggcctgcagacttaaaatagccacctgattataaaagaagtacaggtcttaagtgtatgtccaaatatggaacttgaatgatatggcaaaattagaaatgcaattttagaagtaattacactgttgtgtaaatggccacctcttttgaagtctttgctacattgcttataaaacactgagttgaacatgagaaagccttttgtctgcagctgtacttttcaactggacatgaaccatgtacttttatggcacgtagatattcacatcaaatttctgatttgcagaccgattttatttttagttaacaaataagcttatcaaatgtggcttttgaactaaagcgcttttaattaaggagttataacagcatgttattttgagtagctgttactaaaatctgttgtgatggaacaatttggagtgagcatctgatatcagagataaagagagaagcatgcagtgagcatctggaagttcttgtaaaaaaaaaaaacaaattaaacattctcatttgaatgcatttaaaatttttttaaattgccaattcctaagctttttctttgttagttgtagtttgctttctcgactgtataaaagaaaaaagtaatgacttaactatcttcactcttagaatagaatatgaaatgctagcatttctctgccagttcaaggtatcagatgttttttatttaaagttgcacttacctttgggttccccccccctttttgtttgtttgtttgttttgttttgatacagagtctcactctgtcacctaggctgcagtgcagtggcaccatcttggctcactgcaacctccgcctcccatgttcaagagattcttgtgcctcagcctcctgagtagctggaattacaggtgcctgccaccatgcccgtctgatttttgtatttttagtagagatagggtttcgccatgttggccaggctggtctcgaactcccgacctcaggtgatccgcccacctcggcctcccaaagtgctgggattacaggcttgagccaccatgcctggcctgggttcctttacaattagcagaggtgctgcttctgctttctgagactgatttctgctttgtcagctgaactttcattgttcactttacaaccttctagtggcccttccattcatttcctgcttgcatcagaattcatatctcacatttcagcctccacccaaggttaacatgacacatacttacgtgtgttgaaacttgagtttattgtgagggtgcctcctggaaatgataaagttgggggtagaggaaggctggctgctttttgaaaaatgttcccatttcagttaatggttgcttcttcaagtgtatctagatttgggtacctataaaatagagaatttttaatttaatgttttgcagattcctgcttttcatttagttacaattaaaagtttaaaaagtattatcacaaacgcctacatactctttgcctagattcaccagttagcattttgccacattcacattctatatattttctgtcctgaactattgaaaataagttacagtggctgggcatggtgactcatgcctgtaatcccagcactttgggaggctgaggcaggtggatcacttgagcccagtcagagcagcctgggcaacatggtgaaaccccatctctacaaaaattacctgggcttggtggtgcatgcttgtagccacagctactcaggaggctgaggtgggaggatcacttgaggccagaagacggaggctgcagtgagcatagattgcaccactgccctccaaacctgggtgagagagcaagaccctatctcccctgccccccacccaaaaaaagaaaagaagttacagaagacatcatgatacttcatccctgaacacttcatcattatctttgtctcctaagagctaggacattctcctatctaatggcaataccgttatcacacctaagaaaatgaaaataattccatatgtaatatctagtttaaattgtaattttccctgttatacaaaatacatcttttctgcccattttttaaaatgtggattatgggccaggcacagtggctcacacctgtaatctcagcactttgggaggctgaggagggcgggtcacttgaggccaggtgttcaagaccagcctggccaacatggtgaaagtccatctctactaaaaatacaaaaattagctgggcctggtggtgcacacttgtaatcccagctactcaggaggctgaggcaggaggatcacctgagtccaggaagtggaggttgcagtgagctgagatggtgccactgtactccagtctgggcaacagagtgagactctgtctcaaaaaaaagaaattatattataatcaactttcacttatcaaatttggttttcatagctctctagaacagttctcatcctgcctccatattgcctttttggaatagtccaggccagttcttctatagaatggcacacaccctggctttaactgtttatttcctccttgtgttgcttgactagttcctttatcctttatttcttgtaaactgaaaattagatctgaatcttgattggatttagagtaaatatgtttggcatagagacttcattggtaggttgaccatattcccaggtttctccaggatagccctgtgacctgttgtgttggcataattattatttatttttgctctcagaagtgttctggtttggatggtacgttaagtcactatttataagtgacgatgtgtacttcatgtggactgccatcaggaggcccatccagttagattgatccactatttataacatggtgattacgtggtgattgccagatttcttcaacgtaaaggcatctttttctctttgtagttaataagcaatctgtgggatgataatttgagactaggaatatcctgtacccatggtttaagagtccattgacgaccctgaacagaataaattccacattagttgttacaatgctagatttattcagatggttaagttttgacaatgagatagatttttttttttttttttgagacagaatctcactgtgtcgcccaggctggagtgcagtagcgcgatgtcggctcactgcaagctccacctcccaggttcgccattctcctgtctcggcctcccaagtagctgggactacaggcgcccgctaccatgcccggctaattttttgtatttttagtagagacggggtttcaccgtgttagccaggatggtctggatctcctgacctcgtgacctgcctgccttggcctcccaaagaaagttctgggattagaggtgtgaccaccatgcccggcctttttttttttgagacagagtctcgctctgtcgcccaggctggagtgcagtggcatgatcttgattcactgcaacctctgcctcctggatgcaagcaattctcctgcctcagcctcccgagtagctggaactagaggcgtgtgccaccacgcccagctaatttttgtatttttagtagaaactgggtttcaccaggttggccaggctggtcttgaactcctgaccttgtgatccacctgccttggcctcccaaagtgctagtattacaagcgtgagccaccgtgcctggccagattattttttaatgggaggacaatgttttatttatttccgaacatcttaagatcctcaggcaacttaaacattggttacttgccttttccctattgtataaaatgctttttgttattgttcattgcagctttctctcctttgaaaacactaagaataatgtcactgcatcagtttttactagagccaatcacctgtcatgcctggaacagggatcgtactcgtaagtattttattaactttgcttttgtattttggtacctttggtacatttcatctttagacacatttagggctcacatatctcagtatcacatgtgcaaagaacatacatctattatatacattcagaagggaactaagtcagtcctttggtttacagatagataaactgaggcccagagtgaaggaagggctttgcagaggttacataccaagttcacatttagtcagagcactaggacctagaataagctgtttcagagacaagtggtttgctcctgagctactcagagcattattaactagtatttactatgttattcttagtcagcttgagtttctagttttctagctccagcaaactagaaagggatggagaatgctcttagaagtaggcacagttcagcaagcaaagtgacagataatatgacaagatgaggctgggtgcagtggctcctgcctgtaatcccagcactttgggaggccaaggcaggcaaatatcttgagctcaagagttcaagaccaacctgagcaacatggggaaaccctgtctctacgaaaaaaaatagaaaaactgtgtgtgtgtgtacacacacacacacacacacacacacatatatatgtattttttttttttgagacagagtctcgctttgtcacaaggctgagcatggaggctcatgtctgtaatcccagcactttgggagaccgaggcgggcagatcatttgaggtcaggagttcgagatcagcctggccaacatggtgaaaccccatctctactaaaaataaaaaaaattaaccaggtgtggtggtacctgcctgtaatcccagctactcaggaggctgtggcaggaaaatcgcttgaatccgggaggcagaggttgcagtgatctgagattgtgccactgtactccagcctgggtgacagggcaagactctctttctcaaaaaaaaaaataataacaataataattaaataataaaaacacagaaagagcaggattggggagaaaaagtccaatttcgcttatttttcttttgttgcttgtacttctgctgttgtatcaaagaaaccattgcataatccaggatcacaacaatgtgtgcctatgcctgtgtttccttctaagagtcttaaagctttagtccttttatgtaggactttggtccattttgagttaatttttgtgtatcctgtaagatagggttccttttgtatgtagatatccagttttcatttttttcttctttttttctgtgtttatttatttatttatttattgagacagagtcttgctctgtcatccaagctggagtgcagtggtgcaatctcggcttactgcaacctccgcctcccaggttcaagtgattatcatgtctgagcctcccaagaagctgtgattacatgcatgcgccaccacacctggctaatatttttttttttgagacgcagtctcgctctgtcgcccaggctggagtgcagtggcacaatcttggcccactgcaagctccgcctccggggttcacaccattctcctgcctcagcctcctgagtagctgggactacaggcaccagccaccatgctcggctaattttttttgtatttttagtagagacagggtttcacctgttagccaggatggtctcaatctcctgacctcgtgatctgcccgccttggcctcccaaagtgctgggattacaggtgtaagccactgcgcccggcccacacctggctaatttttgtattttcagtagagacagggatgcgctatgtcacccagactggcctcgaactcctggcctccagcaatccacctgccttggcctcccgaagtgctgggatatacttagtgggcatgagccaccacaccggccaagataatcgagtttttcctgcaccttttgttgaaaactatcctctctgttttattgccttggccccctttttgaaaatcaactgactgtaaagatgagagtttatttctggactctcaattctattccattgttctttatgtttatcctaatttcaggaccagtctgtcttgattactatagcttggtggtaagttttgaaatcaagaagtgtaagttccaactttgttcttttcaagattattttggttattgtgtcgcttgcatttccatatgaattttaggatcagtttgttaatttcttttaagacgtcagctgagattttgacagagattactttgaatctgtagattcaccatctttttaaagcatttcagggctgggcgtggtggctcatacctgtaatcccagcactttgggaggccaaggcaggcagatcacgaggtcaggagatcaagaccatcctgactaacacagtgaaactccatctctattaaaaatacaaaaaattagcccggtgtggtggcgggcgcctgtagtcccagttactcgggaggctgaggcaggagaatggcgtgaacctgggaggcggagcttgcagtgagccgagattgtgccaccgcactccagccttggcaacagagtgagactcagtctcaaaaaagaaaaaaaaaaaagcctctgtattgggtaattgaaaatgtataacctagcaggacagtgaatttagagcatgtgttttgtgatcatctcacagagcttcatagccaactttcctatatcttctgtttccactttcccatctaataataggcttttggagtatttccaattatttttaatacagatgcaagctatcattgtcctcatttaaactacttgataaattcagcatattaagtcaacattttttgtgacattgtaatttgaaatttataacattttccaggtttaaatttggacttggcttttgaaatctctatatacatgtgagaaagtgagagaaatatataactatttaccagaaagcactcttaagtccttaggattttatagctagatatttacctagttccacagttttatctgtaaagcagatagatgtagctttcctaaggagggtaggaaagtgagtgtaggtggggactattaatgactggcctaaagtttggatcataggtcttaattttttttttttttttttttttttttttgagacagggtctcactctgtcacccaggctggagtgcagtgacgtgatctcggcccaaaatgcagcctctgcctcctacgatcaagcgattctcctgcctcagcctcccaagtagctgggactacaggcgcgtgccaccaggcctggctaatttttgtatttttagcagagacggggtttccccgtgttggccaggctggtctcgaactcctgatcacaggtgatctgcctgcctcaacctcccaaagtgctgggattacaggcgtgagccaccacgcctggcccatagatcctaattttaattttaagaaaccaataaaaagaaagaggggctgggcatcgtggctcatgcctgtaatcctagtgctttgggaggccaaggcaggagaattgcttgaggccaggagttaaagaccagcctaggcaacatagtgagaccctgtctctactaaaaataaaaattaaattcaattaaaaaaaaaacagatgaactagatggggtaaaaaaagatacatgaatacaggtctagtatcccttatctgaaatgcctgggaccagaattttctggacttacgatttggggatatttgcataatatatacgatttgagcactgaaaatttgaaatccagctgagcctggtggctcatgctggtaatcccagcaccttgggaggccaaggcaggcagattacctgaggtcgggagtttgaaaccagcctgaccaacatggagaaaccctgtctctactaaaaatacaaaattagctgggcgtggtggcgcatgcctgtaatcccagctacttcggaggctaaggcaggagaatcgcttgaacctgggaggcggaggttgcagtaagccaagatcgcgccattgcactccagcctgggcaacgagagcaaaacactatctcaaaaaagaaaaaaatgaaaatctgaaatccaaaatgttccagagagcattgcgtttgagcatgaccttttgagtgtcatgttgatactcaaaaagttttggatttgggagcatgtcagatttcagcttttcagattagggatgctcaacctgtatgagtttttaaaaagtccgttttgtgtattatattttggattagttcaggaaattactcttgaaaacaaagtattgtgatttatattggctttattgtaaaggagaatttcagtatagtttatcagcagaatcaatttttttaatataaactagtggttccagcctgggtccatgatagcagtaatggaagtccataacctattttcagtgtttcaaaaagacaaacagaaatttagatttagctctaataatattgcacaggtgaatgaaactgtcaaacatttttaccctgatctaaagttattttagctaagtacactaacattgtttatttttcgctggttagaatcattaattgacagttgtacgtgtctctgggaaaatgaattttaatcttagttttcctgtaaagcattataaaatacagggtccaagtaaaggttaaaaaaaaaatggaattattcagaggtgaatttgggaactactttttcaaaagtttttcttttccttactatagtctgcttttaaaacaactgtgacatgtcccctttttggtgacaattgcaagttcaggtgttaactgttgtttgacttgtgtctccagagattgccctcagtcccaataatcacgaagtgcacatctataagaagaacgggagccagtgggtgaaagctcatgaactcaaggagcacaacggacacatcacaggtaaaggaagatagccgtgagcttagtgtgatatttccaaatcaggcactcttccttttagataaagagcctaataaacccaggtggccataatttttttttttttttttttttttttgagaaggagtatcactctttcgcccaggctggactgcaatggcgcaatctcggctcactgcaacctccacctcccgggttcaagtaattttcctgcctcagcttcctgagtagctgggattacaggcacgcgccactatgcctggctaattttttttatttttagtagagataggtttcaccatgttggtcaagctggtctcgaacccctgacctcgtgatcctcctgcctcggcctcccaatgtgctgggattacaggagtgagctaccgcacctggcccgtaatatttaaagtcatgcagcacttactgaatttccttaaaattttaaagaaaatactataatgatcttagttgttaagtgcttcttgtggccccagctggtacccagcactctaccgttgctatggaaagcactgaacctaccctgaggactaaagagctaaaattaggagatgagacgtgaaattgaaagctagataacatgaaaatgtagacaacacgaaaacgtgcgccaaactatttccaagtgtcttccaaaagtttcctttgtgtttttagggtaaggaagactttccagaatattgagaagaacaaagtaatataataaacacccatatcagataatcgccaccagaattaccaactttttccctgtgccaggaagtaatttcttttcctgtatcaggaaacttaaggaaaaaggatgtaataataaggaatattattcttgatgatggtaaagtcacctctcaccagcagtcctattcctctcccctggaaggcagactataatttgctatgacaccattccagtccatttttaatacatttacatacatacatattcataaacaagcttaggccaagcacagtggcttacacctgtaatcccagcactttgggaggctgaggcgggaggatcgcttgaacccaggaatccaagactagcctgggcaacataatgagaccccccgttagcacggtgtggtggcatgcacctgtggtcccagctacttgtgaggctgaagtgggaggaccacttgagacaagatcaaggctgcagtgagctgtgatcacaccactgcactccagcctgggtgacacagcaagaccctcatctcaaaaaaaagaaaaaagagaaaacaatctttaggactattgactagtatttttttgaagctacataaatggcatgatactatgcatctccggcagcctgcttttgcattcatgattgtttctgagatccatctatgttgctgtctagatcaagtttattccttttaaccactctttagcattttatacctcatttatttactccttcctccactgaagaacatttaggttgtttcaatttttccatattacatgaaagtgctgaataggcatcccttgatttctgtacgtatgtgtgaatgtttgtagatggtagatgtgttaataccacagggtatgcatatctgcagtgcagtgttgccaggcctcatcagattgccatcattcccacctgtcctgtatgagagtgctcattttcccacaccccgccacatacttgagatgggaagactgaagaatgcatgaaaggttcatccattgcttctgtaagttgtattttcctgattcatggaaaagttgagatactttcagacgtgtattagccatgagagtttttcttccttgtgactgtcctgttcataaatcctgatcattttttcattgagtttttgtcttttttctgtttttgtttgtttgtttgtttgtttgtttgttttgagatggagtgtcattctgtcgtctaggctgaaatggagtggtacagtcttggctgactgcagcctctgccttccaggttcaagcaattctcccgcctcagcctcccgagttgctgggattacaggtgcctgccacaatgcccagctaatttttgtatttttagtagatgtgggatttcaccacattggacaggctggtctcaagctcctgacatcaagtgatctgcctgccttggcctcccaaagtgttgagattacaggtgtgacccttttttttcttttagacagggtcttggctctgttgcccagtcacccaggctagaaggatcatggctcactacagcctcaacctcttgggctcaagtgatcctcccatctcagcctccccaggagctggtactaaaggtgtgcgccagcacacccggctaatttttttgtaaagatagatttcaccatgtcgcccaggctgattttttattcttttagttggactctgcaattttacctctaatcacctaaaatactgataagcttagagatatccttacccaaatgagagaacttagcatgttttgctattctacatcctttacagaagttgtcctgcattcttcagcaataactcatggccacccttgctttgaccagtgatttataaataatgctcttgagcaccagtagctgagtatatttccaaagcagcaccaaagacagcgtttctatttttgttgctgttcctttcccacaatcttatttctattaggtttggcctattttcttaagttcctttgccagtggcctcatagcctaagaataagaatactcatattttaaattggaattttaggccgggtgcggtggctcacacctgtaatcccaacactttaggaggctgaggcgggtggatcacctgaggtcgggagtttgagaccaacctggccaacatggtgaaaccctgtctctactaaaaatacaaaaattagccgggtgtggtggcaagcacctgtaatcccagctactcaggaggctgagacatgagaatcgcttgaacccaggaggcagaggttgcggtgagctgagatggcgccactgcactccagcctggggtatacagcaagactctgtctccaaaaaataaaaaattaggctgggtgcagtggctcaagcctgtaatcccagccctttgggaggctgaggcgggctgatcacctgaggtcgggagttcgagaccagcgtgaccaacatggagaaaccccatttctactaaaaatacacaaaattagctgggcgtggtggcacatgcctgtaatcccagctactcaggaggctgaggcaggagaattgcttgaacctgggaggcggaggttacggtgagccgagattgtgccattgcacgccagcctggacaataagagcaaaactctgtctcaaaaaaaaaaaaaaaaaaaattaattggaattttagaatttaaaaggaaatacttttaaatgagaaaaggcaaagatgaaagaccaaagaaatcgccaaaaatgtgaaatatttagttatgtgtttttttccctctacttctcttttggggtcctttgaacttgggcctgttttctgtctagctgctcacatggcattttttagatctgaaataacttgttggaaaaatctaaatataactctggggcaggagatcaaggatcagacatattttctcagaaagatagtaattttaggggaaaaaaatattttctgaagcattctagaagaaaaaactagtccatactacaaagaaaagaagtgtggcaaacatcagggatatcagagttctgaggttttattcttttgtattaaatatttttaagaaacatgttttgttaccatggaaaattttaaacagatttttaaaaaagtggaatagtataatgagccttttatacccatcacctgcattccacgattatcgagtaacagccaatcttgttcttctcaattcactttctcctttcctgtactaatttgaagcacatcccagacattatattgtttcatatttcagtttgcatctctaaaagataatgatttttctttttaataataataaatattgatcaggcttacacctgtaatcccagtgctttgggaggctgaggcaggcagatcacttgagccctggagttcaagaccagcctgggcaacatggtgaaaccccatctctacaaaaaattagccaggcatggtggcttgcacctgtagtctcagctactcaggaggctgaggtaggaggatttcatgagcctgggaggttgaggctgcagtgagctatgatcacgccactgcactccagtctaggtgataaagtgagaccctgtctcaaaaaaaaaaatctaataaagaggacagcaagcaaaattatcttgtaatgaataaataaaataaacatcacttagaacacattctcatattttcttcccttcagtggtacaaaaaattgagctgatatttcatgtgggtaaatgaatgaataaactaaactcttcatactacttttttttttttttttttttttttgagacacagtctcgctgtgtcacccaggctggagtgcagtggtgcgatctcggctcactgtaagctccgcctcccgggttcacaccattctcctgcctcagcctcctaagtagctgggactacacgcgcctgtcaccacgcccggctaattttttccatttttaatagggacagggtttcaccgtgttagccaggatagtctcgatctcctaacctcgtgatccgcctgcctcggcctcccaaagagccaccgcgcccggcctaactcttcagtcactatgacttatgggtaattgaggctcagaggtatatttgtcttttttccatataaatgtcaagaatgctaattattaatttttagagagagatctgtaataaatatttattagtaatatttctgtactttttaatgtgaaattatatttatagaaaatacctcatcaaggccaggcactgtggctcatgcctataatcccagcactttggaggctgagacaggcagatcgcctgaagtcaggagttcgagaccagcctggtcaacatggtgaaaccccgtctctactaaaaatacaaaaattagccgggcatggtggcatctgcctgtaatcccagctactcgggaggctgaggcaggagaatcgcttgaacccgggaggcggaggttgcagtgagctgagatcgtgccattgtactccaccctgggctgcaagagtgaaactccatctcaaaaaaaaaaaagaaagaaaagaaaagaaaatacctcatcaataagtgttaaatgagtcatggtgaattttgctcttggtatataagaaactgaccttgagtcttggtatatgaaaaactgaccttgactttgggattcttcacagaggtaccagataagtaaagtctcatcaaataagaaaaataaaccttacattcagatacatatttaggtatcttcctggtttagatgcaaagaaacaaggattctttcacaggacctgcatcatgtagaaaaggttttcagtatggttcaactggcagtgactttcagaagaatatatgatgaatcacaatatatagttccccctctttacactaaagattatttttatttaccctgtatgctgttttagttgaatgccatgtagcagactgttggttaatatcatagaatgaggtgtgttaatgaatacagttattttcacacacacaaaaatctaataaagaggaaagaaagaagtaatgaatcttcagatctttagaagtcttagaaatgtgtgaatgggtggaaagaatggccccgtttagttttgtaaagtctgtaattataaaacagctcttctacatgacctcatagacaatcccgagtcccagacgctttgcagagaagcatccttgcctttccttgaggcggtgatcaggacatagatagtgggaaggatgtgcctgggaggaaggtcccaagaccacgtctcatcctggcatgccagtgccacccacctgcctgtgccgcagttgtttgtcattgactgggcaaagcagatgacccatgtctcacttgcaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgagtgacatctgaattttttctatccctctctatagaatttacatttgcactgctgtgtgagggctcaccataactccagtttttctcatccggagttgtgtggttttttctctgaaattctcgattctgtctgagcattttcccttctcatgtgcatgttaagttaaatcgcacgttttttatattaacatagagctattgtgtccatgttctgatcgcctaacttgtttcttctgcaagatgctattactgttctcactctatactgcgcaaattgctgttttcttactctcatttacaaataataacattgaaagagtctccgttccctgaggaatattttttctttttttttttttttcacaggatatctatgtaggattcctacagataacaatgttctttttttttttttttttttttttttttttgagacagagtcttactctgttgcccaggctggatggagcgcagtgacacgatcatggctcactgcaacgtccgccccctggttcaagcaattctcctgcctcagcctcctgagtagctgggattacagtcacctgccatcgtgcccggctaatttttgtagttttagtagagacaaggtttcaccatcttggccaggctggtcatgaactcctgacctcatgatccaccgcctcggcctcccaaagtgctgggattacaggcgtgagccaccacgcctggtcaatgttccttctttaaagcttatttgccaaccaaatctgtgtcttggtgtaatattttacttgtttaaactgttgaagtcaaaactcaccagaatcttagaagtctaatcagctattgcacattttttaaattacttcttgctgacccagtcaaaacacaggtttattttatggccaaaacttattttaactactccttcctgtttgttttgataaggaaacaattattctccagcctggccaagatggtgaaaccccatctctactaaaaatacaaaaattagccaggcacagtggcaggtacctgtaatcccacctacttgggaggaagcaggagaattacttgaactcggagggcagaggttgcagtgagccaagatcgtgccactgcactccagcctgggcggcaaagtgagattctatctcaaaaaaaaaaaaaattatttttctgtgtggcatgtgttcagcatgactggtaaatatccttcaacgtaaagttgtcatttactactaaactggcagtgtttgtgtttctactaaaaatagcagagtatacatgactctttgtagctgttttgttatttgtattctgctgaaattgaaagaaggggattatcatgttacctttgtaatttagtaaaacttcagaaattttattcttcaaaaagagattgggaatttgcggtaaaattgagttatgggccaggtacagtggctcatgcctgtaaccccagcactttgggaggccgaggcaggtggatcacctgaggtcaggagttcgagaccagcctgaccaacacggataaaccctgtctctactaaaaatacaaaaaaattaacggggtgtggtggtgcatgcctgtaatcccagctacctgggaggctgaggcaggagaatctcttgaacccagtaggcagaggttgcggtgagccgagatcacgccattgcactccagcctgggcatcaagagtgaaactccgtctcaaaaaaaaaaaaaaaaattgagttacgaatttgaaacatacatttttctttcaaatgtgaaatcaaggctaacaaaatgttacctgctagaaactatttggaagtttcattgtaatgagataggaaactaacttcattaatattctctcaaggctaaactttatgtcagctggtactccttgcaatcttacaaatttctacaggaaacttttcttccaagttaagcttcaacctcagtaattgtttacatttttattcgttgagaattagtgtcaagtataggtaaattggactttattatggtacaaggtattgtctttgaacaagctgtatgtttagggcagtttctcagctgtagaacaattatttcatatttcataggagtactttaaaacaacttctcagaagtttataattcagccatatgaactaattattttgcttgccatcttttccttaattaaaaaaattacattataaaggccaggcacggtagctcacgcctgcaatcccagcactttgcgaggccaaggcaggcggatcacgaagtcaagagttcgaaaccatcctggccaacatggagaaaccccatctctactaaaaatacaaaatattagccaggtgtggtggtgcatgcctataatcccagctacttgggagtctgaggcaggagaatcgcttgaaccagggaggtagaggttgcaatgagccgagaccatgccactgcactccagcctgggcaacagagcaagactctgtctcaaaaaatatgtatacattatgaaacaattcgaaatactgtctttttctccttttttagagactttgtgggggattttggttttttattttatttatttatttattttttgagacagggtttctctctgtcacccagtctggagtacagtggtacaaacacggctcactgcagtctccaactcctgggatccagcagtcttgccacttcagcctcccaagtagttgggactacaggtttgcaccaccacacctggctaattttttgattacttgtggagacaggttctcacttttcttgcccaggctgatctcaaattcctgtactcaagcaatccttctgctttggtcttccaaagtgctgggagtatagttgcaagcctctgcacctggctgtctttttcagaatgaacttcttcagacaggatactaagaaagtgattctgtagccaggcgtggtggctcatgcctgtaatcctagcactttgggaggctaaggcaggcagatcacctgagaccaggagtttgagaccagcctggccaacatggtgaaagctaatctcctctaaaattacaaaaattagccgggcgtggtggcgtgagcctataatcccagctatcgggaggctgaggcacaagaattgcttgaacacaggaggcagaggttgcagtgagctgacattgcgccactgcactccagcctggatgacagagtaagactctgtctcaaaaaaataaaaaataaataaataaaagaaagtgattcttgcttgaccccgggaggtggaggttgcggtgagctgagatcacgccattgcactccagcctggacaacaagagcgaaactccatctcaaaaaaaaaaaaaaaagaaagaaagtgattctatagaaaggtaatttagcattgaaggaaaggcattggctcaatatttagtctcccaactgttgagcaaccagacgtgattggtttttaaacagcagtttgggggcagaaatgaattagttaagccaaaatactgactggtcctagacataaatcatcttttttggatggtgctagcgaattagaggctaatccccaacatgaggttcttctaatttcttggttgtgatttttcagtgaaagaaattaaaaagaatttgcagattcgtggagacttgggaaggatattaagctgtcttacaaccccaaattcaccaaaaattcagcaaatcactgaatattcataataaaaattgaagtattttcaaacttcagtttttatctcagaggttaacgtcctatgtaatccgaaatctcacgaaaacataactgagttaatcaatatctatgcttactaatgaggactgctgaaaaccagctgttgtgctgagaacatcagggccaggagtggagaaggcctgttcatggttcttttcctttctgtcctttagcaatgcaccttgtcagctgggcgtagtggctcatgcctgtaatcccagcactttgggaggctgaggccggtagatcacttgagccccagagtttgagaccagcctgggcaacatggagaaatctcatctctacaaaaaatacaaaaattagccagtctcagatcataacctggtatcaaaaaaccttgtctctggcagaaggcctggtgaccgacagaagaacgttgaatgctctgttacttttctatagaatctttttttatagaaacctatctgaaaaagtttattctgaaaaaaataatattctgaattgttttataatttttttttaaattaaggaaaagtgtggcctacttaggtattttcacctgacatacatttgtaggtcatttggggatgctggttgagtggataaactgaaacagttttcccctctcataggtgggtgagcaagcacattaaaaagccgattcgctccacagtcctcagcttggattggcatcccaacaacgttttgctggcagcaggatcatgtgacttcaaatgcaggtgggaaccagtgagaactgataaacttgagccgtgcattcttcatccttcaacaaataattttaggttctctttctttgttttttgttttgttgtggttgttgttgttttgagacagggtctcactctcacccaggctggagtgcagtggcaccatcatagctcactgcagcctccaattcctgggctcaagcgatcctccagcctcagcctccagagtagttgggactacaggtatatgccaccacacctggctaatttttttaaaattgtctttattctttgtagagacggggtcttgctacattgcccaggttggtcttgaactcctggcctcaagtgatcctccctccttggcctcctgaagtgctgggattacaggcatgagccagtgtgcctggcctgtaagtttccttttctttgcaaggtactgcgctaggcactgtgagggactcaaaaatgaggcctggtgctgtggctcacacctgtaatcccagcactttgggaggctgaggtgggcggatcacctgaggttggaagttcaagaccaacttggccaacatggtgaaaccccgtgtctactaaaaatacaaaagaggccgggcgcagtagctcacgcccgtaatcccagcactttgggaggctgaggtgggcggatcacaaggtcaggagatcgagaccatcctggctaacacagtgaaaccccgtctctactaaaaaaatacaaaaaattagccgggcgtggtggcgggtgcctgtagtcccagctactcgggaggctgaggcaggagaatggtgtgaactcgggaggcggagcttgcagtgagccgagatcacaccactgcactccagcctgggcgacagagcgagactctgtctcaaaataaataaataaataaaagttagcctggtgtggtcacaaatgcctgtaatcccagctacttgggaggctagggcatgagaatcatttgaaccggggaggtggaggttgcagtgagctgaaatcacaccactgcactccagcctgggcgacagagtaagactccatctcaaaaaacaaacaaaaacaaaacaaaaaaatggaagcagtttgtgatccagaaaaggagctcaagcatggtgattaaaagaacaagttcataagtcactgaggtaaaaagaaatccacttggaagtggggtaggagggagaggcaagggtggggccagcgaagatttccttaagtgtaagaatatctatggtttagaggggaggattagcatgtactctctctgtctctgtctctgtctctttcttaccatctctttctgtgtctccctttctccctgtctttcttgacaacagtatttttctcatttcatattccaggcagcagtctctgcaaattccaaagtgaaacaattaataaaacatagctaaacagtgcgctgctaagctgttattgtgctgttctttcagttaaagctttttattttgtcattagcttgaagctagaagaaatgcagccactttgctaagaactttaaggatcataccatggaattccatgtaattgctttttaaagttgttctttctcaagaatatgcttttttccctttagctgaaaggaaagcaaagcaaataaatgttgctttgtgttgactatatggtaggttgggagatgaggtgcacttttttttttttttttttttttttttttttttgagacaaggtcttgctctgtcacccaggctggagtgtggtggtgcgatcatagctccctgcagcttcgacctcccggactcaagcaatcctcccacctcagtctcctgagtagctgggaccacaggcatgagccaccatgcctggctgattttgtttattttttgtagagatggggtctcactatgttgcccaggctggtctcaaactcctgggctcaaagaatccttctgccttggcctcccaaagtgctgggcttacagggatgagccactacactcagctgggatacactttcttcagtaactgtggagaattcccagaaaaccaggctagtggtttatatccaggaatactcaaagcttaaaaaaaaaagagagagagatgtgtttgagtttggcggagaggatggaggtcatgggagtgtcaaggcactttatattctggacctgtgttacttgtgatttcttaaccagagtcattggaaaatagaactaggtggcactaacccacaccacctggattctttgatggttgtgaaaataggttgcagttattttgttaatattaatttcccctagtttctctgtcacaaaagctggagtgcagtggtgtgatcctggctcactgcaacctctgcctcccaggttcaagtgattctcatgcctcagcctcccaagcagctgggattgcaggcgtacaccaccatgcctggctaatttttttttttgtattttagtagagacagggtttcaccatattggccaggctggtctcaaactcctggcctcgagctatccacctgcctcggcctcccaaagtgctggggttacaggcatgagccactgcgcctggcccagtcctgtgggtatgggtctgtcccatttgtgttcctgagttggtggctgagagccactggttctttcttggccttctaagactaaagcagccgctgtcatgatgcagatttaaagcacagtgtttctactgtctcgtcatataacctcacataactcacagtcctctgccaggcatcttccagagcctctgtactgccattgtcatttggggtggtaggggggatacctcggttcttttagggagcctttaggttcagcagttttttggagagaagaaggtgtacaaagtagaaatcacattggagggcgaaagggccctaaagggtagatttccagccgttcccctttgcccttaactctgggccagaacatcctcaaacacagctgtgtggaattagataaaagagtgagttagtggaaacgggcgacaccacctataaaggacctgcctccatcttaagctattcctgccacagagactggacagtgggcctgagggtccagggagcctgcccaccccttgtcaccagcctcccttggctttctcttggggtatgtctttaaaagggtcaacaccattagtttgttgcagggtggcaaatagtttctgctctcccaccattgactgcgcaggcttcctggagtactgtgttgagaatgatggtaaggtagacaggaaagaatgctgtggccatttagcaaggtctcatgtgggcaagggagggatgggacagcaagatctccccagaatgtgcagtccatgaggacaggtcttttgtgatcactacttcagaacctggcacccacagcctgacacacagtaggtgctttgatagtatctagagtatggattagctaggcgcagtggcacacatctgtaatcccagcactttgggaggctgaggcaggagtattacctgatcccaggagttcgagaccagcctgggcaacacagcaagaccccatctctacaaaaaattttaaaatattagctgggcataatacgaacttgtagtcccagctactcgagaggctgaggcaggaggatcacttgagcccagaagttggctgcagtgagctttgatcacaccactacactccatcccgggcaacagagccagacccccgtctcttaaaaaaaaaaaaaaagttggagcgggggatcaggtgtggtggctcatgcctgtaatcccagcactttgggaggccaaggcaggtggatcacctgaggtcaggagttcaagaccagcctggtcaacatggtgaaaccccatctctactaaaaatacaaaattagccaggcatggtggcacatgcctgtaatcccagctacttgggaggctgaggcaggagaatctcttgaacccaggaggcggaggttgtggtgagccaggatcatgccattgcactccagcctgggcaacaagagcaagactctgtcccccaaaaatatatatatatatactagaatatggatttgccaaacttgggttggcctgtagatagctctaacaataattctgttacttgagaggtttgaatatctggacttacctatcatgatttattattttagtttagtttagtttagtttatgttatgttatgttatgttatgttatgttatgttatgttatgttatgttatgttattttagagacggtgtctcgctctgttgcccagcctggagtgcagtggcgcaatctcagctcactgcaagctgtgcctcctgggttcacgccattctcttgcctcagcctccggagtagctgggactacaggcgcctgccaccacacccggctaattttctgtatttttcgtagagatggggtttcaccgtattagccaggatggtctcgatctcctgacctcatgatcctcccgccttggcctcccaaagtgctgggattacaggcatgagccaccgcacccagccttatttatttatttatttatttatttatttatttattgagaaggagtttctctcttgttgcccaggctggagtgcagtggcgtgatctcggctcactgcaacctctacctcctgggtttacgcgattctcctgactcagcctcctgagtagttgggattacaggcatgcgcccccacgcttggctaattttgtgtatttttagtagagacggggtttctccatgttggtcaggctggtctcgaactcccgacctcaggtgatccacccacctaggcctcccaaagtgctaggattacaggcttgagccaccgtgcccagctcatgttttatttttttttaatgagtcaacctctttgcattctgagattccttgtggcagctgcctatggcctgtttctatatacatatattttcatttgctttttccttttctctctgccctttaaacagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcagtgagtatttgcctttcatttggaaggtggggaacaaggggtgggatctctcaccagctgaaccaggactgcccttcctggggtgttagcacagggcacaaacataaaaaccttaatcaggccaggcgtggtggctcacgcctgtaatcccagcactttgggaggccgaggtgggtggatcacaaggtcagcagttcaagaccagcctggccaagatggtgaaaccctgtctctactaaaaataaaaaaaattatccaggtgtggtggtaggcgcctgtactcccagctactcggaaggctgaggcagagaattgcttgaacctgggaggcagaggttgtagtgagccaagatcatgccactgtactccagcctgggcgacagagtaagactccgtctcaaaaaaaaaaaaaaaaaaaaaacacctcaatgaaaactgcaggcaggcaggcctcagtggctcacgcctataatcctagcactttgagaggctgtgggcagatcacctgaggtcaagagttcaagaccagcctggccaacatggtgaaaccccgtctctactaaaaacacaaaaattagccctgctgggcacagtggctcacacctgtaatcccagtactttggtaggccatgggtggatcacctgaggtcaggagttcaaggccagcctggccaacatggtgaaaccctgtctctaataaaaatacaaaaattagccgcagtggctcacacctgtaatcccagcactttgggaggctgaggcgggcggatcacttgaggtcgggagtttgagaccagcctgactaacatggagaaaccccatctctactaaaaatacagaaaattagctggacgtggtggcacatgcctgtaatcccagctactcaggaggctgagtcaggagaattgcttgaacctgggaggcggaggttgcagtgagccaagattgcaccactgtactccagcctgggcaacaaatgcagaactccgtctcaaaaaaaaaaaaaaaaaatcagcccggcatagtggcatatgcctgtaatcccagctactcgggaggctgaggctagagaatctctggaacccaagaaacagaggttgcggtgagccgagattgtgccattgcactccagcctgggcaacaagagcaaaactatgtctcaaaaaaaaaactgcaagtcagcttttaccgtgacaggcacagacacaaattctccggttggaaaattttaaagacctaggtcttccagaaatacttcttaatggaagtactgataatgattcctttcaagaaccctcctggttggctactgataagggtcacttaaaaagggccagtttaagctgggcacagtggctcacacctataatcccagcactttgggaggccaaggtgggtggatcacttgaggtcaggagttcgagagcagcctggccaacatggtgaaaccctgtctctacaaaaatacaaaaattagcccagcatggtggcgggtgcctatagtcccagctactcgggaggctgaggaaggagaatcacttgaacccaggaggtgaaggttgcagtgaaccgagatcatgccattgcactccagcctgggcaacagagcaagactccatctcaaaaaaaaaaaggctagtttagtctgttactctgaattccttacaaaatgtaagtgccgttcaccggccttaaattaaataggagatatattcttactgggggaagtcagcgaacgatgacttcattaatttgagccttccattcagtaaggcttaaaaagcattgatgccacttctctgctgtggctggaaggactcgaattacggtggcttctttgtgagtggcgtgtctgttcagccataaagtacttggccagacatcagagttcattttgttcagtatatgttggaggaagagagaagattggaatccttcttcttttataaatctttgttcttccctggtgttccttttccattgatagctaaagggaactcaccattaaaggttttgtgatggacatggccacttgggtatcaaaaatcaatcacactgggtgacctttactccctgtcaggtcagtaagagtcacccagtgtaaacagcatgatatttcagacatgatatgtttttcctaacaggattaaatgtgcattttttagctagttttacatatttttttaaagattatcccctcaggccgggtgcagtggctcacgcctgtaatcccagcactttgggaggccgaggcgggtggatcacctcaggtaaggagttcgagaccagcatggccaacatggagaaaccccgcctctactaaaagtataaaaattagccaggtgtggtggcatgcacctgtaatcccagctactcaggaggctgaggcaggagaattgcttgaacccagcaggcagaggttgcaatgagccaagatcgcaccactgcactccagcctgggcaacaagaggaagactctgtctcaaaaaaaaaaaaaagactgggcacagtggctcacacctgtaatcccagcactttgggaggccgaggcgggcggatcacaaggtcaggagatcgagaccatcctggctaacacggtgaaaccctgtctctacaaaaaatacaaaaattagccaggcgtggtggcgggcgcttgtagtcccagctactcgggaggctgaggcaggagaatggcgtgaacctgggaggcaaagcttgcagtgagccgagattgcgccactgcactctaggctgggcgacagagcgagactccatctcaaaaaaaagaaagaaaaaaagaaagattgtcccttccattataaaatgtagtctttcagaagatttccctacataaacaggcacttatatatcttttcatttttaacagaaataagattattttatacatttttatatacatttggtaatttgccttttaatacttgataatacttttgtattttgatgccagtgttacttgatttttatatggtttattgtgacacagtaagttcttagcatacacttattacaagtccctgtctaccctcgtactgacttctttcccttttccagtcctgcaagtcagattacatgctccacctttccactcctccaacataaatatctcatgtagtaaaagtcaggtataccgcactaagggcttaagatgacacattagttcttcaattcaatgccaactttatgaagggtgtcctgagacatatacagttagcttttttttattttttaatttagagagacactctctgtcgcccaggctggaactcctgagctcaagttctcctcccacctcagcctctcaagcagctggagccacagacgtgcaccaccactctaggctaatttttttttttttttaatttttcgtagagactgggtctcactatgttgtccaggctgatctcaaactcctgcctccagcaatccttccacctcagcccctcaaagtgctgagattacaggtgtgagccaccatgcccagccacagtcagcttttgaatgcatcgtttcttgcatgaagtgaggtgctcctaactcatcagccagtgtgtctgcctgccatatctgtgtaatctctttgccacattcaagagcaaataactacatgcacacacatgtccctgcaggcacacatacacacacatggcccattcgagtgtgagctcctggctaagaccgtttggttcatcttggtagctctagctcctaacacagtgcctggccgtcagcacagatctgtgtggtcacagccctctcggagctccggtgagcacaggcaaggagaaggtcctagcacaggtgtctgctgccaagtcatagtaacaggaagagctctaggagctaagagcagggagaagccactttaggcggaagtggcccgggaaagtggaccgtgggatcatgggggtgatccctttagagctgtgctgggggtggaagggcgtgatgcaaagactgggctttgggaaccagtttgtcgtcagtgggcagggcctcagaaggaggcagagccggaacccagggctgcccctgtcttgagaggcctgcaagttgaggtcaggggctccttttcaacataagtgcccattgatactgcagaagcccctgtgagaatgggtcctttgtgatcatctgtgtctgtaaagaagctaatagtctgttgcatcttgggataacacatgttcttgtgttcagggtctcgactctgaagacagagttcctgccgctcctaagtgtgtcatttgtctcagagaacagcgtcgtggctgctgtgagtatttttcttcattctccctcggggtgcactgtatgtgatgctcagacagggaacaatgtgtgctctgtcaccctagcacaaagcagaacagttttttagaagaaacagagctcacttttttttttttttttttttttgagatggagttttgctcttgttgcccaggctggagtgcaatgggtgatcttgactcaccgcaacctctgcctcccgggttcaagcgattctcccgcctcagcctctcgaggaactgggaatataggcatgcgccaccatacctggctaattttgtatttttagaagagacggggtttctccatgttggtcaggccggtctcgaactcccatcctcaggtgatccacccaccttggcctcccaaagtgcgggcatgagccaccgtgcccggcctcagaggtcactttttttttggagactgtcttgctctgtcgcccaggctggagggcagtggcgcaattttggctcactgcaagctccgcctcccgggttcacgccattctcctgcctcagcgtcctgagtagctgggactacaggcgcccgccacctcgccgggctaattttttttatttttagtagagatggggtttcaccatgttagccaggatggtctcaatctcctgacctcgtgatccgcccaccttggcctcctaaagtgctgggattacaggtgtgagccaccgtgcccggccgctcacttttaagagtaagagggggtggggcacgatggctcacgcctgtagtcccagcactttgggaggccaaggcgggtggttcacttgaggtcaggagttcaagaccagcctggccaacatggtgaaaccccgtctctactaaaaacacaaaaattagccaggcatggtggcagacgcctgtaatcccagctacttgggaggctgaggcaggagaattacttgaacccgggaagcagaggttgtggtgacctgagattgtgccactgcactctagccagggcaacagagcaagactcggtctcaaaaaaaaaaaaaaaaaagagtaagagaggcctgtcgtggtgaacactctgccaaggaggtgggcggtgggcagtgcatcctccagggactgactgagtcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtaggtgccgtctgtagagaggtggtcaggtgacaaggtgccttcctgcccctcgctgtttccttactgggttcctacaaaagctctatgcccctcaggcccagacattctttcagggacaagtgcagcaagaagtctgtatcttcccgaccgccaggctctcatttccagctcgtggtagggagggagtcgccaccacctggtcattctgtccttcaaggtgcagattacaaggcagcagccagcaggagcagtgcagaccttgttgcaatctgaggtggtggggcctcagggcagctgcttcctagggtaccctttctcagctactcgagaacaaaaggagacattcctgaatgctgcgttcccacagtagtgcacacataacagaaagcgaagttacagcctgttggaaaaggtaactgtagctgtcgtttcaagtaatggatacaaataagaagattatttaattaaaggaacagaatttcttatcatcatgatgacaaagctgaggagtgtctcgactgggttttcatcaggtatatgtaattatgtaagacaacagaattgtgttttgtccagaaagtttaatttttttttttttttttgagacagagtctcactctgttgcccaggctggagtgcaatgccacaatctcggctcactgcaacctctgcctcccgggttcaagcaattctcctgcctcagcttcccaagaagctgggattacaggcgtgtgccaccacacctggctaattttttgtatttttagtagagacggagtttcaccctgttggccatcctggtttcaaactcctgacctcaggtgatccaaccacctcagcctcccaaattgctggaattacaggcgtaagctaccgtgcctggcctgaaagtttgatttttaaggtctagaggagaggctgggcatgatggcttacacctttaatcccagcactttgggaggctgaggcaggcagatcacttgaggtcaggagttcgagaccagccttgccaacatggcaaaaccccatctctactaaaaaatacaaaaattagcttggcatggtggtacacacctgtaatcccagctactcggcaggctgaggcaggagaattgcttgaaccgggcaggtggaggttgcagtgagccaagattgagctactgcactcccgcctgggtgacagagtgagactccgtctcaaaaaaaaaaaaaaaaaaaggcacctggaggagaaatatatgcttgatattctaaattactgtgttcagagttgggtcccatgggattttcccttactgagaagccttttatgtttagaatcttattgtggtattgatggtgggagaagtaatggaaacctctagacttcctgtttgagagaattacaatgaaatgcaggttgtgcttcatcttcagcggagaaggggcagctgtatataaaataggctgcaaatgctgtattgaaaaatgagaaccagagacctggcaccatgtctcacacctgtaatgctagcgttttgggaagccaaggcaggaggatcacttgaggccagcagttcaataccatcctgggcaacacagcaagaccccatctctacaaaaaaatttttaagttagctggctgtgttggcacgcacctgtagtcccagctacttgggaggagtgagctgtgattgtgccactgtacttcagcctgggctacattgtgagatcctatctcaaaaaaaaaaaaaaaaaagaacctgaaggcatagcaaaacttaccttttctccacattcttcaggtttctccttctatagcaaaactcaccttttctccattctttaggtttctctgtcttgaatggctccgagttacttcttgtgagtttctcttacgtttctatacagaccaagtgttaaggaaagaaaaagctctcattgcctctctgacacttctagatgaaaaatgaaaagaacaaacccttgctgattagtctacttttatttgcagaaattaggtgctctttgcactagaactgtgtcagctaactttttctgtaaaggaccagatagtaaatattttagactcctagaggccataggtctctgttgcaactactgaactctggttgtggcaggaaagcaggcacagatgatgtaaacagatgaggtggctgtgttcccgtcaaactttatggacactcaaatttgaatttcatgtaattttcacttcatgaaataatagtctccttttaatttttttccagctatttaaaaacgtaaaagccgggtcaggtgcagaggctcacgcctgtaatcccagcactttgggaggctggggtgggcggatcacttgaggtcaggtggtcaagaccagcctgaccaacatggcaaaaccccgtctctattaaaaatacaaaaattcgccagcctggtggcaggtgcttgtaatcccagctactcgggagtctgaggcaggagaatcgcttgaacctgggaggtagaggttgcagtgagccgagatcgcaccactgcactccagcctgagtgacagagtgagactccatctcaataaataaataaataaaataaaaatgtaaaaccccgcccccctttttttttttttttttgagatggagtctctgtcacccaggctggagtgcagtggcacgatcttggcttactgcaagctctgcctcctgggttcacgcccttctcctgcctcagcctcccaagtagctgggactacaggcgcccgccaccatgcctggctaattttttttttttttttgtatcttttagtagagacagagtttcactgtgttagtcaggatggtctcgatctcctgacctcgtgatctgcccacctcggcctcccagagtgctgggattacaggcgtgagccactgcacctggcctttgttgttttttttttttatttaagctcacaggctgtacgggcataggcagtgtgtgccatagtttgccatccccttcccagcgtcggggaagaggcgggtaagttctagacatctcaaaggagaaagaaaaatattgtctgagcaatggatgattgtcttgaaagcttccagataattaggctaagacaagttgtttcatttatctgttcccctgcttagcttggtcggaatctagtggtgtgtctgctgctaacatttatgatgattcacttcagactcaaggagggctgttggcttatctgcactggctgtcttggaggctgatttgagaggttttgtttggagctatggaattcagtcatgcttcatcatgcctctggtttatttaaaaacaaacaaaaatactgttttcgccatggctgtggtcctacccacaacctgctcccagcatttgagtgctgtgtgggctgggtcattcctgcttccccaggtcacgctaaccaaggcaagttcttaacttctccccttgccagttttgtctttcctggacatctggtaataatatgctttggggtattttctgagccagattgttgcagcctaatgttcatggataagttcataatcaggagttaaaagataattcatttcctggtggagcgtggtggcttatgcctgtaatcccagcattttgggagactgaggcaggaggatcacttgagcccaggagttcaagaccagcttgggcaacataatgagacccgcatcccagctctatttaaaaaataaagaagaagataattcatttccttaagctgcccttacactattagtcaggaatgtttgtgttcacttccactacataccttacgatctcttttgctttgctttttttcagtcaagtctctatttatgaggtggacaagcaagattgtcgcaaattttgcactactggcatcgatggagccatgacaatttgggatttcaaggtattttctacctaacagaacaaattttgtttgtgttaaaacttttttttttttttttaagagataggctccttctctgtcacccaggttggagtaagtggcacaatcatggctcactgcagccaccaactccttgcctccagcagccctcccacctcagcctcccaagctgctgggacagcaggcatgcaccaccatgctccgtgaatatttttacaaaactcttatgagaagaatgtttctcatttcttgaaacaaaatgttaaatctagtatacagtttaatgtcctaatgtaagacattaaactggaaatctctcatttttttttctttctttttgagatggagtcttgttctgtcacccaggctgcagtgcagcggtgcaatattggctcactgcaacctccgcctcccgggttggagcgattctcctgcctcagtctcccaagtagttgggattacaggagcacactacaacacccggctatgttttgtatttttagtacagacggggtttcaccatgttggccaagctggtcttgaactcctggcctcatgtgatctgcccaccttggcctcccaaagtggtgggattacaggcgtgagccaccatgccagccttggagatctctctctttttttttttttttttttttgagacagagtttcgctcttgttgcccaggctggagtgcaatggcagaatctcggctcaccacaacctccgcctctggggttcaagcgattctcctgcctcagcctcccaagtagctgggattacagacatgtgccaccacgcccagctaattttgtgtttttagtagagatggggtttctccacgttggacatgctggtctcgaactcccaacctcaggtgatccacccgcctcagcctccccaagtgccaggattacaggcgtgagccactgcgcccagccagagatctctttaaaacctaaaagtcatccgcagaagaacggcacattctcagtgaactggaatttttacttctagatgtccatttattcattgaggaaaaatggagtgctgttttggaaacaggccctattggacaccagcccaggtttaactatatagatatatatttatagctgacactaattaatttaataaacatttagtacatatctcctgggtgccatgcatgatgctgagcactgagaatatccaatctgaatgagcctgtctggtagaagagagaggtggatacgggggctgggtaggggattcggcagagctcagaagagaagccagtgcctctgttttcacacagaggaatctagggggatgcgtggactgcagggaacaggttgcacctgagcggcatcctgagttgcgatgggttttggagggagggactgtgagttgagaagacacaggcgagcatcctcggctgcaagtgcagcacacccagggcagccctgggcttcagagagcgcacactgcctctgaggcgctgcccgtgctgtggtcctccggaagcacagatggagctagaaaaaagagctctaggtagccaggcgcagtggctcatgcctgtcttcccagcactttgggaggccgaggtgggagaatcgcttgaggccaggagttttgagaccagtttgggcaacatagcgtgaccccatctctataaaaaagccaggtgcagccaggcgcactgacccactcctgtaatcccagcactttgggaagctgaggctcgtttctcctcactgctttcctgtcttgagcacaggagttcgagaccagcctgggcaacacagtgagatcctgtctctatttaaaaatatacatatatatatttttaaaaaccaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaagaggagtgaggagtgtgcccagagcctgtgtgtgtggcagtggggaaaaggcacacctggcctggaggagccagcagggggagccccggcctggagtgtctctgcggggtgagtcctgggagatcctgtttcaggtggggcagggccaggttcagggtggggacaggcagaaccttccctgaggaagagggagtggtgtcatacctacctcggggtagacactcctcagtgacatcagtgctcttcccaccttttccaagaccctcgagtcttccatccagggcctccggataatgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtggtt

SEQ ID NO: 35722 - DNA, 31579 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtatgcacagctctggacctgccgtggtttcgccatgttgctttgcaaactccctttggaaaggctgggaaacgtcgcccgcttaccctcgcaccccattatcccggccaccccacttctaatcgtgccctctcccccaccccccacctcacgaagattacttacagtttggttttccagcttcctcggtgcggagatttgggtggggtaggaagggggggagggggtgtgtgtaggggggataccgggtcacccctgaaggagaggtgggagccccccgtgcctctttccagggctctctgctcccgtctttcccctcgctcgtcaccgcgttccctagtttctgtccttgtgggccgcagccggacactcccgccgcggcgctcaccccttcaagtttcctcccgggatccaaagccccaggggtcggaatacagacctttctggcacccgaaacctctgtttcgggaagcctggctcttctttggggttttcacgccaaaagggcttttctaggatatttcctcgatttttaattattttttgaaaccatccccccctgctccgactccagctgccgaggctgcggcgctcttcctcctctcctccctccccctctcttccccacctctcctcacccgcccccccaaaagcggcccctgggccgcagggacccccccagacattttttccaattgtcgggaatgatagaggaggatctggggatccggatgagaccaagaagtggacccccggagcctccagaatatttttattgattttttgaaaagatgacgaaatccaaaaaagagtgagtgagttagagtgcgcgaaggagtagccaaagggagcgtcgcggagctgccgcggctgctgcgcacttctccgactccccgttttggagctgtagttcacccccttttataggatccctgggaataccaaagcactgatgggctattctgattcactccagtttcctcatctttgttctttattcttatcacgcattctggtcccctccccctcccacaaaaaaaaattaattttttttgtttcgatagattacgcttttttattctttttctcttttgctgatgctatgctctccacccccgccccccaaccctttcccactcccattataggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggtaatgaccggccccttcctcccttcctttctgcgattcccgctttcccctggccaacaatatgccttctatcaccactgccagagcaaattcttgggatccagaatgaccccaccaatagaatttacccacttatgggcgatagctcatttaataggaaaccactgtttattttttgtgtgttcctactatgtgcccaggctccgtgcccagcactgaggctacatctgtgaataagatcctcatggagatttgggttggtgagactcatttgcaattgtgtatgcatgtgtgtaggggacgcatggaatattttaattaacagtgataatattttaattaaattccaaatttccaaaaatagtctgagaacgtgttcacatgataggtatgtggctgtggtgtctcctaaaaacttggagttcaaaggtaatgccctctatatctacaaagtctcaagataccaacacataatagctgttcactaaatatcagttcattgacttttgagcaaagtcaaaatgtggcctttcactgaaggagtccgaggcctgggttcctacctccagtgggactgtgacctctgtacaaccccagggatcctgtcttatctctgcttttctaccagggaacctttttcccacctgatctaactccttttccctgcagcttgacatataagacgaccatattgcagctgtaccgcatggaatagcggctccaaggcccaccttcggtggtttgcacacccctctttgcactgttcagaaaagcaccccctccttcccgcccctccccctcctcactggtagggcccgcacaaagtccacagggctgaggctggcttcttgaactgagctctttgtgaggagccttcctttctggggctctgctgccatctagtggaagacatgcacaaggttgggggaggaattgccgagaatgtggagaggggcctgaatgacttcacctttgaaccgctgccaggttttagctgcttctggtttggtccgagaggcctagaaaggtgctttcttctgggagatctgcttcctttaataacggtgcaagaccagtggttcgtactcgcattaccctgtgaagaggaagggctggcatttcaagccatctttgaagatgatggtggtttagtagtttattggggtgctttaccccggctgtacacagaaagccaaggcagattttaaagcttatgaagaaaacattgttagaattgggaaccaatttgtttttctcatgagagagcaggaaaaatcatcttcatatggttcatttgtttcgagaggatggtgaattgagatgttcttcaggacacccaaatctttccaggactagccaagcaatatattgctacaaacaaacttggctttttcctattccctttatcccagaagttgggatttggaagagtcctattttacaaatgagaaggctgaggcctgggagggaaagggaatcacccccagccccacagctgtgggactggtgctctggttgctggtttagcaaatgaaagagattccaggttctccaggtgaatgggagagagggtgcattggcaaacaggccctgcctctcattcttctgatgacagctcagtggataggcatattttctggtagcacatacgatatttttaatgttttattttggaccgtttccctttgagcacagtttcccgtaagtatctcagtgaaagagggaaacaaggttctttttcaggtgggttgctggtgagagacccaagagacagggttgtgtggtccccacacttgcactgagggatgctgtgacactgagcaggcaccctcaccttgccccagatcacctccatctgcaaaatgaggttgctaatgaccatgtggtcctttagtcatgatgacaatggcctgtgaaacatttaggggaaagggctgagtgtcacatccccagaatttctgcctgatatgtaaaaggggagtttgagcagcagagagataaaggcactttttggcactaagtaaaagcaagctaattggttgccaaggagttgggccaaggaaccttattttgagctttatctgtgtgcatcatttttccatgaagattaaaaagactattaattcggtgatagagacatatacaataaattaccatgaaagggccacaatgaccttggccgtatctcattgtaggttcagctttctgggtgggcgggaagcagtattgcctgcaagtcagggttgggagggggtaaggggagctggagtggaaacgaagtagaagaaaatagaatcttggcaacagctacctgggctctcattattttcagtggagcctgacatttgaagcataagaagagctgtcaacaacttcaaagcttcaggggcacattgacaaatgggcccgccttacaatctagcagccacgtcctaatgagcggccttaaaactggtctggagcccaacccccagccccctacaccaggtcagcctgtggaatttagattctcctcttctcttcctgccttcccctccaggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccggtaagatgaggcttgagccggggagggagatgggggagctcttttgggagatgtccggggagaggcaaaaggccgtaggaactttcattttagttcaggagtttggaggaggggtggtcttgagtagtctaaagtctgaagtttcattcctgggttgctttttctttatctgagctttatatattcgctttctctgctaaactcataaatggtttatgaggacaggtgtggttaaggcaaaaaaaattagtgcctgttaaaatattctttatgatggctaaagtgctctttgaagattacatatactgctcactggttgtgttcaaatctttaatcttttaaggaaaaggatggcttggagataagcccaagaggaaatctcgagggggatgggggcaaatacaggttaaaggaacaacgtcaagataaatatgctgcctgccttgattagtggtaagggagaccaaagaaattcttttttttttttttttactgtagggcatttatggccttctagctgtttgcttctctagctgtttgccccactgggcgcgggagggaacctggttggctttcggtgaggctttactttctgagcgctgggttctgatgccctcagttcatgtggaggtgttttgattttggccgcagcctttaacgttgcaattccgcctaccacgtggatcccacaattgatacatcattcctactggcccatttgttttgtagtttcctaataaaccaaaggcagtggtttgctgttgtcttattaaacagccttggccagtgtctactggttttttgtttttttttttcttggtagtggccatggcagagaccctggaaccttactcatccaagggagagatgtcaggagttcatgttttgacaatcagaaaccttaggtaaaaagctgatcacttgggaagacctttcggtgtgcttcacctcaaatttgccaagagtagttaaatcgctaggtggactcacgtggtaacttttttcaggatgttgttacatgttactggtgagttctacggaacggatgattatataacgtacgatgtagtgcatatgccctgtgctcacagtcaaaaagtcaggctttgctgcatatcagtgagtgacctttaattggctgcttaacctctctgaacccgagcttcttcatctccaaaacaagcctattgatacatcatcctacagccttttcagagcagctaggaaaattaaaatcagaaagaggtgatgcacgtggacgtgctttgtaaaccgaagtgtaggttggaccttcactaattgtgaaaatgctaccatctccgattttcaccctgattttaactgttccgactaaagtggatatgatggctttccttttctggctgcccttacgtgtttctagcaggacctgtgtgttctgcacttgcaggcttgagtgtggagtcctcccggccccctgcctgttcatctagggcacaggtttccccttgctggttttctgtagtcctgttctcctggatgcaggccaggcctcatggcgtgcacatgcgccctgtgccccttggtgggagagtccgttatccttcctgcagccctgggggcggttcttaggacccctgtggacccctgctgccttttggatagtggtcactctggcttccttcccttctgctgtctggcccgggcccgagaggtcagtcctccagtgacctgtcattttgtctcccaggctcggctgtctccttcctctctcatcatgattcactgtgggggaggggtcagccagttctttctctctggcccaaggacagctgacccccgaccctaaactcccccactgcccagctgttgatagccagagctctgctcaacactgtctcttgactaacagatcttttggggtctaactgccccttcctcctctctgatctctgattggggtaggggtgctgggtggagttaccggggtgtgggcagatccccagattccgtctagacccattctcgaaaaccggggatcccatcccccacccgtggccttcttgcccagatctttgggctggctgccagctccggggccagagtagggagcctgggattcagagactgaggacagaggcccagagggatacagaggcagttataaagactgtgttttgggggccttgaactagctttggtcagggactaggaaaggacacccccaaaccacatgaaaatggtgtgctaggcactaagcctcaggcgttgacagggcagagcacaggtaggtcctcggcagtttcctgggtctggaaaggaggggcctgtatcgaaagaagttgctttccctcatctgcacttgggtttgtgcaactgactgagtcacatagaatcctggctgcgtggagttttacaacagtcggcctcacagtacaaacaccgaaggccgcttttcttgaaggaaacaccttccatggagaggcgattgtgcattgtggggccagggtgtgatgaatgggcaaggacccaggactctggccagtagcgggcacagagtgactgagaggcagaggtaggagatgcagattccccaacccgagctgttgccctcacctgctcctcaaatcgcacacttccctccttttctcgcagtcctggatgttccgtcctggagctgatgaaacacctgcggccagggtctcggaggtccacagtgggtggagggtgggggtcccgagagatggccgccaaccctcaggccgtgcagctatttgatgggaaaagctggttgtgaaagagctggcagtggttctgcagtgtgtggggagcgtatttgtgtgtgaaaggggaagggagagcaggagaacatagaggggccgcgtaagtgtggcgaagtggcggtcttgctttatggggctctggattaagatggtggcaaggcggagaggagccctccttccttccctgctcagcctaaaatggcttctggaagagcaagggccgcaagctgctggtatccctctgcagcaggtcctgggcagtgcaggcatgggtgggttgggcgggggatcttcctgactacagctcctagcattcctgttcctggagtttccaaaactggggaagcagaactgagccatagcttccctggttgccgctctgctgatagaacacccaggtctgcaagcgaggaaagaaggccattggagatgacctgggttcgcactctggcactgggagattgttgagatgtgataccatgctcggtggatgattccagttagtctagcagagccaatggcattgagtttacacctggcaccgggtagggggaggtgctcaccctccctctccaggcacccacatcccctctttcttcactagaagcccaccctaagatgctgcaccttggtatttgtgccacacacggtagccacccccaggcctccccacgccaaggccagagccccattgttgactagaacccattgtgctgtcctagccccttccctggctttacctacaggtgttccctcagattccatcgccaagtgagagggagacagtggtggcccagagaagttcgatgacttggcccttgatctagagtgggagatttcgccttgatgggtgctgggaaggaagaatggaaacccgtctttccatctgcaagtctctgagctacccctgaagccgcgaggtcatgggactgagggggagtcgttagcatgccctgtggggacaagcagccaggcagtgtggtgcttgccatcgctcttccctctggctgtaagatgaatgggtagcaggctgctcatcgccctccaaccagccccctccccagctcctcccagcaggccttgcagttgcatgggcattcccttgccatggcagccctgccccacaaggacagggtatgctggtcctcttatgggggtggcagatgaggtgcgtgcccagtgacgtccctggcctgtgaacactctggttctggccctttgaacttccacctgactgcaggttggagaagagagatggggaaagcctgacctggccttccctttcttcttcagcgtcagagtgcgtatctctctccccctattggtgaacagaagcaaagccatcacccctgcaccccaagacctcggccaccatagccaaaatgatgggtgctaaatgtactgggcaggaccatgtattccgtggttttaaacttacttagctctgaactctttatttggtaaaatcctaccaagaagtgcagataccaagttgatgaaatggagcacttctcagggcccatgcccaggtgagggagcccagcgggacccccagaggctcccagggcatccttgggaggataagccttttgtgcttgctggtgccggggctgcggctgggacccaattcctttgattcctgagccagagcgccacctttggggctcttctcccacttccgacgtgaaaggctgccctgtcctcctgagtggtatatgggaggtgactttgaggagctggtcagcttccagtaagttacgaagagctctgcatccagagtctcaaagtctcatccggatcccaggcccaacactcacagtgagtgacatcagccagatcacttcatctcccaagacttcattgattcacctgtaaaaggagatgtttgaaacagatgaatttcaagctcctttttattaatacctcaccatcatcaccgccgtcataagcaagcatgcagcccacagcagagctgcccctggcgcctgtgggtccagctgggattcccctaaggtgtgtcctttgcctccaccattttgccaggagggaggcgggaatgtcgggtgttcctggttatctgggcatcgttccttggctcgggtgaactgcatctcaatgaattgtggaatgtgctgggttagagttgccaacttctctcttccattcgctgagtgttcatggggttcttttcattcccctgtggggctgcactttctcccagttctgcaaagcagcaggaggctttggggactcgatgatgtcatttctgggacacatacacaactggatagtgacagattctccaggaagcacagagccctcattcttcctggcctgcttggcctgctccctgcatctgcctgcaatccagggatgctgggcgcctttctcctcatccctccagacgctggagagcatctccagtcggaactccccaccacagtcctgcaggaagtactaggagtgagagcagaggaggggcaggttggggaggatgctggctgacattcattgcttaccttgaaccaggcactgtgcttttacaaggattattttaagtgaatcctcagaacagcactacaacgtgggtattgctgttgtcattatttgcagatcagaaaatgaaaactcagagaggtcaggtaacttgctcatcttcacacacttggtaggtggtgggatggagattccacctccttctgattccagagctaatactctgaaccagtgagctgtgttctccagaggtctgctttggttggaggggagctggagccctaggccctgggacggcctctgttgcccatggcaaggcgtgtggctgctcctgctctcttcagatctccagatgcagcaacctggagaaaggccctcctgggtctggtggggactggggcaggagtggaggctgcccaagctccgtgcactccacgttccagcttggagctttttgagtctactctccaaatccttcccatctccctgaagagtcttctgagaagtgtctcaaatgctcctcttcactcaagagcctcctttctttttttttttcttttctttttcttttttttttttgagacagtcttgctctgtcacccaggctggagtgcatggcacaatctctgctcactgcaacctccaactcccgggttcaagtgattctcttgcccaagcctccagaatagctgggattacaggcgcgtgccaccatgcctggctaatttttgtatttttagtacagacagggtttcaccgtgttggccagactggtctcgaacttcggacctcaggtcatctgcccacctcggcctcccaaagtgctaggattacactgtgagccactgcgcccagccttcaagagccccctttctttgagaagtttcttcagaagttatccatatagtagtacagacctagccattatagcacaccatcctctactatctaatgcattgatgcccagccttaagaagtctgaatattgtacgttttggggggagtcctccatgctgcctggaacagggaggagcacattgtcatgagtcgatcagaatggatcgctgatcggttcattgcctctctctctgctgcaggaggaaggatctcaggaagtcaccagcatctcacctctccaggtgggcaattaacgatggcgagggcacaccctcacccctgagcgtgccttctgcaccagcatattgcttgttggcatttttgatcaagagacttaacagactgctgagaaatttgtacctggtttttatttgttaaaataatattacgtacaaattttacaaactcatctgtgtttctcccacctaacagaacagcttttattttccgtgcatccttccagttcatccataggcatatatgtatgtatttacccatggttgtaatcttcatcgtcgcatgcatgcatgcaatttggttttccgcttccttcttctgagtggatattgtgaccatttctccatcctgtcatagcgacaaagctgatggtttccaggaatggctgcattgggtaggtggagctttccacagttgagggtgggggttggctaattacagctaggaagctagtgcacagatgaaatgatgtttgatttttttgtttttctctctgttcagtatcccctaccagtagagagggggatgtccttgagagtggtcctggggcagccctggtgccacggggaagtagcgccgctctgtggagagggctgctttgtgaatttgccggctggtagacaccgtgatccattctattgtctcctcattgttcttctccttgggagtcattcccattccagatcctcaagtaagagcaaagtagacctgtaaggcacctgggaggttatcctgcttactatctttaaactcttgacctaagccatgtaggaagaaacacattttataacacaactcaggatacttgtacaagtatatcaaactgatacaaaagtttctccgaacaatatttactcttaacgacatacggtgagcctgatactttctatcctactctatttggttaaaggagaacaacaacagaaagtgctggtcacgacccacaaatgcatttcatgacccattaatgagttgcagctagaagttagaaaaacacttatctcacccaacccgttattagacaaatgggaaaccaagcccttggaaagaggaagtgacttgcccacagtcccacgtctggacctagctggagggctgatgttgcctcagtatttgactaacctggaggagaggtggggcatgctcagggatcccgaggaagatgctcgtcttctgtgtagcgggcaacagagggcagcacggccgccgtcctcgtctccagcggcgtctctcctctggctgtgggaacacactgctcctttggtgccactctgagctgctgagaggcagtcaagttcatgcacatagtgctccccaattctgtgggattggacagtgtccccaagaggactcccctgaaaatcttcttagtaaaacaaaaagggaggtagagtctccctgtgcaaccggtgcacctgttccccctatgcctgctggcttccagaagttcattcgtatgccaataataagagttggttttgctagcagtgggacagcagagatgggcatgtgtgaggtgtgcttcccggtctgaggcctatggcagagggaagggagggccggggatacttgcctgcctcttccctggcagatgctcccacccgggcctttgtgggcccagggccatgggccggctgccccgcttgtgttatgaatgtcacaggggggagctaacgaggttattgggcagagaaacactctcctgtgacccatgtggaagagacctacagcagagcaagaggcagggaggctggctttgtcacactgttcatggcgacagagaaggcgtaggaggggcgggtggacagcaggcgtgggcgcagcaccattatatacgtccctcaagaggtggagatggtgagagggcaatggagaaaaagccaaggagacaggcagatggccaggtttgctctgcgttcatgatgggaggggagggctgtgcttggctcagggatccacggtgtctaacaatgctgctaacttgatgctggggcaatgggctgaccattaaaagagctgctgtagaaagtgtgtttgtaatagagtgtgtacaggaggaaggggaaataggagaggggctggtttttgtagatttaacctgattgtttttgctgtaagttgaagggtgacccacggttccctgtatgctgtgtctcctgcccccacgtgccccttccatgtctacacacagtaagctcactagagcaatgctaaaacgagaaagagtacgctttggaagacttgctgcactccaggaccgtcactagcgtgatggctgcaactatacccaccctaatatctgtcaacacgagcaggggcaacttaaactctcaaaagtctcagggttctcacccataccattagggtgacgctcgtgtgcatcttctgtggctgatgggtaaattaaacaggacgtaatgtgtagcgtactgcatgtggtggtcattggtagctgtcagcagctgtaacaggagaagttggctgtctttatttcccctcgatggaccaagcagctgctggatcatggccacccagcccctctgaaggagtgctcggaggaacacaagggggctggtcttccaagaggagccctctagcatggcagtggacggggttcaagcccctctgatttattatcctcattctgcacttccctgtagcaagtcacatttttttctcttagcaataaaatggggccttcagtctcatgagtcataacatcgaaaccgagtcacccatctgattcggatgcaatgattaatcttcagtgcttagttagagccctatgttagggttagaatcctctgccctaatgttctgagggttcttgctgttgggccagaggttgggaactgggtggaactcagcccccactcgcccactccctgcattgctgcttctctcatttccttttttagatcaaaccttttttttttttttttgggtgggggtcatattaatcctcaatgcctgtccagagactataacaagatcccatctgaattagcattatgcatagattttgcccgtttctcccatctccttgtactttccctccttctcacatctggagcccctggtctgtcctgcttgcatggcccatggggtaccttgtctgcactggtctcaggcattctctgctctgttcccaccatcacctctagaggagactatgactcgctcaccttgctccccccaccagggtcaagaatgttaactcagacatgcttaatatgactgggatctggggattggggaccttgaatcctctgtgcattcattgtgtgcgcttagataagctgtcttccttccctgcctcagtctccttcgtttaatctggaacagccatggtgatggcaaataaacacaggctccttgtgaaagaactcgagggaggacatgcctgtagggcacggggtcactcgcgccgctgacctgctgccgtcctgtttctgagtctctgcagtctcgggagctccaggatccaaattcgttctgtgccctgaccttctgcctctcattccttgcagactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggtaggtggccaccaccttcttggctaagtccagatgtctcttctcagctcagggaaggagacgacggatttgattatgttgtgtcagaggtatttttctggtttgtttcctaagatcgacatccaagggagtgcaaagttcagcaggtgacaccccctcttaaggttctgaaaagctgtgcacgggaaaatacggaagaaaactcagcaagcagatgaagggggtgggggtgggagggctgtttaccgatgttcctttatggcgtgggcttctcagtgggtctgaattgttgcttcattgccatatttgtacacgctgccaggctgcctctgcccggcagcgaagagctgccgtgtctgctttcacacgctgaggctgtaaggcgcacagaggagaaaggagagccaggactcagctgcagtggatggagcagacacacaagaggtgccccactgtgagaacggtgtccgtccctggcaaacctctcgacccctccccgctctctcttcccttttgttcaatgcagtaatggattacaaagtgctttcaaaagacaaagtgccatacaaactcaagaaactattattagctacggagcttccccattctgtgtgccctgtggacggcccagaggctgttaacttcctgttgccagaatttggagctcctgagaagaaaggttttgagagagaccagggtcaagtgagcctctgaattcaatcagcaggaagctgcagtcctagcccgtccgagacaggatggtgccaagaggtcagagaggccattccttcgttttccacgggcaggacagggactgaagtaaccagccaggagcggggtgggcagtggctgagctggggctagaacccccaggctccgactgccccctggaaacttcccactccacccttgttgccgctcctgggatcttttggtttgaaaaaaaaccctggggtttaaagtcaacctgagagaggggtgttggccctgagccctcatgcatcaccatggagaggctgaagaatgctgggcacttcacgatgacaccctctggatggtccggggggattcagatgccctctgcgggcttttattgagttaagggatcatgtggtttataggcctatggctgaggcctgcacgagggatacgggacaggttaaacctcagagagcccacggctgcagctcgccggcctcctcgcccgcccacctggattttccctggcatttgttcccagctcagagaaatggcgcagggagatgctgacggagcaaatccggggtcctcctctgagatagttcgtagatatggttttaaaatgcgggctccaaacatacgctttttaaacgaggactccagaacacagactgaaaacctccctccagtgcagcatgaagaatgcttttctaatcctccagaggaaaatcgtggacgggacttaacgtttatagaaatggtacgctttcctccttttctgaatgtctccaattaaggctgccttacaaataggactctcagccagtttaagacaagcccttcctcaatgcctggagacaaaaatgtcagtgacaggagttggaagcggccacccccctcctcctgcccccaggcattgtaaccttttcccccgatgttgatagacctgctctgatgggctgaccaccctaccggctccagccttttcccacctccctttgtcccccgttactgatctcacatggacagtggtggaaatttccctcctgggagttgctgctgagtctcttggcttttcgagaccgcaggcaagtcagtccgtcatctcatctggggaaactgtttgcctttttctgatactacgtagccagtccatttaagtcagctggccaactctgttaaatggatatgaagtgggtacgaagctggtttaggggtgtcctcctataaatcctaactgttggtcaagttgatacctcatttctataatgggcacacgccgtgtttcctaactggggctgcctgtgtgtgcctcattcacaccggtggacctgggttgaacatgttcatatttaaaaaccaagagtgaacgcggtgaaatgtacaattcataacactttttcaaagaaaaatctgagccctcaggaagttccaggcttacctctggcaccccggaggctggttcgctctccctgaaaatgtttttagtggaaaggttcaagcagctctgggctaggctgtgtgtgtgtgtgtgtgtgtgtgtgtttatgcacctttccaagtgctaaatctcctcccatccatcagcctgtgttctctgaaaagctgacgctcagagggaagaaaaataaaaggactagaatttagaacacattagtgtttggagggaggtgagttgtgcttcctgagctctgtttaccatttcacgagtcacgaagtggtgtatttccttcattcgtttctggaagtctttactgaaggcccagttgttgctagaagttggggtggatggtggcatctgggaaatagaggatgagattcctgccttcaaggaacttagcagttgtatgatgaagcaagagtaaagcgtgcaaaaccctagcaaattaagaacgtaaacaaaggtgtgctacgtaacgtgttacgaaccctaaatgcagtaggaaatcaacccaaaagaaggagctcatcaggcctaacgtagaatgccggcctcccagcagagaaaacttggtgatagaaactgttcttagagtagagaaacaaaatgtatgggcacgcaatggaatattattcaaccttaaaaagaaatgaaattccgatccatgttataacatgggcgaaccttgaaaatactatgttaagtgaaacgagccagacacaaaaagacaaatactgtatgattccacttataccaggtacctggaatagtcaaattcgtagagacagaaagtagaatagaggttcccaggagtctggggagaggagaggatggggagttagtgtttaatgcgtacggagtttcagtttgggatgatgaaaacaattctgtagatggagagttctgatggccacacagcagtgtgaatgtacttaatgccactgtacatttaaaagtggctgaaaagggaaatttgacattatgtgtatttatgatagtaaaatgtgtgtgtgtatatatgtatatacacacacatacataaatggatatatatatatgtatgtatgtatgtctgaaacattctcgggccacgctatgaaatgcccataggttgatgttgagctcttccctggaaaagtgaaatacacaggaccacattttgccccctggccctagtgcattgacaaacgggaatcaggaagagctgacagtttcccccagagcccctgaagttatatgtcagctcctacacaccttgctgtttctgatttcttcaagcttgcaatgctctctgttactttgggggttaggtcgtgggttgtcggggatcgagctgtggaaagagggtccccctgattcttgtgagatggccaggcgagtctctgtggttcattggccaggagcagatagctttgatatgagggacgcatgcggctctgagaaagtcggcctttgttgctccgtctggttgccaaaataaaccagaacgcttcattccaaagagaaagctgagtgaggggcctgacagttttatagggaataaacgtctcagagagtggtatattttaaatactttttccttccaatcgtaagagttgctaaaaacagccagagaggcagtttggctgtaggggggacgtctattgggggtgtccagtgcctgggtaggtttgagaggggagggtgccactggcctgggtccccggtgaccatggccctgcttccttgggctgaatcggggtcctcttccatcccctctgcacactagtcgggctgcgtgccagcattgatctcactgcttccttgtctatagaacctcttgaataaggcccagcttttcctcagctctttatccagagcccctggcagagtcattgggagtgatgcttaagagaggaagggaagaggaaggaaggagcaaaggacaaaggcaggcagatgggtttccagtgggtttccgattcactggtctgtccatgtcctttgaaaagctgtgtcttttctttaacttcaattctgtgtcagggccttccgagccttctgagttttccccaaccttatcttagagtaggttaaatgaagtggcttcattttcatatgacacagttgcacaaattcactaactaaaaaatggaatggaggctcacaggccataaaggtgttgtgaagttattgcaagatacttaacagaagaaagactctagtcatctgttccttatatttatccttttttgtctaagtcacatcaaaactctttgtcacattctttaaaaacaaaaagcaaaaaacaaaactttagattcaggggatccatgtgcggtttgttacgtggatatatcgtgtgatgctgaggtttgggcttcagtcgaacccgtcacccagacagtgtacacagtacccaatagggagtgtttcaactctcgtccctgtccctagacacattcttaaatattgcccagagaagattccaggatatcccttccttagggtcatcctggcattttacggtcctggttatcaatgagctattaaaaagcagggaggtggaggcgccgtggaagaagtctcagtttcgaccacatgtgtgtgattcatggggtttagcattgtgtgtttctgctccgtagctggaagtgccgccaccctcgccccacatgtcattttcaagcctccactgttacagattctgtcttctgtggactcttcagggcctgtggtcaggaaccttgtgaagtgttgctggaagctgggggtggggaggtggaatagaatcgggggctgatgcctccctctcctgcctcatttttctgtgggcctcatttggtatgcaaggaaataagccaaacagcctgtgaagaaaggaagaatgagatagtttcctaagttgtctctgcctgagttggccgcgggtctggggctcattcagccctttgtccccctgttgagtgcagtgcgtgtgtggtgacaatgaggtggtgcagttacactgagggctaatggtaggagttccgtcagcccattcatggaggcagaggagggtgcagggcgcggagctcgagccagcaagcagaggaagtcagaggcccttgtaacgagctgaagatcacaaacactgctgtgagggctccaggcttgggggcgggggcagccaggagggaagggggcaagggagggggcctatcatcatagaagttggaggtctgcccgaccgccagcgcggtagggtaccacctgtccaggctgacagacgagcattatggcttcccttttaatcagcttaatttggggcatcttaacacaatggctggtgctttggaggctgcaggaaagctgatgtcctagagccgccacacttgacatgcgtgtaacaccttttgattagaggcgctttcgtgtttttccagccacttgggctctgtctctttttcttggagattctctggtctgtatgtctttacttagagcttagaagtcaaggtatataggaaaaaggagttctgaaattggaggcttgccctttctaaagccagtctgagctttcagccagatgtcactgggacaagccacgtcaactctccacgctccattccctagctgggaaacgagggcatttggctatttgatttccagaggccctttggacctccaaattctccaagtctgtgattatttgtgtatgtcttcttataatccagcccctttggaagcactaactccactcttctctcagcttgatcctctaatagaagcaacctggttggatttaaggtggaggtcttcctctctccaggtggctgccctcatctctacccccaccccaatcccatgcattctcctgccctcctgctttgggcaagacccgggcgatgtggagttggcatgtccagttgcaggtatcagcaccactgcaccatctcctctgccttcacttcccaccagcacacagaatttatatgcccttcccaagtccaaaaagggcccctgccatgctaaacaaaggtattcatatgcaaggcatgagctctgtctcatggaagggagaggccaagttctctttccaccatcagagagtagcgttcaacatcatttatacaagacaggcttttgcccttttagtcttgctgaactagaatgagggatttgtgtagtcgaaagtcaagctgatcattgtcaagtttcgtggaagtggaacctgaaggaaggttaggtggagactgcagagagggttagcgtcctgccttaccacaaggtaagtctagaagagggtggggaagggagttcagaattcttcattcatggagtgtacctgccttggtcatccttttatcttccagtcagaggggtcatcagtcaagagctggccaggctgggtgtggtggctcatgtctgtaatcctagcactttgggaggccaaggcgggtggatcatctgaggtcaggagttcgagaccagcctgaccaatctggtgaaaccctgtctctattaaaaatacaaaaatcagctgggggtgatggcgtgcacctgtaatcccagctacttgggatgctgagacaggagaattgcttgaacccaggaggtggaggttgcagtgagccgagatcgcaccattgcactccagcctgagtgacagtgagactccgtctcaaaaaacaaaacaaaagctggccgtagtcaagtcagtgatgatttggattgaaattaaaatgtgactaaagagagagtatgcagttttgtctatctatgaaaccttcctctgttttatgtgggacacctgggcacccactcttggctggaacttacataaaacactactgtgcacgcacatgtcacctcaagtcccgtggctctgaaagtccagtagaagtgacagccagacatcccagtcctccctgtagggttttctcagaactgttcctttaaggtctcaggctgctggaagggagggctgatagcagaaaaagtggggacactgggaactccaaagggaagacgcgcatggcctgaaaccgagttctttcgctttctggagcctggtctccctatgtggagggtcatgctggcatggctggcaatggttaattcaccgatggccatggagtcccaagttggccatattattgcggtaaaagatacattaacccagatgaccttgccgggggccagaatagagcccgtgaggaaggagagcaaggcaggatcggccgggaggcgagagggattttgttgaggagcaaggtcttccacaggaactgcgacttggaaagtattcaccaagggctgtgccatgcgaaaccctctttaaaggaaccgcatcgctacgcctaacgggcatttcttttttaatgtaatggttcagagctattgtctaccacgcctcgtgtgcacacgcacacacacgcaagttccctcagtcagccgagaatcctgccatctcttttagataacaaaagctcttaggccttatgctttgggtaggatttgtcttccatggacaggtattcagttgggaacaagtatatagtcactgcctctatggtatggagatactccgatttagtccctctgcctcttggggaaaaaaaaaaaaaaattgtaaacatccccttcagcagcttctcaagtccctgtacagtggaggaacattacacgtgaacttcctggattcaatggattcttctttgcaagaaaaaaaacaaaacaaaaaaacagagaaagaagaaaatatcaatttagactgttaggtccaacgtttcactcagtgagtgagcacagggggtgacggaggatggctggaatgtggggttgaagctgctgttctgggtctcagctcctgcccatgtaccgtggagtgagcatctcacaccacgatgattctggcatttaagtgaactccttcacacggtgctcaagtggagaaagggctgtccatgtctatcccagcttagaagaaaaactgatggtatgagacttgccattcctctctgatgtagaacctgcctaagggacattccacagcagttctgaccgttgtcactttgtgccttaacccccacattcattttgattctatatttagtattaaattttttagattattaggatttaaggttttcaaacatctactgaaatgcaagtgcccctagaaacattatactttcaggccgggctcagtggcttatgcctgtaatcccagtacttcgggaggccaaggcgggcagatacctgaggtcaggagttcaagaccagcctggccaatctggtgaaatcccatctcaactataaatacaaaaatcagctgggcgtggtggcacgtgcctataatcccagctgctcgggaggctgaggaaggagaattgcttgaacccgagaggtggaggttgcagtgagccaagattgtgccattgcactccagcctgggcgacagagcaacactctgtctcaaaaaaaaaaaaaaaaaaaaaaaaaaacagaaaagaaaagaaacattataccttaacttttcgcacctagtgagtgataacctatgaggataatgctgccacatggtccttgagggaagaacttggggaagagccgaacagggatgaggcaggtgagccccatgtgatttatcgtcattcattcagctcaacaggtcggacagggtaagggtaagggatgtaaccaggagatgccacaggaacgtctgagaggtgttagcaagtcccagaggccagcgcccgactccatttcagcctcgttcagggtggcacggagactcctgctgctgcgtcacgtctgtcatgttcagcactcttcccagacacacagtcttgactaaagattgtcaggatcttgacacacgcttcattagtcttgactaaatgcgaatctatacctcatttcaaagaaatctgaattctttaggttccaggaccagtttattgttatacataatcacgatcatttattgagctccacttagcactgcacatatatcagtatcatctcagttgccctttactctgattattttgtggggaaactgagatcagaaaagttaaataacttaggtgccacctgcaagtatagtgggtgggcagcagataccacccttcctcatttcattgttccaggtgatatttcgtctctgcctttggcctttagtctgtggttgttcctaatcttagttttcattgaaagctgtagtttgaaatgtgggatagatgagagataggaaaggaaaatttaggggtatggaaattttgttccttagtggttagttccagctttattttgtttatttatatgtttgtttttaaagatcgggagcttgctgtgttgtccaggctggtatcgaactcctggtttcagcttcccgcctcagcctcccagagtgctgggattacaggcatgagccaatatgcctggccagctgtgttttagatctttgggaaataaagagaatgcttttgggcttggcaaaatagaaacctctgggtggggagaattgcacagtaaaagaaacaaaagggaagtttatattaaactatgaaaagacacagggaggttcaatttaacatatttgccttatgtatgtgcttcttaagagagtgcacaaaggcacctttgcagaggagagaggctagaaaatgcccgttagaagcaagtctacggtttgcaccctcttactagcaccagcaacggtccctgtctagtgatacccatgacttgtcattgcattgcatgtcatctgcctaagagaagctcctgcctggggcagacacactgtcaattacccctacaatatagactgatactaaagcaaggctgcatattcttgcttattcccaaattggatggctcaaggttccagaatgttgtagacattctgcattatatctttatgagagttaaggaaatggtaaagaagcagaaaaagttggggatttttttttttaagtatttacagtgaggcgcggtggctcatgcctgtaatcccagcactttgggaggccgatgcgggcggatcacaaggtcaggagttcgaggccagcctggccaatatggtgaaaccctgtctgtactaaaaatacaaaaattagccaggcgcggtggcgggtgcctgtagtcccagctacttgggaggctgaggcaggagaatcgcttgaacccggaaggtggaggttgcagtgagccgagattgtgccagtgcactccagcctgggggacagagtgagaaaaagtatttacagtttatgtgagggtcagtacgttggttcattggcttccttcttatctagttctcgggctgagtttgctaatgtcatagcacttctagtagccttccccttttctctgccacttcccagcttccccaggcagaaagcatctggtcggccccttgattaccaggcatccataagtgaccatcatttaggccagtgcttctcagaatgccaatcacctgggctccactaaaaggcaggttctgaatagctcggcctgggttgactgagattctgcggttccaacaagctcgcaggtgatgctgatgctgccagcccatggaccccacctggagtagtgaggttccttggcactttaagaacatccctcctttacttcacatttatttctactggaaactagcacagacttatgcaagctaaattacgcatgttttctccgtaggatgctctatgtcctgttcctcttactaacaactctggtctggaccattgttctaggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 35723 - DNA, 31579 bp, Homo sapiens; identical to SEQ ID NO: 35722

SEQ ID NO: 35724 - DNA, 21122 bp, Homo sapiens
cctcctggcgcttgtcctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccgggtgagagtgcgggcgcgtttggggcgagaggacttgtctggaaactcggtccacagtgggtccgagagcttctgtgtgactcgtgctccttgctgaattaggaggttagggagcagtgcaaacaggaaacgagaccctggcccggtctttcagaaacctaggctcgagaagcctgttcggttctcagcatgtttgagtgcttctgggcgcgggcggagcgagaaagcaagtgtagggtggcaggctccggagccggaagaagcccgttcaattcagcaacttttcattaagcatttgctgtgcctttagtccggtctctgaagcaaccgcattggcgcagtttttccagacttataagcttataagtctgagccgagcacagaactcgttattagaaaaggagggcggaaaaaaataagaatggaaatatcgtttttgagagatacaaacaaaagtagcaatgcagttcagcatttaagcacttaaggtgtacagagtgttggattacgaggaggaaggagggagtagggaactcgaaagatgatctaggtctggagaaagaactgccaagcgcggtaggagtttgctatcgttgagcgattgatttacagctaggacttctggagctcttcctctgggaacagctttggtaggcaatattgcctaagcagaacccaagattagcctaaaccaatcagggagggatgaagaggtgaatagagaatgttctcagccaaactcaagtaaaaatggggcaggtaggatggcagtttgacctttggatgccttaacctgtgtgtgatgcttaggatcatgagtggaaaagacctacttaataatacaaagaagtaggaaatttagctagaagaaatgaaatacggcttttcattcacttaaaaaattccaactaagggagaatagggcactactggggcatataggagtagtgtctaccctaaattcaaaccttaaggagccaggtaggtaacatatacgagagaagctggcttgacatgagacagtagaagtgttggagactgaggctttgctgcactatagtagtgctctgtgtaaaggcattcagatccagcagtctcaagttactgtgccagccaggcggaaccttttgatggatgggttggtgggtgtgctgctagtttgcagcctcttgagtttttgactgcaccatgttgcttcctaaacaaatcagtcccccaataagaacttagtgggaacatgtaatatgcccgaatatgcaactttatagcgggtaggttggactaaactaggctgtgattgtgagatgaagttggccttaagtgattaggggatattttcattgggtggtctctaacatttgtctgagaattttaaaattgacttcttagacccttagtttaaccttcctcatttaatagaagagaagcaatcctagagagaaacgacttgcttaaaaaagcacgagttaatagctgagccccaagtctacccactcttagaatataccacattctgttgcagtgtttagttgttttagcaggggtgtagtgcgataacagacaggcagctgtggctgtcccaggtggaacagatttgggagaagcagaacccaagatctgtagttggaagattgtcctgattcaaggacagtgttacccttactgttttatctccactgcctagcagtgtgtctgacatgtagtagatgctcacgtttgacaaagaaatgggcaaaaatgtcagatccaagggtcctatgtagaactgacagatcttggtgacgggcagttagggaaggtaaaagggagagaatagagttggatgctcggtcctttgtgcatcaagccttcggcaaagggaaggaaagaaatggttgctgacttagttcctaggagggactttcttagtgaactaagcatttggtgacttaaagccagattcctgacagtgtaattgaagttggtaatatgcagtggtcagcatttcctttggagtttagagaactgattggacactttttctctcttagttttctttttccttctttttttttttttttaaagatatgctctagtggttaagattctatgctatcctaaactgcttgagtgtgagtttagctttgtgatctcagacaatgtatataactaccaccactgcccggcctcagttttctcctttgtaaaagttgcataatataatttataatgctatgtggcatctttaggattacattaaagagtgtctataaagtgcttacagttatattaagtatctagtgaattccagctactattagtgggagaaaggagttacaaggcctttaggctttgaagtgtactgagtaaattgaggttttaggcgggagctctctttctgatgtattatacagagatatataggcagtcagctatgacagattgatgagaggaaaataaactggccccagccttgcggaaagcgtctatggaggatgggcacaggcaaaaaccagaggggttagggctaagccttggatgactcctttggttgttaagagatccagaaaagagacgtaggtttagaggcaggaagaaaccagctgggtgaagtgatattgaggtaaccagctgtgggggatattgaggaagaacaggtggtcatgaaggaggcagcacaagtggagctgttgaaaagctctcaatcatgagggctgagtcggggaagagaacaggagagacaagccacagagagagtacagcagtaaggcactattatggtgttttgttgtttttgagacagtcgctctgtcacccaggctggagtgcagtggtgcgatctcggttcactgcaacctccgcctcctgggttcaagcagttatcctgcctcagcctcccgagtagctgggattacaggcgcccaccaccgtgcccagctaactttttgtatttttagtagagacggggtttcaccatgttggccagactggtctgaaactcctgacctcaggtgagccacccgccttggcctcccaaagtgctggaattacaggtgtgaaccaccgcacccggtgacaagttatttcttgtaggagaagaaagagacatgggtgaattaaagggaagctttctggagaagtaattttattggtagcagtggtggagggaagtttagggaaatctcatgcatgatagttaattgtactgcacatttgctgtataccaggtacactttcagatcccagcagtagctccacaggttaagtggtagtgtcatatttcagatgagaatggatcggtgtggaagttgagcagtgtcactaaggtagcaaggtaataaatggctcaagtgcagcttcaaacgtaggtctgcttgacttcaaatgtttctggaatgtggaaagttgaaagtgggtttgggacagtctttcacttttgaaaactggccctttttctgtctggagttcctgaaaggccctagaaagtttccttctgaagcatcgtgttgcttagtttagttgttgtagtaagtcaaggccctacatgtcctttctgcatgtttccacagcaacagacgatcccttggcttgagccagttgattcttgtaagaatgttagtgcagtaatacagtaactaataaagaggaaagcagatgccagtgggtctggaggagccttcagacagcatgtgatttttaaggagatgtgggatgaggattgcttcttgttttgtatatggagtagtgatcaaagtctctcatattccagcccagggctggactatattagtggatagttggtatgtcaattgtactatattaaccataatgtaggcctggccagactagccactgtaggatctaggatttaaaactatctcactcttctgtcttacacaaaaataaattccaggtggattaaagagagacatttaaaaagtaaaagaagaaaagtgagtatttgtctatctcataataggaaaggccttcagcataaaagcagatacagaaatcatgaagaaaaagtcgatcatgtctacatacacaaattaagttgttccaagtgttaaataccataaaccaaatcaaaagagaaactagggaaaatatttgactattagagagcaaatacttagagatcaaaaaatagcaggaaaataggcaaactcagaaaattcagtaaagaagaaaatcaggtgtcgggtatgtgattacctcactggaaataagattggcacaacaaagccaccatgagtttgttttttttttccattatcaaattagcaaaaattttaaaacatgatcaagcacagtccctagtatcagggaaggtctaagaaatggggcacttgtgctgctagtagtaatataaactggtagactaataggaacaagtgggtagaattttagaagtctttgaaatacatatcctgggccaggtgcggtggctcacgcctgaaatcccagcactttcggaggctgaagtgggcggatcacctgaggtcaggagtttgagaccagcctgaccaacatagtgaaacctcgtctctactaaaaaatacaaaaattagccgggcatggtggcacgtgcctgtaatcccagctattcgggaggctgaggcaggagaatcacttgaacctgggaggcggaggttgcagcaagccgagatcgcgccagtgtactctagcctggccaacagcgtgagactccgtctcaaaaaaaataaaaaaatacatatcctggctgggcgcagtggctcatgcctgtaatcccagcactttgggaggctgaggtgggtggatcgtctgaggtcaggagttcgagaccatcctggccaacgtggtgaaacccccgtctctactaaaactacaaaaaaaattaggtgggcatgatagctcacgcctgtagtcccagctactcaggaggctgaggcaagagaatcacttgaacaacccaggaggtggaggttgcagtgagccaagattgcaccactgtactctagcctgggcaacagagcaagactctctctcaaaaaaaaataaaatacatatcctgtgatccagcaattccttttttttctttcttttttctttttttttttttttattttttgagatggagtctcgctccgtcacccaggctggagtgcagtggcgcgatcttggctcactgcaacctctgcctcccgagttcaagcaattctcctctttcagcctcctgagtagctgggattacaggctcatgccaccaccctggctaatttttgtatttttagtatatggaggtgggtttcaccatgttggccaggcaggtcttgaactcctgacctcgagtgatcctcccaccttggcctctcaaagtgctgggattataggtgtgagccaccgcgcccagctgtaacccagcaattctacaccaagaaatttattacagaggcgaaattgaatatgcttcccccatgctttcactagtttgataaacttcatatttccaaaactttatagagtgcttaaaaaactacataggtaggtggcacatgccttaaagtggtaaaaggccactgacaaactataagaaactcatttttgtactgacatataggagtaaaagtcaactaggaaaattaagaaaaatatgagaggccaggcatggtggctcatgcctgtaatccaatactttgggagaccgaggcgggtggatcgcttgagtccaggaaatcgatagcagcctgggcagcatggcgaaacccccttcctacaaaaaaatagaaaaattatccaggcgtggtggcgcatgcctgcaatcccagctcctgtggggactgaggtgggaggttcgcttgagcccaaaaggtcgaggctacagtaagccatgattgggccactttgctccagcctgggcgacagagcaagactgtctcaaagatgaagctgcaggtctctgctcactatgggtgattccaggccacacttttttttttccctcatgcagaattttcatagagaaacactgttctctttctgctagtcttccatttgttaccactgtaaaatagaaaacagaaaataaaatcaaaagcttttggacttgggagcttaaggacagatgtgtacacattttggtgaaatttgtatataagcacatcttggttttatttgttgtatatagcacctaccacagggatagcatttagtagctcaaggttcatacagcatatgatgctgtattctactgtacaaccctttggcccagtgtttgaccagtccttattgatagaccaaaatcttatgtcttgcagatgctgttgatggagtaatgaatggtgaatactaccaggtacagagtactctgattctgttcattgatagtgattgagaatcttcctttcctgtgattttaattgactgacctagaaagaaaccccagtcctttgactttcctgaatgtattactggctggtgtgttatctaccaaagtggaaagatttaaagagaggtagcattgataaaaagagaactgtttaaaaatgttatttacctgcccctagtgttatcacctttattctaaagaaatcaccattcaaatgatactgtgttgagtgcagtaagttaatactaatactttaaataattctccttccatctttgtttatagtctgattaggttaacctggtaatattaatattccttagttcagtgagtggcatatggaataattttgtaaagattaacatttatttgagtctttttttttttttttttttttgagacagtctcactgtcgcccaggctagagtgcagtggcacgatcttgtctcattgcaacctccaccttctgggttcaagcgattcatccacttcagcctcctgagtagctggaattacaggcgcatgccaccacgcccggctaattttttgtatttttagtagagatggggtttcgccatgttggccaggcaggtcttgaactcctgggctcaagtgaccatcccgccttggcctcccaaagtgctgggattacaggcgtgagccaccgcaccccgccagagccaccgcaaccttggctcactgcagaacccgtttctaacaacaatggcggcttttgtaaaatgttaaaggattaccttaaaagcaacaacacaggccgggcacggtggctcacgcctgtaattccagcactttgggaggctggggtgggtggatcatttgaggtcaagagttcgagaccagcctggccaacacagtgaaacccgtctctgctaaaaatacaaaaattaaccaggcggtagtggcatgtgcctgtaatcccagctactggggaggctgaggcaagaggagaatttgcttgaacccggggagtagaggttgcagttggccaagattgcgccactgcactccagtctgggtgacagagtaagaccctgtcccgtccccccttcccccaccccagaaaaaaaaaaaaaaaaaagcaaccacataggccaggcgcaggcacctgtaatctcagctactcgggaggctgaggcaggagaattgcttgaacccgggaggtggaggttgcagtgagccgagatcgtgccactgcactccagccttggcgacaagagtgaaaactctgtctcaaaaaaaaaaaaaaaaaacagaaccaggggttctaactcaggtgaagtgcattttaggaaggaatttttggtattaatatagcacaattgtgttttgtgttaaggaaagtaatggtccaacagacagttatgcagctatttcacaagtggatcgattgcagtcagagcctgaaagtatccgtaaatggagagaagaacaaatggaacgcttggaagcccttggtaaggaatcccttctgtgttttggtgtctgttttcagtggagtagttgagctggactctacttttattcctttttagctcacattaaccagtgtcattgtctggtctttgggaagatatcttctcagcctgaaggttacaaggctacctgcacagagatgcctaatcacaggccattgtgtgaggagtagggtagccggagatccccaagatcctctcacaggaagagcatagtgatgctgctcctgacctcaagagtagcctcaggtggtgtttatagagtgctttataaacttgaaggattcaagtttcctatgtccgtggactttaacagtccatttttcttttttcttttttctttttttttttttgagatgaagtctcactctgttacccagggtggagtgcagtggtgcgatctcggctcattgcaagctctgcctcccgggttcacaccattctcctgccctcagcctcctgagtagctgggtctacaggcgcccgccactacgtcccgctcattttttttttgtatttttagtagagacagggtttcaccgtgttagccaggttggtctcgatctcctgaccttgtgatccacacaccttggcctcctaaaatgctgggattacaggcgtgagccaccgcgcccggcctccattttttatttgaaggctaaatgaatttaaagtaacacgaggaaaatgaggtatgttaggaaaaaatgtacaatttgtttttcctaccttaatatctctgtaaggtaagttttacaattttacaggtaagaaaagtggaggagaggtagaataagtatttggaatactcagctaaggaatggtaagagtcacaatttcagctgaagtctgccttgcttcaaagtcactacccatccccatcagccacattgctttctaaacatttaatgtgcgtggccatctagccacacagcctggcctttgataaagagatgtgtacgtggagtgtcacctgttggttcatgatcaggggagacttgtgtctgtacatggtggattggagaagtatgcagagtgtgaggatataatccacattgtggccttttctttgttttttctttttctttttttaatcagctgactttaagattcatcttttctcaactttacagaacaattgaaaggaggaaaataaacatgtgcacccccagattcagtaattaatggattatctttatataaatgatatgttttagacatacacacacacaaattgttttggctgacctactttaagataaagacatcatatactttgtgtctaaatatttcaatgtacacctcctagaaataatgacattctcctatgtaaccacaacgtcagcagtattattccctcttgggaactgttgaactagtgaaaacatgagtccttatttttcagatgggataactgacacccagaaataggaagggacatgacccagatgacacagccaattagtgccaaatcatttatctctctagtccaatttaggtggctttcagaacaaagaatgcacttagtatttgaacctttatagcaccattcattagtgatttctttggtggaaatattctgtatctgtgctgtctcgtatggtagccactaaccacatgtaactgttaagtacttgaagtgtggcttcacaattcaagtgtgactgagaaactgaattttaaattttctttaattttaataaatttacattgaagtagccacatgtagctagtagctaccatattggacagtggagctgtaggaagatgaaaataggtcctaacagctttggtccttgcttgttctttgtgtctcttgagtatgcttagaggcaagatttagctggtcttagtactgctgtagtatttttcatgttacagaacccaaatttatcttttctgttttaccaagctctagcagtttttcttctccatggagagagtctactttggtgtctggaaagatttaatttttcaattatgaaattgggtacttggggaatactcttatgagctgttttcttaattcaaagtgctttttttgagagaagtacaacatttggccttgcattccaactgaattgaattcacttggttcatgaacaaggtgttccttcaatttcaccttttttccttgcaaaaactgtgagaaagcacgcgatgctaaaaatagagaaccggtgccagtggttttcagcctagctgctggctacattctcaagtaattttcttttctctgaccagtaacgagggtggccagaagggaaggcacctgtgaatgtgctttgctctctaaggggactcttcctcttcatcctctgaggggaagaattctaaattagtattgcagtggcactaaagctgcaaaagccagaagaccaatttaaatgtactattttatgcagtaaccacagtctgttcaggaggtcaccatttttatttaatttcatttttcagagataaattttatattttagtcctaatgtatagtaaatgttaacatcaaaatacattgaaagaaaatactgtccaatcaaaaaggtaattatttggaagtaatttcaccatgattgaaaagggggccttacattttgaattaggtattgtcacatggcacttccagcccacagcttctcattgcagcatagctaaatcttgcattccacatctgtacttcatgccatggatagacacatattagatgtttactgtagaggctaggtggtgtggctcaggtctgtaatcccagcactttaggaggctgaggtgggaggatcacttgagctcaggagttcaagaccagcctgggcaccatagtgagaccctatctctactaaaaaaaaaaaattagctgggggttgtggtgcacgcttgtggtcccagctgcttaggagattgaggtgggaggatcacttgagcctgggagattgaggctgcagtgagctgtgatagaactactgcagtacagcctgggctacagagcgagaccctatctcaaataaaacaaaaaaaagtttactgtatatactttagagtcatcagtgaaaaatctgagaaaatgattcttctgaacgacagatcaccttccgacaaattagataccgagatgaacgttcctactaacctgaaacttgggggagtttctagctgctattaggctttttcttatagttacacacagccttttgcaggttgttactataagacctttcttgcaaaggccctaaaaatgcccaagaatacttcatttttcatcccttctagtagttacttgacaccgctactgctatctactctccttctcaaagacactaattacagtttgggctcttggtctgcactttcaaaactctgtccagatcactggtggtcacgttttgtgattatttctaggcttgcctccctttctgtccctccctttggaggaagcataatgaggtaagcaaagtgtaagctttacagccagatctgggtttgaatcttggctctgtcacttactataacctttaggaaattcactcaaactttctgagctttagtttttctcactgctgaaaatgtgatcagagtttaccttcttgggattgttgtaaagattgagttagatgtctataaaacacctgccagacagaagaacttgtttaaagtgaagtatcaggttaacttcaagtgtcagctgcctcagtagctatgacatgtatttcttttttttttttttcttttttgagacagagtctcactttgttgcctaggctggagtgcagtggtgcgatctcagctcactgcaacctctgcctcccagattcaagcgattctcctgcctcagcctccccagtaatccccagtagctgggattataggcatgcaccaccacatccagctaattttttgtatttttagtagagacgggattttaccatgttggccaggctggtctcgaactcctaacctcagatgatccacctgcctcggcctcccaaagtgttgggattacaggcgtgagccaccacaagcagccggcatgtatttctttatctctcactatctactgatgtatgtctcttcagcttagtgtcttagagaaaaccatatttagtcctcagaaacttcatgtttcatgtttgagaatccaatctagcaaacctgctaggtatgcattttcttgctgtcatttctagaacctttaggttaactgttagcaatgatcccatacctctaccccctgcacttctctccagtggagtttcttttgtagctctgccctggctctgccacaaacacactgcagaccaagtaggagtagatgctttgtggtcctctctagtgctaatattctgtgttctatcattctctggttcctgaatcatctctacctttggtaattgtcctaatagcaccctgcctcacagaagtgcttctaccatatttagttatgagagtgccaccttgtgttccacaaaaccattgtcaaacctggaatatggactagtttgggagaagaggtaaaagattaagatgaataccctactatgaactaatattggcagcattggtaaagaatcatctataattgtttctcccccaattggtgcccagaaggcttttttcctattaataatagaagtcagtatttccacatacacccttctcttttgctctgcccaaaacaagacaaaacaaaactaatgacccactaagatgtcagtggactgggataagaccaggaataggactgtgggaaagaccaggcaggaatagaagcactgaaatcagagttggttgtgcaaacagagaaaacagaagtttatcttcccctctctactcttctcccccaacaggcacacagacatggacctgcacccaccacaagttcagcaagaccaaaataaactgatgaacttcagtttgcactttgcctcaattgtattgtctttctcttctctcccttcaaagatgccaattctcggaagcaagaagcagagtggaaagaaaaggcaataaaggagctagaagaatggtatgcaagacaggacgagcagctacagaaaacaaaagcaaacaacaggtcagtccgtggtggttgtagcacactttgttttccaaaattgaatcaaatccattctcagcatccagtctcggtttttggcttctgcctcctttagtgtgaaatgtctgcagtttttaaagaaagtgcttgaaacaggttgcaagtctctcgggtcttgtgagcataattcaccctattgtttagccatcccaattgtagtgagcttagctctctgagagtttggttaatatgcataacctgtaatggtgtgattcagccaagggaaaagttactttccatggaaccctgaaacgaaagctgggtgtcatgaatacacccagatctagttactttggatatgattatagacttggtcatgttgagtctcctcaatatagccctgccccctgaaagccacttcatgaaggggtccgttggcaggaatatgtgctttgtaattaggcagccaaggatgttccaacatgattattttagaattgagggttctgtgggtacttatttgtgccttaaaaagtcttgaattgacttcttaaaaatgttctgtttgaaatagattttatttagttactgatggttaaggagttgtgaggagaaaaacgctttcattctcatatcactactcaccagcagctgggctttaatgccctacacttagagcccttcttggaagcagcaaagagaggatatgtggtgttgcttccctcagggcaggcaggttcagagcccaactttcactgaatagtcaatccattcacttcagtgtataaacgggccagaccgagcctggggatatttttaattttcagggtagagccttgggttctcgtatgcagaggcaggaagcaggttgggttaagtgcccttgtctctggcagctctgttagacagagatgtggcaggagagagagctaacggctttgccagccagccagtgctattgtgggtccagtatgacagagcagttggactctcttttatatgctagcagcccttcagctcattggattccggcttgagcctgtgtcctggtcactttcctctgggggcggtgtgctcaaggagtgcctgtcaggttccatgtggagtccacaggactccacagtcccagtcccacaggactgctctctggtgtgcaggctgggttgccagtggtgatggcttccatcagctacgtggggctgttgttgagcctgtggtcagtaggtggtgctgacaggtccaggctcctgtgtcctctgctccctcaagatgattttctcccaggtggaagttcagatcggtaaagccgagtggggactgtgtgcaagcaccctgcgagccctgagaactcccccagcctgcgaccccagcatttaagtttagtctgaagtactgtagctgtgccgaccctccccgctctgggtctgtgatgcgtcaataacttaacacaagttttcaaacttagataatgaatatgttggtaacagcctttctgttgcagaaatttttttcaaggaagttttgctgaactgtcaagaaagggatattctctgtatacagaatccgttgttctcagagggagtaatgacacctgttttttttttttttttttttttgagatggagtcttgctctgttgcccaggctggagtgcggtggtgcgatctcggctcactgcaagctccacctcctggattcacgccattctcctgcctcagcctcccgagtagctgggactacaggtgcccgccaccatgcccagctaatttttttctgtttttagtagaaacaaggtttcactgtgttagccaggatggtctcgatctcctgacctcgtgatctgccttccttggcctcccaaagtgctgggattacaggcgtgagccaccgcgcctggccatgacacctgtttttaggagctcagtcttaaaagtttagtccctccaggcattgaatttgggccttggtacctttctgtacttggaactgtagaatgctgggtaagctggtctcacagatgaacctcttaagttccagagagaaggaacttccccactgctcactgagaatgtagagctgcttaggaagcaggtcacttgccttgtgggaaccttgcagcacagggctgactcttgagagcataacgctagtggcacactagccattgtcaccagggctctaggacagaagagatggtttttacagtttattccagtgattcttcactggttggaggtgggatccatttgagagtcactttgggggacttcttccaagggtctacaccctcccctggagatttttatattgctgactactccccctctccatccatgtttgactctaaactttagagttcaaaggaataggtcccatttagatgtataaagtaattcatccttgttatctgtctatgggtaaagagtgaatatttttagaaaagaaaatgggggccggacaccgtgactcaacatctgtaattccagcacattgggaggctgaggcgggcagatcacttgaggtcaggagtttgagaccagcctgcccaacatggtgaaaccccatctctactaaaaatgcgaaaattaactgggtgtggtggtgtgtgcctgtaatcccagcaactcgggagtctgaggcaggagaatcactagaacccgggaggcagaggttgcagtgagctgagattgcgccactgcactccagcctgggcaacagagcgagactcagtctgaaaaaaagaaaagaaaaaagaaaacggggtgctcatttcaagcaagtatgattctctctgggtgacttctgcagtagctagatgttaaggggacccgagagataaggcagaaagatgagaagtttgaaagaggaaagtcggagacaggaagggcatccagttaattgtgagagcatcctcaggcctcctgccttccagctgcctcaccactgggtcaccaaagcactaggagcacgtcgcgcctggcactgcactgggggtgggtgtgctgtactctattgtcagtccccagactgcatctcccttcttttatcccaagttgaggcctaagtgtcacagtacaagagctgtgaattattcagtgacagccatggaaaagaatttccttttcatagccagccagccagagcagtgactgactcctgcagctggatgagtttgctcatcaagaacaaccccagaacatttcccctattacaggtagcacttgtgcttgtcagctctttcaaggcttgagaaggtttggggaacccacagttctcagagatggcaaacatttttttctgtgcccactttgaggctgtttatggaatgaagttctgcattgtattcgtgcctccagagcttgtcctaggtcaggtattcctcttccctcccctctcctaagcctccctgagccccttcctgccttggctgaggattgctactttcaagtgaaggacaaataaggggagggccacctgtgtgtgtgtctgattttctgtttgttctgggcctgcaaccttgacaggggatgtgcttgtcactgaggagctctttggtcttgggctagctgcaaaggagcaagagcctgacattcaaacttttgttgtcttagtgatgatttgacaggagtcatgaaacctctactcttcttgtggagggaaacccaagttgaaatcgatcaggtttagtcctttgtgtaaactaaaagggttatgggtttataagccagcctgccttgccttttcctcccactcattctgcccacaaacaactctgttttcctgctgagtcactttaagttataatcagcctgctctttttgctttctttaaatttccacaaaacacctcctgtgtataaaacaaaatgggaaagaaggaagggcatgtgtgagcttaaaaattaacttaaaattactagaatttgccttcaaataagtatgtgaggttagcttaatgaccaggcatgattatccttgaaaaatgtctttccccttgcccaccccaaatcgacttgacaaaggacagggtaagactccatgagggaggttccatgtccagccacagtggagaagagtgggctggcagagcccagggagtcagtccaggacaacagagtcaaagccagcctggcccctgctgtcaaaatttatccacccagtctgccccctccttcctgtctgagagccctgccatgttgagagttaagaagggatgaagttctggattctgggctgcaccttatcaaagccaattgagtctggtgtaaaaatattcagaaactgtacccgcttcttgagtagagagagagccatattcaggaacaacagaagccagggccaggatcctagtccagtgttcttcccaccagaccactcacctccagccgttttttcctgtaaggttgagattttaaaatgacgatatgtgttcccaggattctggaagtgtatcccacccagacagtgtggggaagcagtagttagataatccaagataaaactggctttgggtcctagcgcatctggtgtctggcagcattcctgcccagtgcattaactgaaacaggaaggtggcgtggctttctgggcacatacagcagggaagaagcatgactatacagtagaaagagccctggacttagggccaggctgccttggttgtgagtcctgaatgctgccactgtggtgtagctgagcaagttgttcatctctaagcctcagttacctcatctgtacagtgggggtgagaacagtcagggtcataggttgttaacagttaaggattgaatcaacataatgtatgtgaaagggcttagtccatgattgggtgcttaataaatgcccgtgttgctggggtgagccaaagggatgaagttggcagtgcttgctctgtcgtggagcagtccccacgtgggaaggccagcgggaaaccaggcctgctgaagtctccagcgctggaagcctcacgggggttaggaaggagccttgggagcagctcctcagagcacagttgtacctcaattgtggattttagatgtttctgcttctcaatgttctctcttttttcctgcctgcttgcctgccttttggacctcttgctgtctagggtggcagatgaagctttctacaaacaacccttcgctgacgtgattggttatgtgtatgttgcaaaactaattcctttttctacatctgattctttctacttttgtttagagttaatgctccttttatgtcacaagttgctttgctttttaaattatttcaaattggcactttgggggctgcctaagaattgataagcggggtatgatctgttgatgaatcttccagatttgtgactccctgcatcctctgatggccatttttcatatttggggttttggagggaagaaagctaactcgctttcaaaatgtgtcatttgcgatcttatctgggaacggtttgaggctcgggggaactctgctctcttgctcttggctgccatcactgctgccatgccctgttgcctgcctgcctcaggtgggaaggaggtttccccacctgggagcaggtggcagtcccaggaggttaggagccagtgagcagcagcaccttgcattgccaaaatcagagctgtggggcagcattttccatacttggttcattcaaacaatgtggggtcgtttgcctctccctcaggcagaagagtccagagcagagggggttgtctccagtgggtgtctataattgttcctctgtggtcttgcatgtcagaaattgctatttagtggtcagcttctgatgtcctgtctcctagcacagggaagcccccagctttgagatcaggatagtcaaagtgtcttgatacgggccacttgggcttctccccctgacccccccaaaagaaacctgcatcttctctggagaaggtgtttttcttattcttttttttttctttttttcttttttcttttttttaaggatttcttttatcaaagcagtattgctgaagagttggaaacagttctcattgtctcctccttaaaaattagggctggctttacatgagaagtaagggtggaatggaagaggagaggaacctgtggaaggtgggcgatgagctcaggtctgtagagcctctcagggcctatgaccttgagatgttcatccccttagaagatagaactgggtttcctgggcccccagatgcatttgcagtgagacttgtgaaatgctggacttacaggtggtgtttgatttgatttctgcacattctctctggagtagaaatggagactggaaaggtcgagtctggttttgctgggcagctgggtggccagcaaagccagctgcacgtccccaagcacagatagagtggcaagggcatgtccagcttactgaccatctgcattgagctcattctcattttctatatctgacttaaagtttctctcgtttcttttcttctcttcacctttaagcacaaacataaaccatccttgctacagcctagaacagttaagtaaacctttctcactgcccctaactgtgtgtgccatgaagtcgcagtgttgtagtggctctgggcttcagcggtgtttgccacggccatccctgtgatagtgccacccctccgtccccacagaccagtcatctccattgcttttgctttgcccgtgatgcttgttggagtagatgaatatagtgtgtcttagcgctgtcctttccggctgtagctcccaccagttaattccgaactgggggtgggctgaccttgatgtgaaagaatgttggagcagcatcctgccaaaaagcaactcacgttggctctcctgccagtgtgccctgagtggccccaaggcacctggctggagggaaaatggcaaacttttggctgaactggagaatgtcctaacaaacccccttccagaatggctttagtctctagtgcttgctagcatgggagctttgtcttgaattccttttgatctgccccgtttctctccagccttaggaataaatctagaggctattgtgcaatgatctgtgggctttttagaagtctctaaatttccttgaaattcagtacagcccagcataaactactcaagttcttgatcagcctgctgctttgttcttattaataaaagcagtgtgtagctggctaaggacttgttttattaatgctccacaggagcagagacagacagagagacatagtgagccttgaaccaaacacctgtattccaacattttacacagcggtctgggcaccctgtgcctaggagagccagctacgtgtctacctgagtctgacctgggccaggggctgttatcttgggaaagccagaatgtcattaagaaagggacaaataggcagttgcttgtgtagcaaggcagccaccaggttgctcaaagggggttctgcataaaccaacatattttgttgttgcttccagggcagcagaagaagcctttgtaaatgacattgacgagtcgtccccaggcactgagtgggaacgggtggcccggctgtgtgactttaaccccaagtctagcaagcaggccaaagatgtctcccgcatgcgctcagtcctcatctccctcaagcaggccccgctggtgcactgaagagccaccctgtggaaacactacatctgcaatatcttaatcctactcagtgaagctcttcacagtcattggattaattatgttgagttcttttggaccaaacctttttgtctttagagttgttcattgtttgtgattgcatgtttccttccttcaactgtgttctccctggcattcagagaggagggagaggaggaagaggaaggggagggaagcttcccaagagtagcctcaacctgtgcttctgtgcattattctgagaataaatttctgtttcaaactgt

SEQ ID NO: 35725 - DNA, 17264 bp, Homo sapiens
ggtccctcggacgattggacctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 35726 - DNA, 7340 bp, Homo sapiens
actatccggcgccgagccggaggggggaaacggcgcccgccgcccgcccggagcccgcgagcaaccccagtcccccccacccgcgcgtggcggcgccggctccctagccaccgcggccccaccctcttccggcctcagctgtccgggctgctttcgcctccgcctgtggatgctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtccggtggagtccgcggcatttacggtgccggagctcgggcccgggcggccttggcttggccttggctcagcccctcctccctcggcttctgtctgtggcctcgtggcgtctgggccgtcctgcccattcagtccagggaacgacccggacccaccccgacacccccagcccctgccctgacccagggagttagttggatccccggatacccatctggggccgacactggcagtctcagagcaggctttttgcaaacacccctcagtgctggggagatggtgaaagatcacgcctgccggattccgaatcctttctctccttaagccaaattttagccacttccaattacaaagcacagtatgtatacttcaaacttaagtggtgaacttaggctccgctccttatgggttttctaatgttaatttttagaatctgggtccattagctgtttagagcaaatattgttatcctgtagtccaaggagggtatagataagcatgttttccaagaaaagggtctggagctttcattagattctcataggatttttaccgtcaccaaaatcagattcagaaccacttctctaaaaatatggctctattctctctcccatcctcaggttagcttcttgtaccttccctcccctagcaacgcccctttaaagaagctaagttggaaatggtctctttcctcaggtgtattttgacctacgaattggagatgaagatgtaggccgggtgatctttggtctcttcggaaagactgttccaaaaacagtggataattttgtggccttagctacaggagaggtaagtggctggagcaggggtagtcaactcacatgaagtgaaattggcactggggatggcagcaaactgacctgcagagttcagccgatctgtagcgtggacctcactgagcaccgactgcctgttgccctgggaacacagtattgccctttcttaagagtaatggggccctgaccaggcacagtggctcacacttaaaatcccagcacttttggaggccaaagtaggaggattgcttgagcccaggagttcaaggccaacctgagcaacatagcaagaccctgtctctacccccgcaaatttttttttttttttgagacggagtttcactcttgtcgcctgggctggagtgcagtggtgcggcctcagctcactgcaacctccgcctcccgggtttaagtgattctcctgcctcagcctcctgagtagctgggattacaggcatgcgccaccacgcttggctaattttgtatttttagtagtgacagggtttcaccatgttggccaggctgaactcgaactcctgacctctggtgatccgcctgccttggcctcccaaagtgctgggattagaggtgtgagccactatgcccggccaaaaaaaattttttttaattagctgggtgtgacggggtgcacctgtggtcccagctacagctactcaggaggctgaagtgaaatggaggttgcagtgagccatgttcatgccactgcactccagcctgagcaatagagtgagaccctgtctcaaaaaaaaaataaattaattaaaaataaaaggccgggcgcagtaactcatgcctgtagtcccagcactttgggaggctgaggcgggtagatcacctgaggtcaggagttcgagaccagcctggccaacatggcgaaatcctgtctctactaaaaatacaaaaaattagccaggtgtagtggtaggcgcctgtaattccagctacttgggaggctgaggcaggagaatttgttgaacccaggaggtggaggttgcagtgagccgagattgccccactgcactctagcctgggcaacaagagggaaactccatctcaaaaataaaaataaaaaataaaaaaacaggctgggcatggtggctcacacctgtaatcccagcactttgggaggcggaggagggcagatcatgtgagtttaggagtttgagagcagcctgggcaccatggtgaaaccccatctctactaaaaatacagaaatcagctgggcattgtggtggcacatgcctgtaatcccagctactcaggaggctgaggctggagaatcgcttgaacctgggaggtggaggctgcagtgagcggagattgtgccattgcactccagcctgggtgacaagagagaaactctgtctcaaaaaaataataataaaatttaaaaaatgagataaaaaagagtaaggggtccagagcttcctggggagacttcacctagggtgagggcagtgggttttaaggaaacaacagtgccctatttcagtttatattaactttccattgagccagcaggtgacctttcttctcagttttcttgtatctgttcttatgattggaagaaatgaggggaaaagcattatgtgatgtagaattgtataaagcttgggaattgtatggaggcagagggatttccacatctgtgtgtaccatgcctgtcctgtggcgcctgcccgctcacttagtagcacactgaacagtgaaagtggtcagcagtggtgtctcttctgcgagcaggagttgtggacttgttcctgtgaggcctatttaatgtaatgtcttcctgctgccccataccacctccttaccttctcttccctttttctagaaaggatttggctacaaaaacagcaaattccatcgtgtaatcaaggacttcatgatccagggcggagacttcaccaggggagatggcacaggaggtaaccacaggtcctctgggccaaggagtatgtcagtgtagcctccacagtgggagggccaggttctgctggggagaccaggcctctttcttccccagctctagaggcaggcctacttattacttacctactttgagaccagcggcacccttctttgaagagggaacccagtacaaaggagagagaataatggggtggacctgatggtagatctaagagaatctctcccaggtgaccgtcctgctgatccaggcctatagcctggtgacctttcctgatacctcttcagaatggggattggggagagaggcgtgtggaagcaaagtgaagacatgtgggtacgcgattctaggtcagatgcccaaagcctgtccaggctaccctggaagccccagcaagagtgagagggccaggcgtggtgactctgtgatcccagcactttggaaggccaaggtggctggatcacttgaggccaggagttcaagaccagcctggccaacatgttgaaaccccatctctactaaaaatacaaaagattagccgggcgtggtggcacgcgcctataatcccagttacttgggaggctgaggcaggagaattgcttgaacctgggaggcggaggttgcagtgagccgaaatcacgccactgcactccagcctgggcgacagagcgagactccatctcaaaaaaataaaaaaaagagtgggagcagttactttccttgacagtctttcaccagagaccactctgtgagggccgaccctcaccttggcattaacttgcacacataggacagaaagacccccggacgcctgcatgagtctcactgagctcaggtacagcctgctgctcccttagaacacagctcactcctcgatgagtgtctatggggctctgtggtgggggttgaggatgtgaagacccatggggcagtggctcccttttacttccaacaactgaaaatgtacaagtgagccatgatgcagcgtttaggactcaggctcacaaaggagaccaaagaactgtatttgtggagtcagacgcagttgggctcgatccagtgtctgccaccttcttgttttgtgacctcaggcaagtgagtccttggagcttcagtttcctgttctgtacagtgagggtggagagagttgtggggccatgaggattgggctagatctggagtgtgaagtgcctggcatgcagtgagtgcttagtaagtcagccattgttgaagtgctgacaagcagagggatcccctcaggccagggaacgggggaatgaccttgcggatgtgaggaaagatttcagtggggtcctcaatgaggagaatttgaacgggcagaaaagaggcagggttagggcatgagcccggtgctgttctgtggcaggagcttggccaaaggtggggtgaggacatctgtacccggagtgcagagaggtgggtgatgtcctgcagcctgggcttcggcctgcagggagtcagggccacagagctgagtaagaggatgacccctcacttggggtgccaggggagtcatgtggtggcagatccaggatgtggaggctagggcaggcaggctgctgggggcattggtgccactgaccctgggcagggagatttggacctgatcctgaggtggctgagagcagagattcgagagcagaccaccttggtctgaactctagccccgctgttgctctgctggggctccttttattctctgtgcctcagtttcttcatctttgaagtggagttagctcctcctcatagagtggattgttaaatatgtaagatgcttggaacagtctctggctcacactatgagcaccctaagcactcgcctactgcagcggtggtggtgggaatggaaagaaagagtaagtacatggggagtgggtagggacaacctgagccacgtgcagaggaaaaggggtcaaaagaataactgaggtctggagagaaagatgacaaggtatgttgagtttaaatagaaatgtccatttgagtttggaacccctgtatcttgagagagtggctggagctaaggatggagatttgggggttttctggataacaactataatcaaaatcccacagttggctcaaatgggggaggcttttagccagcactccagccaggtctcactgcacatgtggcagagtccagtctccccagcgtgggggtgagaggtggagcacaggcagaagcaccctgtccccaccagccagagtctggtcattcttggttttcagtcatcctacctgctgcccaatcagaaacatcttcctggttggcatctgtctaggacagtttcccagctcagttccattctgtggaaccacaggatgaaggtaggtgcagtgagaaggaaaaaagagttttgcatgcaaatatgtttgaaaggtgttagataaaacaaaatgaaaatgaccccatttttggctgagtttcttggggcctcatgcacagtgtcagtctccaaggggtgatagggaaaaagaagggtttcggtgttcctcgtggaagcagctttggaactaggatctctgaaatggcatagagatcactccggattgcccttaccatatccccaagccccacgtggacagacgcgtcacacacactcacagctgtcttttattcctgttcattccttgttaagaggctttgactctccagaatccaaggggcagcccctcttttctgcccctccccacacatctctggctgctttctcctctgcagctatgcctgtgtcttttgtgctcataggaaaacaggctggtcagccacagcagtcctccttttctggagagttccgaccctgttgactcccctgcatcctgcacggcacttccctccaccaaagtccctccgtggcaggcctgggccatagctaaggggagctgataacatgcgccttatttaaaagccacaaaactatcttctcaaagtaatccttctgtgagctgttcaccacatcagcctggcctgatgccccacttggcctcagtcagcatggcttggctctgaggccagaagataggaaggacgctgcttttatgtccttgtagtccactccagcctagcctggcacagaggacaggttaagccccctcagtcctggccccgaatgtctgcttggtttggcgcaatccagcgcccctgacctgctctgtcttttttcccaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggtgagttgtggaagcaagggctactactgggcaatcctcaccggggattcaacacagaccccagggcaggagctccatgtgtccatccctttcccaaaaggacccaacccacagatgcagcccagtgctcctgtccagaataaaccctgtacctccatgcctccaaggttctaaattcttccagccccctcagagcccagccaggaaggctgcacaactgccagagcctccctcccctccttcactcagtgacgtgctggtcccacccctgaggtatacagagtgcagctgaacgcaatgtccctgagaagccacatgccctggtcaccctcttcctcctcctcacccttggcccaacctgggtcttacttcaaaggaacaaaattcctgtaccccctcgtcaaatctgcattctccctgctctggccaggagtctgttagaattttggtgcctccagttttgtgtgctgttgatcacttgtgggtcttagccctcctgagccatacgctggggcctttctcctgagcggtggacctcctgatccaccatgccctcctgcttccacctttcttttccaggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttttaatat

SEQ ID NO: 35727 - DNA, 60664 bp, Homo sapiens
actcaccaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatggtaatgctgaaattttttgggtgcgctgttatggccttttctttgatcttacaatattgctttctcctgaaagaatattaaacataagttttaggaaacctttggacaattccaaacatatccaaaaatagaataactaccttagcaagctttaacagttactatacattttgacaatcttgatttgtctatatctctaaacacttcttcccttcctaggcatatttggaagcaaatctcagacatcatatcatttcatctgtatatatatatttttaaacacggtctcactgtcacccaggctggagttcagtggcgtgatcatagcttactgcagcctcacacccctgggctcaagcagtcctgcctcagcttcccaagtggttaggaatacaggcacaggcaactatgcctggcttacaattatttaagcacatatttctaaaaaagaattattattaaaaagaaaaaaaattgaccacagtgtttcacatgtccgtgtgaagagactaccaaacaggctttgtgtgagcaacacagctgtttatttcacctgggtgcaagcgggccgagtccgaaaagggagtcagcaaagggtggtgggattatcattggttcttataggttttgggataggcggtggagttaagagcaatattttgggggcaggggttggatctcacaaagtacattctcaagggtggggagaattacaaagaaccttcttaagggtgggggagattactgatcaacaaagtacattgatcagttagggtggggcagaaacaaatcacaatggtggaatgttatcagttaaggctattttcacttctgtggatcttcagttgcttcaggccatctggatgtatatgtgcaggtcactggggatatgatggcttagcttaggctcagaggcctgacattcctgtcttcttatattaataagaaaaataaaacaaaatagtggtaaagtgttggggcagcgaaaatttttgggggtggtatggagagataataggcgatgtttctcagggctgcttcgagcgagattaggggcggcgtgggaacccacagtgggagagattcaactgaagaaagatttgggggtaaggggtgatattgtggggttgttagaaggagcatttgtcgtatagaattattggagatggcctggatgcagttttgtatgaattgagaaactaaatgaaagacacaaggtccgaataaaagaaggagaaaaataggtattaaaggactaagaattgggagtacccaggacatccaattagagagtgtccaagggggttcaacgttgttgtctgcttggttggagagtttttgggctctatctctatccttaagtttttttatgttgtcatataccaggccagattgatttaggtaaaaacaacactcttcatttaaaaatatacaaagtcctcctttttcagcagtgagtaagtcgaggcttcagtgattttcaaggaaagagaggaggtgggaaggccaaactgaggaattatgtctgacagaagggaagaaatgaccgcggtggccttcttagaccctgtgggaaaggcctctacccacccagtgaaatgtctacccaaaccaagaggtattttagtttcctgacttgaagcatgtgagtaaagtcaatttgccagtcctcggcggggcaaatccccgagcttgatgtgtagggaagggagggggcctgaacaatccctgcagggtagtagaatagcagatggaacattgagaagtgatttccttgaggatagatttccacgatggaaaggaaatgagaggttctaagagacgggttagcagcttgtaacctacatggaagtggttatgaaatgacgacagaatagaatgggcctgtgaggctggaaggagatattttccttggtccaagaaccatttgccttgtgtgggaagagattgataggcggaagtttcagtgggggagtaggtgggagtgaccagatgagaaggagaaaaactgccatgaaggatagaagttagaatgctagctgctttttagctaccttatcagcataagcgttgccttgagcagtgagatctgatgccttgtgatggctgttgcagtgagactccacttcctttggaagtacggccttgctcagaggcctgacacacagtatcattgtctcacctttaaaaaatagtaattgcgtaatattagtcagtgttcaaatatcctgtggtctcaataactacttattttcctactgttcatttgttaaaatcagaatcaaaatgaaatttatacattgtcattggttgatgtgtcttttaggacaagtcaaagacttttaagaccaggaacacaccagtaattgaaaaattttgtttatcattaattgcagcaagagggatgctatggtttgaatatgtcccccaaaaagcatatgttggaaacttaatgcccaatgtaacagtgttgggagatggggcctaatgggagggctccaccctcatgaatggattaatgccaattatgaaagggcttaaggcttcgatttctatctgttgctctttcactcttgcactctcctgcacatttaccttcctccattggataacaacacaaagcccccataagatgtggagcccttgatcttggaattttcagcttccagaactataagaaataaatctctgtctttattaattacccaatctcagttattctgttatagcagcccaagatggactaagacgggggaacgcacaccatgggaaaccatgagaagactcaattaggaggtgttaggatctggggcttgattggatgatttggaaaatggagctggggtgctgagcggttctattatcagagatgttcaaaccagagtgacttcatcttgagtagggactgagtaaaatgagttggagacctgctgggctgcattcccaggaggttaggcattcttagtcacaggatgagataggaggtcagcacaagattcaagtcacaaagacccagctgataaaacaggatacggtaaagaagccaaaaccaagatagagacaaaagtgacttcttgctaattataatatattcacatgctatctcctttactgcttattgtatgctaatttaacacactagcatgctaaaggacacccccaccagtgcagtgaaagtttacaaatgccatggcaacacctggaaactaccctatatggttgaaaagaaagaggaactctttattctggggaattcttgcccttttccccagaaaactcatgaataattcaccccttgtttggcatataatcaagaaataaccataaaaatagccaaccagcagccctcagggctgctctgtatatgcagtagccattcttttattcctttactttcttaataaacttgctttcactttactccatggacttgcccccagtcctttcttgagtgagatccaaaaattgactcttggggtctggatcagaacccctttccagtaaaattagatttttttttttgagacatagtctcactctgcctaggagaccagcctgggcaacatgatgaaaccctgcctctacaaaaaattttaaaattagctaggcatggtggcacacacctatcgccccagttactcaggagactgcggtgggaggatcacctgagccaggaaggtcgagtctgcagtgagccctgatggtgccactgcactccagcctgagtgacagagtgagacctcgtctcaaaaaaaataagataatgggtgatacagctagccataaaatgtctttaaacaatggggttggtgcgactgaagttccatactcctgtttccctggacctgataaattttacatacattgccaggcacagtggctcaggcctgtaatcccagtacttgggaggccgaggcgcacgcatcacaaggtcaggaaatcgagaccatccaggctaacatgctgaaaccccatctctactaaaaatacaaaaaattagctgggtgtggtggcgggcgcctatagtcccaggaggctgaggcaggagaatggtgtgaacccgggaggcggagcttgcagtgagccgagattgtgccactgcactccagcctgggtgacagagtgagactctgtctctaaaaaaaaaagaaaaaaaaaaaatttgcatacctgatatagctcaggctactcagctattttcctttcctcaggtctaattgttaaagcagcagcagtccctcttcgtggccaaggaaaggaatgtttggtgttttgtgggtagctcagtgacctttttttggtctgtgcttaaacaaaattaaatatctttttttcttttgcaatttattttatttatgtatctcccaacctgccctgcctctttgtctctttttcccttgtgacttacttgccgaagaaaccatgtgtttatgggttttgctgctgattacaaacccatacactgccctttttttttttttttttttttttgagacagggtcttgccctgttgcccaggctagagtgcagtggcaccatcttggctcactgcaacctctaccacctgggctcaagcgattctcccaccttagccacccaagtagctgggaccaccatggcctgcctttttttttttaaatagagatggagtctcactatgttgctcaggctgttctcaaatttttggtctcaagtgatcctcccaccttggcctcccaaagttctaggaatacaggcatgagccactgtgccctgccagggtgtactttaatatatatctgtgtcctgtgtgttctctgtaaattagtagttacagctagaggactggacacttttaagtttaaattcttccagcaagactataaaaaaggtgttttatcttcataatttattttaaaaattagatatgggtaaaagaacagacatagaaagattattgccatttaacataacccttgcaaataacagatggtaaattggtaccaacataattataaacaaaaagcaaaactctggcactaagatggcatggtagtattgatactggtgagctagggaagatctccaaacgctggtgggaccctgaccctggctggtgtccaggcccttgataccatctcgggaaggaattcaacaagtcagaaaatagtgaaagtggctgggagcggtggctcaggcctgtaaacccagcactttgggaggccgagtgtatccatttcaatatcaaaagtaagaaataaaataccccatacaaaaattgattagcaagctcaattatcttgtggtggcttccttataataaaaataaaataataataataataaaaaagtggatacatgtttttctcagcatctattccttcttctggtaatggtacctcagtttctcttcaggggaccagaaagaccccattgcacacagtcttgggactactacttgaggtactcaaaacattcccaccagaggtgtgcctgtgtccaaagccaaaggtattcaaaacattcccaccagaggtgtgcctgtgtccaaagccaaaaggtattgaagctgattaattctaatagaagaaccctaaggaaagttctagaccccaaactactctgggtattgtcttctccagggcctcattcttcatcttttcctttgactctatgagttaccacacattttgtttgcaaaccaagaaccctaacttagagccctgtattatctttatctttccttctttgagtcttgcttagttttttttttttgttttgtttttttgtttttttgttttttttggagacagagtatcactctgttgcccaggctggagtacagtggcatgatctcagctcactgcaacttctgcctcctgggatcaagcaattctcctgcctcagcctcccgagtacctgggaccacaggcatgtgccaccatgaccagctaatttttgtatttttagtagagactgggtttcaccatgttgcccagggtggtcttgaactcctgatctcaagtgatccacccacctcagcctcccaaagtgctgaaattataggcatgagccactgtgcccagccttgcttaggttttctaactgttgccattcccacctccaactcctaaagagaattatagacaaggcaatacttgcaagttcagatagtagactgtccatgtctgggaggccattacacagaggcaagaaccatagccagcaagttgtttaggccagcaagcttaaaaagcaagggccagacctctgtatgaggaaagggctagagtaagaggcctatgataaaattctgaaacaaggacttttgaagtctagttatctaaaaaacacagggctcaaatgtaagaacaaacagaatcataactatcatcaggttgctttgcacaagcataaaaactaatgatgtatgatattattttcgacttactaaaaatcaaaataaaaaagactaatgatgtatatacctggttttatttttggagttttaagttttggttactgtgctggagggatagtaggatatgcttaagtcaccagcccctccataaaagtctcagatcctaaaactcaaaggggcttccctgggcagagacatatcccaaattcactgccagagagagaaagtgagagcgagggaactcctatgtagtacccaatgggaaatgcttaggaagcctgtgcctggcctctctgaactcccttgatgcatatctttttcccactgcttttgctctgtaacctttgctgtaataagccttaccacgaatattacttgctattccatcttgtgagtctttctacctaatcactgaacttgggtcatgggaccgccgaaacagaaggcatgggaggagttcagggagtacaggatagaggaggacctggtgagcctagggccttggaagaagctgatcaggaaaacaaaatatattgattacaacaaaatcaagttgtaataattgtgggacaggaaaaaaaaactatactcagtttttgtgattttgtaggaaaatgggcactccattatactaacttgggaaaataagtaagtccagttttttggaactacaatctgtcaacataaacccaaagccttaaaatgtacatgaaccttgacccagcaattccacttctaaatctaacctagagaaataataatgtatagctcaagattttaattacaaaaatattcatcacaatgttattttataaatttataaatcagaaacaatttcagtgtccaacactgcattaaataaatcatggtatattaatttagtggcattttaacaaccattaaaaatgacttataaatttttatatgtgtataagttacatgcagaataccagcctggccaatatggtgaaaccctgtctctactgaaaatacaaaaaattagctgggcgtggtggcaggcacctgtagtcccagctactcgggaggctgaggcaggagaatcccttgaacctgggaggcagaggttgcagtgagctgagattgcaccactgcactccagcctggatgatagagtgagactctgtttcagaaaaaaagaataatatacaaggaaccaaaaagtggttgattcctgagaggagaacagggaacagagtgactagggaacaaagatgggagagaagttattcttattgcataagtaacttttgtattttaaagttgtgtgctgttgtcttgtaatacttattcaaaaagtaaatatatgttttagaattcaatgaaaaataaagtgctcaacatagaatgttaaaattggattacgaaacagtaaagtgttatcacattattatttatgtattttttaaagtacataaataggaagatatggatcaaaatgttttgcttggctatatttcctgttaaacatatgttattttggtaataagaaaaaaagatagctgagcatggcggcacgcacctgtggtcccagctactcgggaggctgaggtgggaggattgcttgagcccaggtggttgaggccacagtgagccatgactgtaccactgcactcaagcctgggtgacagagcaagaccccatctttaaaaaaagtaccaaataggccaggagcggtagctcatgcctgtaatcccagcgctttgggataccgaggaggggaggatcacttgagtctaggagttcaagaccagcttgggcaacatgatgaaaccctgtctctacaaaaaatacaaaaagtattcagtcatggtggtgcacacctgtaatcctagctactgaggaggttgaggcaggaggatcatttgagtcagggagttcgaagctgcagtgagccatgatcacaccactgcactccagcctgggtgacagcgcaagaccctgtctcaaaaacaacaacaacaacaacaacaaaacccacgaattttaaaaaataataaataaaaatttacaaagaaaaaatagagaagtagaaaacgaaaatctcctcagttcttagcagctaccaatccagagccagcagtcttggtgtgattggccactacctcttcctcttctagggaacagggggatgtccagaaacaaactaaagaacttcttataggtcagagggaggtggagtttcagtagcttctatgcagggttggctttatgggtatgtgacctatgcagtcacacaggaccctgtagttggtttaatgctctgttgtcacagctttgaaattcttaataattttgaataaagaacttcacattttcattttgcattgggcgctgcaaattatgaagccggtcctacttctatgtccaaggctgatcgcttctctaccactgttagtattaccaaactgtccatttgaaattccatgaaaaagtttttcactgccagtgtttaaaatccaaatgtctgcttgaactttgtgatctaaatgtattatttcaatcaataaactataagctaggcatggtggctcacacctgtaatcccagcactttgggagccagagaagggaggatcacttgagccaaggagtttaagagcagcctgggcaacatgatgagaccctgtgtctacagacaacaacaacaacaacacaaagttattttttgagacagtcttgcccgttgcccagggcggagtgcagtggcacgatctcagctcactgcaacctctgcttcctaggttgaagtgattttcctgcctcagcctcccaaatagctgggattacagatccgcaccaccatgcctagctattttttttgtgttttgtaggagagagagagtttcgtcatgttggccaagctggtctccaactgctggcctcaagtgatccacctcccctggcctcacaaaatgctgggattacaggcatgaaccaccacacctggtgtacaattttttttttttgttaatttagccaggcatggtggcatgtacttgtagtccagctactcaggacgctgaggtgggagaatcgcttgaactcaggaggttgaggctgtagtgagccatgatcatgtcactgtactctagcctagatgacaaactaagaccctgtttcaaaaaaaaaagtatgagtgtattgtctcagatatgactaggggagtgagagaagcgccacaagctagggacttcagtttccctaaatggggactagatgtccctgctgggaagagggaagaagatgcaaaaacaaaacagagtaggcacaaagattctctccagtgaaatcacaattctaggatttgctctttagcttcaatgaacatagtcaaacaaaactgtgcctggaagtaattttgcccaatagtgtaaaggcaaaaacctctgctttgccaggcctgagactctaaaaaaatacagctgactttactttaaaaaggaatttaagtcctagaaggtttgtggatgtattcccaatcgtatagtgcctgatttgcaactacttctggggtaaatccctgggttatccattcctggttaccagttcctctcagttccaagagtactcattcccagctctcccattaaatcctcagacaagaaactgaggtggtgtcctgggtgatggctcccacttaattgcagtatctctccctcactgccccctttccttctctctttctttgtccctcttatgtatatctctttctccataatgcctttctctctttctctcctcatttccaatttttgcttaatgatcttagaaaaatatgttttctttcccttccgtcattttgtttgtaaatgctggattacctcaatgatggttaagctcgagaatggtgaaatttataccagggaaaagagaagataagcttatatgtttgtcctaaagaatcagtatctaaagcacaaaaagcatccttgggaatctcctacaaattattttcccatactttttccttcattttaatgtttcttctaaaataaaaaagtattcaaactttcaacaagaattttcattctattttcttatttcttattgtggcattaatttttaaatattaaataattttttaaagacaattttttgggagttgtaggttcacagcaaaactgagcagaaagtacacatttcacacataccccctgcatgcatagcctcccttactatcaatatcccccaccagaatgtgtcatttgttataaaggatgaaccggccttgacacatcataatcgaagtccataggttacattagggttcactcttggtgttgtatagtctgtggatttggaaacatgtttaatgacatgtatccatcattacagcatcatacagaatattttccctgtcctaaatatttaccctccccactaatacctggcagctactgatcttttcattgtctccatagttttgtctttttgagaatattatgtagttgaaatcatacagtatgaagccttttcagattggcttctttcagttagtaatatgtatttaagtttcttctgtcttttcatggcttgttagcgcatttctttttagtcctaaatatattccattgtctggatgtatctcagtttattcactcattgaaggacatcttggttgcttccaagttttggcaattataaatacgtttgctatcgatgtatgcaggtttttgtgtagacttaagttttccactccgttaggtaaataccaaggagtgacatgctgtattgtatgttaaaagtatagtaataaactatacttagtttagtaagaaactgccaaactgtcttccaaagtggctgtaccattttgcattcccaccagcaataaattagagttcctgctgctccccatcctcattagcatttgatgttgtcagtgtttttggttttggtcattctaataggtgtaaagaggtatttgactatcgttttaatttgcatttctctgatgatgtatgatgtggagcatcttttcatgtggttattttccatctgtatatcatctttgatgagatgtctgttaaggtctttggcccatttttaatcaaacttttatatattaaacaacttttatatatttttaaatgaattttcaactttaatatacaaagttgtttgcttactgtggagttttaagatttctttgtatattttggataatacctctttatcagatacatcttttgcaaatattttctgtggcttctcattctcttgaaaatttaagtgattttcaacttttttttttttttaatgagcctatacccagtttttgcatttaaggttttcaccaatgctcacctcaacaccaatgacaatttataatattctttcaatgggaaaacatagtcctctctgcaaatggttgacttctaaacaaactgttggaatatgattcatttgcaccaataagagaccactattacagaacaagtttagcaggagggtgggaataagtctgatggcaaaagtctaaagagggttaagtttgacaatgagaaaagacagactagacagcagagtaagaccctgtctccaaataaataaataaatagcagtaatccaggctactaaaatggcaagttttaagtgagtgaacatattttccagttatgttctaaaattttgaattcctcattaatttccccatactccagatccttagaaccctctagtgtccgtatgaggaattggtttaggtgaaccaagtaaaatgcttttaatttttacattcatgtttttaatatatatatatatatatatatatatatatacacacacacatatacatacacatatatatacacatatatatacatatacatatatatacacacatatacgtgtgtatatatatatgctggatgtagtgactcatgcctgtactcctagcacttcaggaggctgagatcggtggattgcttgagcccaggagtttgacaccagcttgggcaacatggcgaaatcctgtctctacaaaaaatacaaaaattagctgggcatggtggtgcatgcctgtagtcccagctactggggaggctgaggtgggggatcacttgagcagtgagccgtgatcatgtcactgcactccagcctaggcaacaaggcaagacccagtctcaaaatgtatacatatattatcaaatacaaaaaacctttagaagtgtgcttgtctgacttccaatttaagacaacagactaagcacatgcatctgcctcccccttcttaggatctgagtgacatgacaggaaagtggtacaagcaataattttgtggcaacactgaaaagaaagaaggaccagtggtccagaaactgcaatacctccaggaaagaaggaccagtggttcagaaactgtattaaaaactctagaaaacagaaagtagatggattcatactaattggtttacctataatttccacaatatacccgcggtgaaatgaagtttggagatgtgaagtactcgagagattccaagaacaaaacagagcattacagagggagggagtggcctatgaagcagcagctcaagaacagccgtgtgtcacttaacagggataggttctgagaaatgtgtcactaggcgatttcctcactgtgtgaacatacagtgtacttacataaacttagatggtatagcctattgctcctaagcaatacaatatgttactgtattgatactgtaagcagtggtaaatatttgtctatctaaacatatgtaaacgtagaaaaggtacagtaaaaatatggcataaaagataaaaaatggtacacccatatagggtacttaacttgaatggagtttgtgggactggaagttgctctgggcaagtcagtgagtgagtggtcagtgaacatgaaggccaggggcattagtgtacactactatggactttataaacactgtacacttaggctatgctaaaaatatttttcttgttttaataatcaattaaccttagcttactgtaactttttaaatttataaacttttaattttatataactttttgactcacaatatcacttagcttaaaacatacgttggccagaacaagcctataatcccaacattttggggggctgaggtgggatgatcccttgagcccaggagttcaagaccagcctgagcaacatagtgagacctcgtctctacaaaaagtaaaaaaattagctgagtgcggtggtgcatgcctgtagtcccaggtacttgggagcctgagttgggaggatcccttgagcttgggaggcagaggttgcagtgagccaagattgtgccactgccctccagtctgggtgacagaatgagaccctgtttcaaaacaaaaaccaaaaaacacattcacacacattatacagctgtacgaaaatattttttctttatatccttgctctaaaagctttcctctaatttttttttttttaacttttaaagacacaaacccatacattagccccagccatgtaggggctattgatcaggatcatcaatatcactgtcttcacttccacatcttgtctcactggaaggtgttcaggggcaataacacacatggagctgtcatatcctacagtaacagtgccttctggaactcctcctgaagggcatgcctgaggctgttttacagttaactttctaaagtaggggtacactctaaaataacaagtatagtatagtaaatacataaaccaggaacagtcatttataattatccagtattatgtactgtacataattgtaagtgctagacttttataggactggcagcacaggtttgtttacaaacagcatcactacaaacaagtgagtaatatgttgtgctagggcattacaaggctatcatgccactgggagataggaatttttcggctccattataagcttatgggaccactatcatatttgcagtttgtcagtgacaaaaacgtctttatgtggcacataactgtagctgattagatcactggctatcacacttcagggcaaagactttcttcccccaggtgcagagaacaaatggttgaagcatttcctctggttgcagtcctgcaaactgctttccaaagacagtactgagcctcagatgatgtagacctcctcaaagtcctgaagagtagaaaaatgctcctcccctacagaataattttttttggaaattgtgaggcccctgtcatcctacaacgacactaacaggacacttgtcagtcacaagaccaactgtgagcaggcaatcagccctgcattccgggcaaggctttggtgtaagcagctcttcacaactgccgccgtgtccacgcctgccacttaacctcatcgactctacagggctaagctgtccctgaagaggtgtaatgttatggctgggcctatgacttaccactgatctgacgcaggggttacagacagtcagcaggtctatgactattaatggattgtatctttccatagagagctgaaaagccaaggataaaatgctcaccttataatttacttttggaaaactcaacatcttaccttttcacctttttggattgcaacataaacatcacagaatttctgatattaaatttattttggaatgtatgtgtattattttttacttggcaaggggtataaattcagaaaatgttcaatttagttttttaaaaactggtttaacagtttgtctgaagcagattagtggcccatgatcttcattaatcttttgagcaataaatgtttaaattgttcaatctgtgtcaaaaccaatctggcccattgctttatttctttttttaaacaaagtttaaggccaggagcagtggctcatgcctgtaatcccaaagcttgggaggccgaggcaggcggatcacttgaggccagaagttggagaccagcctggccaacatggtgaaatcccgtctctactactaaaaatacaaaaattagccaggcgtggtggtgcatgcccgtaatctcagctactcggaggctgaggcgcgagaattgcttgagcccaggaggcagaggttgcagtgagctgagatcgagccactgcactccagcctgggtaacagagcaagactctgtcccaaatttagatgttaaaatgccaattgcggagtcacatctgattcacttaacttgattatgcttccactaaataaaaacaacagtctcagagtaataacagtaccaaatgtgaaaataaattgagtaaaaaaaccccaaacatagtgaaggagaaaatcagcaagtaaaataaagatgatgatgataatagtaacaacaaaaagtatttacattttgttgttgttttggaggcagggtctttctctgtcacccaggctggagtgtagtggcatgatcatggctctctgcagcctcaatcttctgggctcaagtgatcctccagcctcagtcttataaagtgctgggattacaggcatgagcctaaattagtgcctggcctaaattttctaatgtgacatgactcaagaattccacttctaggagtttatatagtggagaatacaagaagcaacataattatgtggttatttccatgttattttgtattcttctacagaatacaaaggaattagcaatatttttctgtaaaatgccagagagtatatgttttaggcattgcaaaaacatgacctgttggaaatactcaactctgcagttgcagcatgaaagcagccatggaaaataagttaacgagtgagcatggatgtgttcaaagaaaactttacttatggacaatagatttcacagttttataccattttcacatgtcatcaaataatcttttgattttccaaccatttaaaaatgtaggctggctgcagtggctcatgactgtaatcccagcatcttgggaggacgaggtgggcagattgtttgagctgaggagtttgagaccagtctgggcaacgtggcaaaacgccactgtttaaatgaggggaagtccaaatgttagattctggacttggctcttcctctacttagctgccaaccatgataaacacgttaaaccttaaaaaaaaaaagcaaaccatttttctatttagagcatgttaaatcttactttttcccataaagtcttccttgattcattagttgtcctttactttttttttttttttttttttttcttgagacggagtctcgctctgttgcccaggctggagtgcagtggcacgatctcggctcactgcaagctccgcctcccgggttcaggccattctcctgcctcagcctcccgagtagctgggactacaggcacccgccaccacgcccggctaattttttgtatttttagtagagacggggtttcactgtgttagccaggatggtctcgatctcctgaccttgtgatccgcccgcctctgcctcccaaagtgctgggattataggcgtgagccaccacacccggcctgtccttttaaacaaactgaaatttatacaatctatattggtctgctcaggctgccgtaacaaaataccagactaggtggtttaaacaaagaagtttattttctcacagttctggaggttagaagtctgagatgaggatatcaccagcatggttaggttctggtgaggactctctggcttacagctggctgctttctcaccatgtcttcacatggcccaaagagacagaacaagctctctggtgtcttttcttgtaaggacaataatcccatcacgaagtccccaacctcttcacctcattcaaacacacttaccttccaaaaggcccatctcccaataccaccacgttggaggttagggcttcaacatacgagttttaaggtggcacagtcagtctattaacttcctgtccatatattagttatgtattaggcattatgtattacctaatacatagctaatctgtattagtcagggttttccagagaaacaaacacatacacacatcctgagagagataagagagagagactcatatagaaggagctccaaaatatttttttttgtgtgtgtgtgagacggtttcactcttgttgcccaggcttggagtgcaatggcacgatgtcggctcactgcaacctctgtctgccgggttcaaacaattttcctacctcagcctcccaagtagctgggattacaggtatgtgctaccacgcctggatacttttgtatttttagtagagatggggtttcaccatgttgatcaggctggtcttgaactcctgacctcaggtgatccacccaccttggcctcccaaggtgctgggattacaggtgtgagccagcatgcctggcctccagaatattttaagggagtacagaaccactatggtgagtataagctgggcatagtgatgcaagcctgtagtgtcagatacttggaaggaggaggtgaaggatcacttgagtccaggagttcaaggtgcactccaacctgggaggcagagtgagaccctgtcaaacaaacaccaccaccaaaaagccccaaacagaacagttagtatatgccatcttttttttttaagtgtatgtgtatgtatatttgaatactcatatggtatctatcattagaaagatacacaaaaaactggaaaatgtggtagtggaacagacttaattttcattgcatgcctttgtattttttgaattagaaaaaaaaaagtcctgtgtgtatactttttctttaaaaatttttaaaaaaggattttgttactacataggatactcttacaaattaagaagaaagtcaaacatccaaacagaaaaatgggcaaaggaaaagaaaaatcaattcactaaagaaatacaaccaactatcaaacgtggaaaagtacataacccatctctgataaaaatacatgtatataacagtaacaaacaatcatttcctctttatcaaagtggcgaacatttcaaagccttatcacttctgatattgccaacagtgtggaaaactttaaatggtgcaagtataaagcttgagatagggcaatttggcagtatccatgaaaactaagcagggtgcttagtgttactaaatgatacattacttgaggatacaggagtagtatatatcatagtgacctaaagcataggctctgggattagatggccatttcctagctttgagacactgacaaatttcttaaatttatggccttagttttttcatttataaaatagagattaaaagaattacttcatagagtcttgtgagaattaagtagttttacacatcttataaattaataaaggatatctgaactaaggaacttataataaaaacagtgattaaatttaaaatgtctttgttcatttacatggtatatatcaccctctacaaaaaaaaatgacacttgtctttcaatctgtcaagcttagctaaaaaattcacgtatctcttttctatatcacatattgacatgatataggatgcaagatataaatatcaatttaatagacattattaaataattttacacttagtagaatcttggataaatggttaaaattatagattgacattaagtgtgggcacaggaatattctgtgtataccaatgggtttaacagaagatgtgtttgcactgatttctggtcatcaacttgctttccgtgaatctttaaatacccaattccaaatcttccagctcctggagaagggctgtttctttctgaattttctccaactagaaaagtttgaaacaatgaagttattatgaaataattactggatatgtaaccaaaataatacagaaaaaatggtatttctgacaatttattatgttcactagtaaacacagattttaaaatacaggttagaaacaaattctaatttgttatctggtatgaatcgagggtgaaaagaacagacactgtcttactgcatccctttgggccccaaaaattttcaattctatattcgggcttaaacatgttgacaggaggagggaaaaggcaaacagggcagtacaacttgagagaatcttatatttgtctaatataacaaattgctattattttcagcagtaataacatagtatgcctcttaggaatattgactttttcattcacatgatcaataccatatctcttctatttaagagtaaagctatttaaaagtaaaaacattaaaaagaatatggcatatggttttcaaaataagtttttaaactccatgtgctcttttacctgactaaatacttgtttataataaaagggggaaggctggtggtcaccacaagcctaaatgaaaaatgcagaaagtacctgatttttttctagctgttttccagttgctgcttgttctttcagttgttcgattgctttcagtttctgcaaacatcaaatatgagtcaagagcatggaagaaaagtcacttcaaatgcaaatttccttattaagaatgtgaaactcaagtaaggagattaattatcttagatttgtatcaacaatggtctgttaaaatgctaggataaattgttttttaaagttaaatgcaaaattgtaaatgttaaaaacatgagatttggcaaaatattattctcaggcttttaattaatgttatcgtgtatgcatgtgtatatataaatgtatcagtaatggcacatttcaatgccccattggacctgggtgatgtttctggctttgagagaaatctcaatgagagcattctgaaagattgttggtccaaagtcctgcccgataaaaagtgaatgaaagagaaacctcataatgcagctgtgaagggctctagagacctttttttatccccagggccaccccagcacactggctgcaatatcacaaatcaatacacttcttttttgtctctgtctcttcatcttcaaaactaggataaatatctgcccctaattatcacaaggtatctaatgaaatactgagtataaaagtattgagtgaccaggtgcagtggctcacacctgtaatcccagcactttgggaggctgagacaggcagatcatgaggtcaggagattgaaaccatcctggctaacacggtgaaaccccgtctctactaaaaatacaaaaaattagccaggtgtggtggcaggcgcctgtagtcccagctactcgggaggctgaggcaggagaatggcctgaacccgggaggcggagcttgcagtgagccgagatcgcgccactgcattccaacctggtcgacagagcaagactctgtctcaaaaaaaaaaattaaattaaattaaaaagtgttcagtggccaggcgaggaggctcacaaatcccagcattttgggaggtcgaggcgggtggattacctgagggcaggagtttgagaccagcctggccaacatggtgaaaccctgtctctactaaaaatataaaaattagccaggcgtggtggcgcacacctgtagtcccagctactcgggaggctgaggcaggagaatcgcttgaacctgggaggcggaggttgcagtgagccaaggttgtggcactgtactccggcctgggcaacagggcaagactccgtctcaaaaaaaaaaagtgttcagtatatttctatgctgatgcacactgaattttattactccaaaaatcaaagtactaagagtcttcagacatttatgaatagaactaaaatcaataccattcctaagtgaacagtgcttcatagtgagaaaacaacaatgagaactgctgataccaacttcttagatacctgtctttaggcatctaagtactctcttacttatataattttcatgtatacctttcaatatgcacatctgtttttaagtctctcaccttctttaggttcttgatttttttgtctatctcagggtccccagaaattgactgagagacagtgtttcgtggtgtgctctgtggggcaggagtaggtgccaaatctggactcttgtcacttcttgcttcctgcaggaaatatttttttaaattcaattttaaaagccaaaaacattacagtatttaaatcaacatagctttggcatatgaaatacagaaactaaatatgtgattttatctacattttatataaagaatctgaattaaaggtctcatgaagtatgctacatactcccatgttagaaataaaatgaccttatcagagtaaaccaggaagtttctgtaccagccaacaagcattccaaacttttgcatattctgagatgtgccagtagatagatggtttgaacatatgagagggcttttctatttaaggtgtttaaagtttcactcttacaaggctctctccaaaactataaagaatatgtatgatcaagtacctgtaatggattatgctacaagaataagaatcctacagatattaatttataatcagatcaattcagctctgcaacaaagtaccacaaaacttttttccccttaaagggatgccataatgcttccaatatgatcagacctctgataacttttcttgtccctcctcactgattctgaatcacttttatttccgctaaggtgctgtatactcttgcccctggcctttgtgtacagcagtctcccttaaccatggtttcagtaaccaagcgtcaactgcagcccaaaaatattacatggaaaatcccagaaataaacaattcataagttttaagctgtgtgatgaaatctctcagcatcctgcctagaacgagaatcattcttttatccagtgtatccacagtgtattcgctccccacctatttttcactagtagctgtgttggttatcagatcgactgtcacagtatcaacagtagttgtgtttaagtaacccttattttacttaataatggtcccaaagtgcagagtagtgatgctggcaattcggatatgccaaagagaagccgtaaagtgctccctttaagtgaaaaggtgaaagttcttaataaggaataaaaaatattgtatgctgatttgctatgatttacagtaagattaaacctatccatgaacttgggaagaagaaaaaagagattagtgctagttttgcagttgcgccttgaactgcaagttatagccgtggtcattcaacttaccacacaagcattgtaccatctcacattgtcgcaaaaagggtgaatacaacaccattagatattttgagagaccatattcacatatcttttattacagtatattattataattgctctattttcttatgagttactgttaatctcttactgtgtatcacagtctctatagggttcggtactatctgtggtttcaggcatagctctgcccctccaggataaagggagactactatatattgttccttgtgcctagaacaccttcccccacaagtcacctggctgaaccctacttatcctttaagtcttctggaaaatctccccaccttaagactggatagtcgcacctttcccaggctctcataatgcccagtatttttccctacggtaacaccatattctaccattccccattagaactgagcctctagcataatacttgcttcgttgcacaggctaaataaataaaaaataaaggaatgactcttcctttataattatgacaagatatatattttggtaagaggggaaaaaattatgtaagtatttattggctccaacgtagggtttctacttcttatagaatttccagtggaatatatatataatgctccaggtctccataaccttttactcagagttctgggtaggatactctgaacttttaaagcatcctcagatcctcagggaacatagaatagggtatcacttctagatattcaactctaaaagtctgcctaagagtttttagaaaatacagaattgaagtcaatttttctctttttttttttttttggagacagagtctaggctggagtgcagtggcacgattccagctcattgcaacctccacctcccgggttcaagcgattttcctgcctcagcctcccaagtagatgggattacagttacaggcacctgctaccacacccagctaattttgtatttttagtagagatggggtttcaccatgttagacaggctgatctcgaactccagacctcaggtgatccacccacctcggcctcccaaagtgctgggattacaggtgtgagccactgcatccagccaatttttctttttaaagtcatgttggtttcactttttggtactatttaataaacaattatttaccttctacatgaaaacaaattactgggcactttgagaattcgaaagaaaatattaagtttctcctcttaaggagcctgtaagttctggtaataggcagttttatatttttcacaatataaaattaaagtagaagagtaaataaaagaagaggggatattctgcctatcaaaattcacttttgatatcagattttaaaaatataaaattttagttgtttgtaatgagctaagaatatagctctctaggaagaaaggttaatcttatcatgtgaaaaaccattaaaattaagtgatatataaaatttatttttccccacaaactaaccaagaacaagttgaaatgtctgcattattatacttaaattctagccattctctagaaaggacgtatatatggtaagattaaattcttatgtttcaactcttttttggtaaagtcaacaaacttataaaattatcaccagtttacaaaaatactagttagattacatatatctgactgctctatctttgactatttacttcagagtcaggactaagaaggtctggataaggtgagattctgtcaagggccatttagctttgttccatcacacagccacaacttttactaacttcagccagtcgtccccaaaatacatactgaatagtttatcttgcaagttgaaaacctttgctattactggaaaaacaactcaaaaagcaattccacaatgagggattactggtatcacctttggtatcatctttagtaaaaaacgtgtgtaggtgcttgatgactgtattggctcttttaaaaaaaactgacaggtataaacatataactgagagttgtaaatttataactgatcagcccagctgatcacactattaccatgagctataaagagttacacatttataacagagttacaaataactattatttataataataatttcattatattaattaaatgtgaaattatcacataatttatattataaaatgtataaactaatagaatttgtatattatttatataattaatacaattataatttagtatattaattaatggttataattattaataattataatcatatgtaattatgtaagtaattatttatataataagtataaaggaatcttagtccagtatcaccaatggtcatattaaaaatatcttttgataaagtggaagaaactttgcttataaaaatagaattctaagttgagtgcgtttcagagaggccctaaaactcaaagggcatcttagttatcaagttgttaaggatactactaatgagttgtaatatccagggccagtagaggtccctacttgtactgatgaagggacaagacttgcttttatacaaatctaatatcaaatgcatggaatagatcatttttacttggaataacctaaagctgaccaattaagatacttctggggatgaaacatattaactacaaatgaacagaatggtttttctaaaagtccagattttagcagaatatggttgcataatacaattctataccttaaaatagtaactgcctcccaaaacacataaccagcctagacctgtcaaaattcaagaattatcagcaagactatactgatatagcaaccagctgttaaaaatctgccctttctaggatgggcacagtggctcacgcctgtaatccaagcactttgggaggctgaggtggaaagactgcttgagctcaggagtttgcgactagcctgggcaacatggcaaaactcggtctcaaaaaaaaaaaccaagccaaaaccaaaccaaaaaaacctactcccatttcctgcttgaaaaacatagcgataacctatctttacaaaaataaaaaaattagttgggaatggtggtgtacatgtacagtcctagttacttgggaagctgaggcaggattagttgagctcagggtctggggttgcagtgagccgtgatcatgcctctgcactccagcctagataacagagtgagacagagtgtctcaaaagaaacaaaaacaaaacatccaaaaaccctaccccactgctacagtctgacatattggtgtttccctcaaattcatagtttgggacctaatacccaatgtaatagtattaaaaggtggggcatttggaaaatgattaagtcatgaggattccacactcaagaatgagattagtagctttataaaagagaccaaagagagctccactgccccttccaccatgggaggacacacagaaagaaggtgccatctatgatgaacgggttctcaccagataccaaatctgccagcgccccagcttctagaactgtgagcaataaatttgtttatgaattacctagtataaggtagcagcctgaatggattgagacatgtactctacctgaattgcaaaaatgtgatcaccataacttcactaaccagacatccccagcccagccaatcacattatcaccatgagctatacaatatcacaatttgtcaattatttacactggtgtggcttttcaactacgtaatcaagtaagaaactattttggaaatatcccattatttgggtacttctggtatttcgattcccagttaaataatttcatatagtactataatactgagtgcccaaatggctttctagtcatgtaatttccagcttctcttagtaaatacatgcttcaaggaaagcaaactacaccacttcacacaagtgccaccaaaagggtctacagcaagtaacatgcttacataataccattagtgtctcaggttatgatgtcaagtccagtttcttttgtcacccatcatatagacaggattacttagaaattcataggcaaagacaaaagaaagatattctgcctatttaagtctaactccaactacattttataacgtaagagccaaggttttttgtgctttttttctttttttttcgagtcatggtcttgctctgttactcaggctgaagtggtacaatcacagctcactgcagcctcaacctcccaagctcaagtgatcctaccatctcagcttcccaagcagctgggactacggggtacacgccattgtgcccagcaaaaaatttttcatagagatgggggtctcactatgttgcccaggctggtctcgaactgggctcaagcaattctcccacgttggcctcccaaagtgctgggttacaggcatgagccaccacacctggtcacagtcaagtatttaggaccacaattctttaaactttaaggcttaaagctaacttaactgcctttttttttggagatggagtctctctctgtcgcacaggctggaaggctagagtgcagtgatgcgatcatggctcactgcaacctccacctcccaggttcaagtaattctcctgcctcagcctcctgagtagctgagattataagccatggccaactaatttttgaatttttagtagagacagggtttcaccacgttggccagtctggtcttgaacttctaacctcaagtgatccactcgcctcagcctcccaaagtgctgggattacgggcgtgagccactgcgcccggccataactgactatttgttttgttatgagattagtgccccaaatacctgctttgcagctttcttagcttcatgcttcctttgatttttaagagctgtttttgataatggcttatcgtttcctgattgtggtttcatattctgaggtggttcctcttcatgctatggaaaatgtaaaataattttgaaatggagtccatgttgtaaacacctacaacaacaaattatacacttctgctaatataggataaacttattttatcaaatttaagatcattagcaaagattattttgaaactcattggtagtggcacactccaactgtcaggatggatttaattagggtcttcctattagttcctatatctttcaatcatatcagagctggcaaaattcactttagttttgttcaaacagaatttttcttagcactactacagacacatgattcttatgaaaactagataccaacaacagcttcttctgaggcctttttggttctaactattgtcaacagaaacccagttgcctcgcttgttttcttcacacaaagaattacttgctagatctttacttgtaaaatcagaaattagaagattaaaaataaaagcaaatgaaaaaacaagaatagattataagaaaataaatgaaatagaaaggagtaattaactagataattacaaatctgggattgacatatgaagagaccaaaaaaaaattacatggcttgtcagattacacaatgaagacaatcatttccaacatcagatattcatgtaaccatgtaacaactatattccacaatagaaaagatggtgaattatagattcaatgtatctccagaacagttttagacaacatacagtataagtgatggcactacaactctctatcagattcaggtacttactgatttctatctatattgctattattttaatgttaactgtctcttagactgtaccataactcagcacatcaaaagtaccagctctccatgaagtttcttgagtactaggtctcagatccgcattttacttataagttctatatggaaatgagcagagctcaaacacttaagatgcagagtaataaataagaaaccataaagtgaccttatcttagcaaatgcattaactatttcaggtcatcaaagttctgggtatgttcatattctacttgaaacaaactgaatattatgagaacccacatttgtagaacagcagacaaatttggagtgcaaggctctttcatttcatttttatccatgttgcataaaatgctacttaagttatacaatatttgctgaacatttgttttatacataatatgaaaattctttcaatagtgggctcttctgtagtagtttactttggccgaaaagtttctgctcagaactttgatgaaaaatgatacaagaagaaaagataagttacaagtctcttccacgcttatgagcatcatgtagccactgagagcctttcacttgagacgaaaaaaatccacacaactactataaatcatgagttttttctggttttggtactatgtgctcattacgcataatttcattctcattaataaactttgtttattcagttatatcaattattatgggactgtttttgatgaacacattttaatttctcagctcactgcaacctcctccttctgggctcaagtgaatttcccacctcaacactcccgagttgctgggatcacaggcagacaccaccatgcccaactatttgttttgcatttttagtagtgatggggtctcaccatgttgccctggctggtctcaaactcctgagctcaggcgatccacccgcctcggtctcccaaagtgctgagattacagatcgaaacccccacaccggaccaacgaacgcattttaaaaggtgaaggtttttttggaaagctaataaatattctttaagtataatttatatataaatttttacttataaaaaacttttttctgtgagggacgaaccccaacaccttttttcccctactgctgtgtaactctcctcctttgtgaagttatctactacactgtctttgtttctagtaatttcttgacagtattttctttgtaatttagctcatttctggaattagatacacgtaaacatttctaattactgggcatatagctacttcaactaaaatgatttgacaggaccacacaatcatcacgccacataaaaaagcaacaatttagtagaaatcttaaatgttaacaaaaaaatcctggccgggtacagtggctcatgcctgtaattccagcactttgggaggccaaggcgggtggatcacctaaggtcgggagttccagaccagcctggccaacagggcaaaaccccatctctactaaaaataaaaaaattagctggacgtggtggcaggcactgtaatcccagctactcaaaaggctgaggcaggagaattgcttgaacccgggaggtggaggttgcagtgagcagagatcgcgccactgcactccagcctcgatgacagagtgagactctgtctcaaaaaaatcctgattttaagttcttacctaatttcatcaccattttcaaagtattattttctgtatcaatttctccccctcaccaaaataaacctactacttttatggatcaaagaattgtgccatcatgcacagattcagaaagcaggatgggttggagttacttttgtttttatctgaggtaaggaaaattccaatacagaaataggaaaaatctgaagtctactatatactttctttttaaatctaaataaatatgataaatacaaataaatatcatgttatgtctttatataattttacataaataaaacaatactggttaaatagaacatttcgatggaaattaagaagtttcagaccagtcatacgttttgtttagtccaagagaaaggttgtttttttttttttttttgagacggagtctcactctgttgctcaggctggagtgcagtggtgcgatctcggctcactgcaacctccacctcccgggttcaagtgagtctcctgcctcagcttcccgagtagccgggactacgggcatgcgccaccatgcccagctaatttttgttatttttagtagggacggggtttcagcatgttagccagtctggtctcaaactcctgacctcaagtgatcctcccgcctcggcctcccgaagtgctgggattacggatgtgaaccaccactcctggcccaaaataaacttttttctataaaagtagtaaaactttacttaccaatttggaattggtgattggtttatttcttaaagctgggggtctataagctgttgcaactttaggttcctcattgggtacttcacttggaactgcttggtaagttattgtttttgctggaaatattccatccaaaaatggctgccaagaaacctgccataattctgcatttgatggcacatcatacttgtgcaagatagagccagtataatgccaaattttgtatccattattaacccgtaacctgggagcacatgtagctgttaaaatatgctcaccatccgggcaccaagcaaaatatgtagaatcagaagccaccggtttagaaataagtttgtagtttttcacatcccacacttccatttgtcccctcagatttccaaatccagctaatactaatatatgtccatgagggctatagtaggctgcattacgaggaccagttccaaagtcaaatacaggatcacatttcaagttgaaaattgtcgctttggcaggcataaaaccatatacagcacaaaactcagtagaactagaattccaaactacatcataaatggggccattttttgctagaaaaagaatataaagcccaaattagcaataaagaactatataaatatttgttagcaaaagttaccatcatatagtactcacaaacacatcaaacagataaaaaaatttcaaggaatgttaacattaaaatactcttacattatatactagggggattaatgtataatcataaatttatttaagaacccctattgaatcttaatttcttttaaacattttggtaatatggccttatagtaatagtttgttactattaataaatttgtttttggaaggggtaatacgtgcagatggtaatcaaaatacaaactaatttatttatttatttgtttatttatttatttatagaaatgggatcttactttgtggcccaggctggagtgcagtggcatgatcacagcttactgctgcctcgacttcctgggctaaagggatcctcctgccttggcattccaaagtgctaggattataggcatgagccactgggccctatatttttaaaaatgccacataagaccaggtgcgatggctcacgcctgtaatcccaggactttgggaggccaaggtgggcagatcacctgaggtcaggagtttgagaccagcctggccaacatgatgaaaccccacctctactaaaactagaaaaattagttgggcacagtggcatgcacctgtaatcccagctactcaggaggctgaggcaggagaagcgcttgaacctgggaggcagaggttgcagtgagccaagatcgtgccactgcactccagcctcggtgacaaagcgagactccatctcaaaaaaaaagccacaaacacaggtcattttacacaaaggcaaccctctgttatatttcttggatatcctttcagaatttttttttgtttttgagatggagtttcactcttgttgcccggtctggagtttagtggcacggtctcggctcaatgcaacctctgcctcccaggttcaaacaagtctcctgcctcagcctcctgagtagctgggattacaggcatgagccaccacgccgggctaattttgtatttttagtagagatggggtttcgccatgttggtcaggctggttttgaactcctaacgtcaggtgatccacctgcctcagcctcccaaagtgctgggattgattacaggcatgagccaccgtgcccagcctctgtcagcagtttttgatgatgcaggcttccccctcactatccttcaactatactgtgtagtttcatatttttatcttcatcagcctactaagtgaaaatgtctatcttgttttcatttgtattttttaaattataagttaagcatcttttactgtaagtaattttatttctttttctatgggctgattttttttcttcttctttttttttttaaagagatggtctcattttgtcaccaagactgcagtacagccgtaggatcttagcttgctgcagcctcaaatttctcggctcatacaatcctcccacctcagcctcctagatagttgggattatatgcatgagccactgcaccggctctgaggactaatttttactatcctatgcctattttatttttctccaattattggtcttttacttggcttacttgatatattaagaaaatttgaccttcctcatacttatcacttgactatttaaaaaacatattttccccaactttttgttcattttgcttaatttatggactcttttcttctctcattgtaataatccattattcttctctagtcaaattcattattttttccccttagtacttctatcttgtttaaaaagtctttttctactcttaagattagaaaaaaaattctcccatatattcttctaattcctctgcagtcttatgtataagtttttgacccaaccagaatttattttgtgaagaagataataaccttttgtttcgaatggctagccagttatcccaaaccacatattaaatgatcaatattttctcctccattgattcaaatgctgactttattatatattaatgtctacaaaagtatggatctacttctggactctgttctcttccactgatttatcagttttaccagtatatccatataccacaaccaaactgtcttaattacaattggcttactttttttttttttgtgacagagtctcaccctgtcagcgggctggagtgcggtggcacgatcttggctcattgcaacctcccactcctgggttcaagcaattctcatgcctcagcctcccgagtagctaggattacaggcatgtaccaccacacccaactaatttttgtatttttagtaaagatggggtttcaccatgttagccaggatggtcttgatctcctgacctcatgatctgcccgcctcaacctcccaaagtgctgggtacattttaatatctggtagtgtcagaactccagataacttcccctgccctgctcttcttttacacaagtttccaaaatattcttgtgtgttcatttttcaacaccaaccttacagccagtttatttagttaaaaaaaaaaaatcagttagcatttaaatttagttttagactgacaagagagaaatgacatctttataaaaataattcttcttagtaaaggtcatagtttgtctctctgaagagttttaaagttttcttctcattggccctatatatttgttcttattatttttgctatatatggaatctttcatttttttaaagtagctgttatagtgtgacttcatctacatgagcagagatgattttgttttctttcaaaactgtatatattttacttctgctgattatagtgactaggtatttcagaatgttattaaaataaagtgaaaaggggagccatccttgttttttctctgacttcaatggaaatagtttttttaaaacatagattaccctacttacacatgttcaattcaaaatgagaaaattaggacgctatcagtattttaaaactattattttaaagttttagttcattaaaacaacagatgaagtggtaacattcttggatattattattttgagacagggtctcgctctttcacccaggctgaagtacagtgacatgatcatagctcactgcagccttgaacttctgggctcaagtgatcctcctgcctcagtctcctgaggagctgggactacaggcatacgccaccatgcctggctaactttttctattttttgtagaggtagggtctcactatgttgatcaggctggtcttgaactcctgagttcaaatgatcctcccatctcagactcccaaaatgtgttggaattactggcacgagccaccatgcctggcctcttgcatattactaacaattctaaagacagtattaagcaatttgccgtcataattagctaagtaagttccaaaagagctactacaatggaattaccttactcaggaagttcacttctaaaacgatggcgtaactcaaataactaattgtattctgccaaaataaggtatgttggaggatgatttttaagtttcttaattaagaaaaattttatcttaaaggttattaaggcatatgaattctatcttttgatcaagaatttagattatatcatctttatggcatagtattttttactatcattgtttctaatcaaaggaagactgctggaatactcacgtaattgcactacagcactttctccatttgttgcaatgtagtgtagagtttgttctccatagtaggaagctcctgtcttgtcaacatctgtgctagctattaccaacacagcagtagctataacagtaaaaactttaattagatttaaaacacaaatgggcattgattcttctgttatacacataggaatatagcctaaattaacaactgataaacaaagggagggataaaatatacttaacataccttttttattccacagcattgtaactttatctgccttaaagaaacttttattagctaaagctgcatgaggtccagcaaagttggggtactgatataatctaacaaatgaaggtgcacctttacttcctggaacatagacagccacctaagatacatagacataaatcattacttaattttttgaagaataaaaactgagatggacatgtttttacaatcacaaaaaactaggaaaaggtttaaacacataatattacacataaacaaaaacagcaattaccttgtatggttggggtccaggtgataatacaaaatcattaattttttgcaaatgcaatttatttgcaattgtgtctaaaaaaaagagtaaattaaatcagattgatgagagaacctaaaaggaacatgttaaactctgaatacattatcaaagatcactataactacacaccaatactactcactgtagtctcctcctggtgagatacagtaacacagtggaaaaagcatggggtaggagcaagacaaatgtaggcttcaatttctactcagtcatttacttgcagtgtgagcttaggcaagtaatgggattataccacccaactctcagtaattggttttaagagaagagtgccaggcacatggtaggtatttgataaatgtcagttatcctctcttcaatcgctgaaataaagtggtcttagagcctattagaaggaaaagatcaaccttggcctgctactgcagaatgtggatatggaaattctgtaacttaatgtgataaacagatgcatgataatgatgatcacaaccacagtaacaatggctgatattaagagcttactctattccaggcagtctgagccatgctattattaataaaactgccactctagttaattagatcaagagctaatatactttctttgttcaatttcagagatcaatggcttttcaaaagcagcacaccaaactgtcaaagtggtgatccctcttcatttgacatgctcacaaagaggagaataagacaagaaagcaagctaacccagaaacagtgaggtgacagtgcgcctcaaacacaggaaaataaaatgcataactatactgattggatgctgctcaaaatcagcctacatgccatctttggtacgtgtgaacaaagttaccaattcctattctaactatgatatactcaaaactgtacaatcagtaatgggatgctctaaagacaaaagaactgcaaaccctttttaaaaaattattttcagtaacagtgttactttttggtattaagattgtaagaataccttgtggataatgtggaacaaaccaaatgaatacttatgtgaatgtgatattctcaaattatcatccctggtattccagagtaacaagattcttggtggtgacagaaggcaatacaaataagatagaagttaaataaaaaccttgtagtcttcaatttaaataaaactatacgtataaaactttaatttaaataaaattatgattgttacatcttttaaatagaaaaaaaaggcctagaaacaatgatcaatgcaacagcaaataagaatctctagaacctaaatacctttttttttgctagactcagccaatttttcaagaaaccctattaccttttaatgtttccttcaatgagatcaagagctaatactttttctttgttcaatttcagagatcaatagctattcaaaagtagcacaccaaaaaggcgacagggtttcctgaaaaattagccagttctaggtgtaatggttagaaatgtacaaattaatcctagaatgacttgtcttaccatatagcaaagaagtcactaaggattaattgatcaaagatgagacaatttgagcatcaataagaaaaataactacaatggactgaaacacataccttttaaatccacagctcattaagaatgggactaaaaaggccaggcgtggtggctcacgcctgtaatgccagcactttgggagggtgaggcaggtggatcacctgaggtcgggagctcgagaccagcctgaccaacatggcgaaaccccatctctactaaaaatacaaaattggccgggcatgttggcacatgcctgtaatctcagctactcaggaggctgaggcaggagaatcgcttgaacctgggaggcagaggttgcggtaagccgagatcgcaccattgcactccagcccgggcaacaacagcgaaactccatctcaaaaaaaaaaaaaaaaaaaaaaaagaatggaactaaaaaacagcctgggcaacataatgagatcctgtctctacaaataatcaaaaattagccgggcatggtggtgcaagcctgtagtcccagctacttgggaggctgaggcaggagaattgcttgagcccaggaagtcgagattgcagtgagccatgattgcactcagcttggacaaaagaatgaggcccactctcgaaaaacaagaatggggaaaaagctaattggttacaatgaaggttgctagaggtggaatacattatattaaaactgataagagcaagaatatttatcccgccttttctatataaatgcagcactaggtaaccaaatagtagaaggggaaatttttctttatagaagcagtacagctgaaaaataagtgagggagaaaaaaccagagtatcaacaatttgcaaccactgatgaaataatgcatccaggcatgaaacattaatgtcagctaagcctacaaaattaaagacaaccagacattatgtgcttcttgataaaagaagtgaacatcaccttataatgtagtcttacccttactcacctaaaaaagaacctgaagctgaaactctagagccaacttgcaatttataggggacagatgaacatgttaaattataccatgggatacaaaagcaaaattcaaactatgggaaaacgtgaaagacaaataaccttgtttcttaaacaataaattatgaagaataaaataacagatagagtgggaacttataggaccaaaagaaacataaaagatatatcaatcaaccacaatgtgcagtaccttatttggatcccgagttttaaaaaaaattgtaacatttgcaattagtagaaatttgaacacatatttaataatttgtgataatggttttgtggctaagtttaaaaaatgaaaggccccaatcttcagaaatctactctgaaatatttacaattacatatttaacaagtatataaaagtataaccatatctgggatttgctttcacttagtaagagatggtagctggagagatgtatggatgagataagattggccacaagctgatggttactagaactaggtgtctgaagtttaaaattctacacgataaaatatctaaaaaatttgtgtcacagaatttcaatagcaattaaattcaggaaaagatattcaaatgtcttaatagcaattaccagataataaaaagttattgtaaaagaaaacctttgtgttacagattttcactgaattcagacttataaagaattatgcaaatgtatgtaagagtaattattgattaatagattaacagtatttaggaaaaccctatgatgtcataaaagttaatggaaactgtatacgattacagtaagtaataaaattatgtcataaatctttccatactaaaattgttgttttcaaagaagtgaacttcattgttaacattgcgggcacaaagagtttcatcttctgaccaggatggacacctatgtcaatgaaaaaaaaaaaaagtataaaaaatattcagacagaatgtaacatcacattaacatgttaaagtaatttatgatattggttaccatttaaggaaaaacacttataaacacttataaatatgatattaagtcagttactaatagttttagtcaatatatgttaatagaaaaggccaggtgcggtggctcacacctgcaatcccagcactttgggaggccaaggcaggtggatcacctgaggtcaggagttcaagaccagcctggccaacatggtgaaaccccatctctactaaaaatacaaaaattagccaggcatggtggcacgtgcctgtagtcccagctacttgggaggctgaggcaggtgaaattgcttgaacctagaaggcagaggttgccgtgagccaagatcaggccattgcactccagcctgggtgacagagcgagactccctctcaaacaaacaaaaaaaagaaaacattgttcctttccacttaatactaaaggaaagaaggatcaagtttttgctctattacattcctacatacaaaatccttaaaaatgtagatttttgtctgataagttattttttaaatcaatatcaggaaaacaaatattatacagtgatgacattaaaaatactatgtaaaaaattagtattttaagccatttatttaccaattttgcatttttttctggatgaaagatttcaaacatgtcccagttttcacatcataaagttgtaggttgggtatcccagctgtgccatctttagaagctgcaataaaatttctttttttcagtaattgccttgtaacatttgtaaagggattatttttcttatttattaagtttgatatggattactatcaaatgggttaaatcatgaaagcttgcctctgtgttaccaaaataaataaataaataaatgaaaggttacataacccactcatgattctcaactgattctcagtatctctttcatttacttggaaaaattagattcatgagagttcatacctcttgaaagaacaaaaactcaggaggtttgtaagccaataatgacctattatcatttacttattcaaaaatatcaacattattagaaaatgtttcttaaaataagcccctataactattttattacatgaaacacagttatatgaaatgttcatataatgtattatcattaagtatctctttaaatattttggaaaatggcacaacattttcgactctaccatacacatcccttagatgttttgtctactgtacttcctttcacataataattatttaaaagtcttgattttaaaagtcattattattcttaatcttcagaaatctctatccagcagttatttacttcctgaattttcccttgagctttttcttttcctttagctcataatggctctttacattaacttaccatataccttgaaattactttcaatacattgtttatttggagagtacaagattcactgtagatcataaatattcacaaacactatttactatcataaagactaattactttcttatgaggttataaactttataactttttcccccccactaaacgtaattgatcgtgtcagagtatttttacactgagaaaatacttactagtgtaaggctgccacgttgccaggacagtatttttgggtgagaattcaaggcaaactgccttcaggaggtcgaaggagtgcagtagtcccttgttagtgacactgataatatttactctggtttcaaaagaaattatttcagcaatgaaatactgttttatagtagtcaacactaaccaaaacattcatacctcttttcaaatacagatcactccaaaatgttgactttttttttttttgagatggagtctcgctgtctcccaggttggagtgcagtggcgcaatctcggctcactgcaagctccacctccccggttcatgccattctcctgcctcagcctcccaagtagctgggactacaggtgcccgccaccacgcccggctaattttttgtatttttagtagagatggggtttcaccgtgttagccaggatggtcttgatctcctgacctcgtgatccgcccgccttggcctcccaaagtgctgggattacaggcgtgagccaccatgcccagcccaaaatgttcatttttcataaaaatcaactttaagttggttctagaaaatatgcgggaaataccttaacttcaaaaaaaaagggccaggtgcagtcgctcacacctgtaatcccagcactttgggaggtcgaggtgggtggatcacctgaggtcgggagttcgagaccagcctggccaacatggagaacctctgtctctactaacactacaaaaattagccgggcgtggcagtgggcacctgtaatcccagctactcgggaggcagaggctgcagtgggctgagatcgtgccactgcactccaggctgggtgacagagtgagactccatctcaaaaaaaaaaaaatgtatattttaccaaaaggctcctatataaggctagtgctgggaaatgatataaaatagaagacacatggatgattccaccttcagctgaaaaggaaaaaaatgcctttaagtgaacacaaaactaatctatagagaagctgaggtctatcaaaccaaaggaaaggcagaggtgctagagaaaatggcaaaagtatacttttgttttattttttatttgagatggagtctcactctgtcacccaggctggagtgtagtggcacagtcttggctcacagcaacctccacctcctgggtttaagtgattctcctgcctaagcctcccgagtagctgggactacaggcgcatgccaccacgcctggctaatttttgtatttttggtagagacggggtttcaccatgttggccaggctggccttgaactcctgacctcaggtgatccacccaccctggccttccaaagtgctgggattacaggtatgagccaccgtgtccggcccgcaaaagtatacttttaaatttgaataaatgggccaggtgcagtggctcacacctgtaatcccagcatgttgggaggctgaggtgggaggactgcttgagcccaggagttcaaaaccagcccgggcaacatagcaagatcccatctcaattaaaaaaaaaattttttttaaataaatagaagctatagcagctagggaaatcagtaaggagacatttgatgtctactacaatctcaagagcaatctctaaaagatatgattctaagaattattatggtacaatgacaaaaatgacaataattgtatgataaaagcagttccattttgggatgttttctatgtacctaaccactttatgtacattttctcatttaatccttacaacaatcttacaaatgtcatcatttctgttttacaagtgctgaaatttaggcttagaaaaataaaatgatttgacgatttgctcaagatcatactattgataaatgccacagccaagctttgaaatcagtttggcctgacttactgttatgtactaaacactctggggtgtttaacaaaaaaaaaaaaaaaaaaaagactctccatcttattccagaagttgctgtaagtaactttgttctactcaggtttgaggaagataactgaggttaagataagcagtcactgaaaagaatgaaaaattaccacatagtatttaaacacacacacctaacatggaaatctttacaacttgctgcaaataacctattttagaattacaagacgctttcttgttttcttcttgttgctgttgttaacctttatttttttctttgctttgcaactggagcctactcagaattgatggtctttaagagttattcttagtttaatgaaggatgtttattttaattaagaaaaaacatatttaaggaagaatcagtaacggtttctgacttagttaaccagaaactgaacaaagaccacaatcaatacatgaaatctagttctcttgccccagaacaataagtaccattgtggtcacagcactttaatgaaataaatgctagaacttaatatagaagatatctattaaaatcatggacatgacatatggggacatactaaaaagattcagagttgaatcccatagaaggttaagtgtggatatgagtgaactattaacaataactgccaaggtaaaaacagacttattcaacaaactctaagctagaagaacaaggaatacttcaaaaacaaacaaacaaaaaaagacaatgaaaagaagtatagtatagcccattaggtagtaaatttctattgattcattactcaaatactacaaactaaaatatggattaaaaaataaaatttaagtacccacaataggttacacaaaaaaagagtaagaaattttgagatcacatcctactttttgaggctgagattaaaactgttaacattgtagataagactcattataattatattattaatgatttgagagtagtagattcaggctgggtgaggtggctcatgcctgtaatcctagcactttgggaggctgaataaagcgggtggatcacttgaggtcaggagttagagaccagcctgaccaacatggtgaaacaccatctctactaaaaatacaaaaattaaccagatgtggtgttgtctgcctgtagtctcagctactggggaggctgaggcaggcgaatcgcttgaacctgggaggcggaggttgctgtgagctgagatcacgccactctgggtgacagagtgagaccctgtctcaaaaaaaaaaaaaaaaaaaagggctgggcatagtggctaacacctataatcacaacacttcgggaggccgaggcaggaggactgcttggggccaggagtttgagcctaacctgatcaacataacaagaccctgtctctattaaaattgaaaaaagaaaaagaataaaagaccaattttttttaattataaaagctaattctgccagctacttatagtcataaaaggtgaatcaactaattcaacatgttctctttagtagtcaatttttaaaaagcaagtattaatgggtagtttaaacacttctgaatacattaccattgtaaagaacaatgtttaaaatttacttttcaaactaatgcatgcagtttctcccctttgaaaaacctaacagtattatatgtggtttagaacaatgtagataactttaagccaagcaacaaatatttgggcatttgcatggtctatgaaataaaatgttgtagtaactcttgaaaaattaaaaaggactggttttcttaataaaatataagcatttaatcaacataattttttgtgcaagaccaattttgtaaactggtattttatgtaacatatattatactaaacgttcttttgaataacatacacttttatatacataagactaataataataactgcaggcagttgttagtaatttaacagcaaaggtaaaaaagtatctacatctaggattaaatgagtaaagagaattattttctcagtgttactgcagatttaggaaactccaaccaataacttagagcactgtttaaaacaactcaacttctttagcattaaattatatttttcatatattaatttttaattctaagtaactagataaacaagtcatggcatatacatagaaatgaacaactttgaaggtattttgtgtaacgagaggtaatatctcactacatcatgacattaaaagacggattttattaatgacactcaaatatctgttattcaaataatgccagttgtgtttatattcgtgacacacaaaatatgttatgtaaatgaacactaacttttctccattgccccaggcaaacaaggtcccatccttactaaagatacagactttgcaattcttcccagattccctgaaaatgacaaaaaaaaaaggtttaaatgaataagcattaatacttttcaaaaaaatctgattataaagtcaaccatttcactatcaatttaataactaagaacttgcacaaatttcagaaaattccaaaatgctttcatctgccaaaatactttaaaatgcaatgctatcactgtaaagtaagctggaaaatgatttcatactaacagatggattttaagaaaaaaatagagcccttttgggtgaataagtttgtgtggtaggccttccatcaatttctcatgtgtagagatagaaagtataacaaaaataagaggctcttcacctaactacttgggaatattctatcaagtattcaaaactctaagtactgtatctccgaagtgaagatgtttactatgaatacatcacccagtgataatgaatacccaaatagaaacttgtatctgtgcacatgtagatgtacattagtgtagtcacaacatgagatgagaacttcctggctaaaaaataatttgaattgctaaataacaacaaaagcattgagaactgactgatacatcccttacactatctttgcattaattcatctgcacaaatgaagatgacatttgtgcttctgcaatcacacaataatgacagcttacactcagtttatagataataaaacatttttaaaatctctttctcatggtgcaatggctcacacctgtaatcccagcagtttgggaggccgaggcaggcggatcacctgaggttgggagttcgagaccagctgggcaacatggcgaaaccctgtctctaataaaaattcaaaaattagccaggtgtggtggtggcgcctgtagtcccagctactcaggacgctgagacaggagaattgcttcaatccaggaggcagaggttgcagtgaacccctgcgccactgtccagcctgggcgaaagagtgagactccaccacacaaaaaaataaaaataaaaaaaatctttcccacataaacagctatgatcaagatgttccccatcctatactaccctacacttatgcaactcatttctgaaccttacggcagaattttacaattatctttattaaattccacccaggttttggcctatcatttcagcctactgaggcctacttaaatcttgattttctcttttaaaacattagtcagtccttacattacatacggaagtatgtaatatataaattataaaactgttactaggctatcatctaaattatttataagactgttcagtgagctctgaacaagatcctgtggctcaccaacagtccttccctcaaattaaaactaactcattaatcagctgactttactgaccttaaccaatgacaattctgtcatcatcatgcaacccaaagactttctcatttctcagatattttgccaaaattatgtttacagttctattattctaatgtgtattctattattctgtctggaaattctacccagaaaggaaacgagataagcttgaaacaatttgttcttaggaagctcattttgacttaataaacacccccttatcgcaatgattataaacttactaaactacagaatccagaattcgattattttcttggtcttggcaattgggaaattttgcctctttccttctggtataattttttgaatgaaaaatttcaaacatacacaaaaaatagagaaaaagtatgataatccacctatgcactcatcatcaagcttaagtaactattaactcagagccaattttatctattccccacttttatctttcatgccacaacattccaacgcaaaaactagatgtcattatcatattgctctatacttgattatgcatctctaaccagtgagtatatttttttaaaaacataatcaccaccatgccacttcatctcacaaaattaacttcttaatatcatttaatacccaatacttggattggatatctgggttttttaacagctccccaggtcattctattgtgcagccacatttgagaactactcatgtaaaagactgactaaattctgagtttgaagtttttttaactttcgtagaagatatgtacagcacagttcctactgtataataactcaccaggagacacataaatatctctctgttctactcttagtgatactgagattgtactggattcagtcatgtgcctccttgtatctacctaactcttcctgctgccacgcctcaactattcaatgaagagacctcatctcctaacgccactggttgtctttgaatctgcagagttaagggccatacttccacatggcttccaccatgcactgcggcagcacatggaggagctctggcactcagattcaacccaaacaggctaagaggctgtagtaaacttcttaccctgtctccacacaacagactgttctgaagtacaaatgttccatacagcctttctggagacaaaaattttgcacacatgaccaagcaagttggctatattttgtggatttgtggtcacctcagtatatcccatcatacttgctttaactccttccctgtctcatttccctttctcccctactcctgcagccttgggactgcataccctaatgaagtgtagcacataactttgccatagttttttttttgttttttgttttttaaatagatatggggttttgccatactgcccaggctcatcctgaactcctgggctcaagtgatccacccaccttggcctcccaaagcgctgggattacaggcatgagccaccgcgcccagccagactgggttttctagagtagtgcttctcaaacattaatgtgcatacatggccgggtgtggtggctcacacctgtaatcccagcactttgggaggccaaggagggtgaatcacctgaggtcagaagttcgagaccagcctggccaacatggtgaaaccacgtctctactaaaaataaaaaaatttagccaggtgtggtagcaggtgcctataatcccagctacttgggaggctgaggcaggagaatcgcttgaacccaggaagcagaggttgcagtgagccgagattgtaccattgcactccagcctgggcaacaagagtgaaactccatctcaaaaaaaataaataaataagtaaataaataaataatgtgcatacaggccaggcatggtggctgaggcctgtaatcccagcactttgggaggccaaggcggttggatctcttgagcccaggagttggagagcagcctgggcaacatagtgagacccccatctctacaaaacatacaaaaattagccaggcatggtggcatgcgcctatagtcccagctacttgggatactgaggcaggagtattgtttgagcctgggagattgaggctacagtgggccatgattacaccactccattctagcctgggcagcagagcaagactctggaaaaaaaaaagtgcatataaatcatctgaagatctagctaaaatacagattctgattcagtaagttgggtagggcctgagatgcatttctgtactggctcaggagtgatgccaatatagttggtcttggttgggcccatgcttcctgtagcaaggttctagagaactgggcctaataaaaattggtcagtagagtcagatgacaacagcctgattataaagttccccattaacagtcatcaaacagttcagctaaaggtttcagcatcttttgatgatcatctgcctagatcagtggttcttaaaggggggtccccagatttgcagcatcagtatcactggggaatttgttaaaaatgcaaattattgggccctaccgctgatctaatgaatccgaacatttggaaagagagctgcaatctggattttaacgagcttttcagatgattctgatgcttggtaaagtttgagaaccagtggcctagatccatttcttgaggattacaaaatggtaattgtctgatccagcatccattctccatttattaactggaattcgtctataaaattctttttctcatcaaccacttggttactctgagaaacagtttgtataagaaaggcaagataaatgcttgactccttccctttatttatcaattttcaaagtaatgagtgaggactccatcaaccaccaatgctgaccagttaggtttaaacggaggggggatttttcgggggagcatttatatacttgacatgctttatctttctattcataattcttaatgttcccatcttaggttggtgtgaatctcttcaagttgcttcctacgaccctttaacaaaatctcattagtcttttatagctttgctttctggcacaaaagttgctacctcaacttgtacattttctgtcccagacctagagttgaccacttctccaaggaagtggttccttttagtgaagaattgtatttagagatcacaatctgtgaggatggggtattcactgctactgtgttatcactgcttccaggccttttcattggccagaactaggaaatgcaaatgttttatgaaaggaaatcatgagttcatactgatataggcaagtctatcttttcactctaatgctgaaaaatcttggtgcctaacaacattaatacaattaatttactctatcctatagtagattcaaatgacaatatcaactttcagttaaaaagaaaactattaggccaggcatggtggctcacgtctgtaatcccagcactttgggaggatgagacaggtggatcacctgaggtcaggagtttgagactagcctggccaacacggtgaaactctgtcactactacaaatacaaaaaaattagccaggcatggtggcaggcacctgtaatcccacctacttgggaggctgaggcaggagaatcgcttgaacctggggggcagaggttgcattaagccgagattgcaccactgcactctagcctgggcaacaagggcaaaactcagtctcaaaaaaaaagaattttgcaggtcttcacatggttatgccaccaacctgatataaagctagaatcacttattttagtttcccaattttttttttttttttttttgagacggagtctcatctttttgcccaggctggagtgcaatgccctgattttggctcactgcaacctccacctccgggtttcaagcgattctgctgcatcagcctcccgagtagagtagctgggattacaggcgcctgcccccacacccggctaatttttgtatttttagccgagatggggttttgccatgttggccaggctggtcttgaactcctgacctcaggtgatctggcctgccttggcctcccatagtgctgggattacaggcgtgagccaccgggcccagcttttaatttaatttttaaatttaaaacaattatatggtccaaagtcaaaactataccaaagctctttcacagatgtgtcccctgcatcctgtaactctctcccccgcattctgtaactctctccccctatagataagcatttttaactagtttttggtttacttgtccattgtttctttggggaaaaaaaaattaatctagctagctatatactatgtgcatatatatgtcctccctttttaatatctttttcattatgatttcactaagattactggccatgatttggctatcaaatttgcaagtttttctcattccttaagatacaactcttgtaaaataaaggcttgtattcaattacactagtgtctacactttttcttagtattgttccccctaccttataaataggcttaagttactattttcagatctgaagatcattttccttgatagagaatatgtattcttttcatcttcggtaaatattatacaataaaaatgagttcatctgttcttttcctttcttgttcaaaatacaccaccaacaaaaccattttagattgtactgtatgttccctataacattacttaacaaaataaatcataccttggaaacactgtgctttctgtaaaatgtggtggtccattcaccatgtacagtccttctgatcctcggactaaagaagtaaaataaaaagaaccacaattactttgttaataaagactcagttaacacaaatgtgttttttaaaaaagcagctttagtcaaaatattaatgaaatcattaaatatttcattgaactatagaatattagcaacaaaagggcatattttcttactctgttacataaaatcatataattgctgagaaatacgtaactttttaaataaaactcgaaactttgtcaccactgaaagaaaggcagctgtcttgtggtaaagaggacatgaattcagagcctgacctaagtttataactgcctgtggaaccttggatacgttaccacctctgaatctgtgacctaatctgtaaaatggaaatatcagaacacaggatagctgtatgctttatataaagtaataaaaaaagtatatgtttaaagtttttagaaatataaggcaatattaatatattcacaatttatcaaactaagagaacaagtggaatgagacatattcatttattaaggccccaatgacagtaatagcctaaaaaattaagtggaaacaaagttcaagattaaataatcatctacagaactagactatacttcttatttctatgtttaaatttatttatttttttgagacagggtcttgctgtcacccaggctggagtacagtggcatgatcaaggctcactgcaacttcaaactcctggacttaagtgatgctcctggctcagtttcccaagtagctgggactacaggcatgtgccaccctgcttggctattttttttttttgtagagacagagtctcactgttgcccaggctgatctctaactcctgggctaaggcaatcctccctcctcagcctcacaaagtgctgagattacaggtgtgagccaccgcacctagcctagactatacttttttaaatggttgaattaaatgcttctaaagctgaaccaaataaatagattcatttagtcaacaaatgcttagtgggaaaaaaacgaacaaactacctcctaggccctgtgttgaacattggcgaaataataggaaagaaaatcagccttgtctctgacctcattgaactttgcaaacagtaatcaaataattggccaaatatacggaatcatatacctgtgtttagtccttcaaaggaaaggtatatggtaccactgagggtataaaagagagttttaacctaaaaatggaaggttagggaaagcatccttaagtgttttgtatactgagatgtaaaggatcaatggcagttaacaagcaaggagaacagttaacaagtgcaaaaaccccatggaaagaaaaacgacagagcgtcaaggggatggaaagaaggcctgtgtggctagaggatgatgaagctggaaaacaaaatagggctcaggctaggcgtggtggctcacacctgtaatcccagtactttgggaggccgaggcaggcagatggcttgagcccaggaattcaagaccagcctgggcaacatagggagatgctgtctctacaaaaattagctgggcacggtggcacatgcctgtagtcccagctattcgcacggctgaggcaggaggatcacctggacttgggaagtcaaggccacagtgaaccatgatcatgtcacccaccaccaagccatgttaagttttatatttcttgtagagacgaggtttcactacattgcctaggctggtcttaaactcctcagctcaagcaatccaatctgcttccctcagccttccaaagtgctgggattacagctgtaagccacctggcccaaactgacattttgtacttctaagatgccttgctagatttaattagtttttctattaaataaatttaataaaagcatatacagtttaatttactcctgataagctgtgatacaaagtttattagaaaaaaacacaaaatcaggtccataacagaacataaactgttttaaactaataaaagcaaaaataaatagggactaaaaaacttctcaatactgaaacaatttttttctacatgtaactttctaacaaggaatcctttttagttacaagtatctgtgaaactaaatacaatgcgtagttagcttaatatagtgtattctgagtttgtgtgattccctgtttttagtgatttccctcttcaatcaaatgggattggcaatatgttctagcagaaagaaaaatctagaatgcaagcagttcttttaagacaacaaataaacgccagtttcacacagtagctgtgtgaaatacattaaacatctacataatcttttccaagcttactagcctttttagacattcatatactatttattgctctaggcctgagttagagagagaaaaacacagggcttcaataaacaaggatcccatggcaggggtgtagtcatctttaaaatacgatacttttcccaactcttacattcactgaactatgtattagtttaggaaaatcactcaattttgaataaattatctctgtgacttcaactggtcaagcagattagacaatgtgaatttcacgtaatggacattgctgttttatgtgcctagcaaccagctcctcttctttaggaggcgctcattttcttttgaggagtatcgaggagtgggaagataatttagtcctgactacatgattaaaagttgactgatacaaaggtgagccaagcaaagtcaaaggcagctagccttgagatttttgctgagactactggcaaaaatgtgttctttcctttggagctgggcatttggttgaatgtcagtttaaagatgaatttaatctggaggaaagcaagaacctacagatgaagaaaaacagatttctggccaggcatggtggctcacacctgtaatcccagcactttgggaggcagaggcgtgtggctcacccgaggacaggcgttcaagaccaacctgaccaacttggtgaaaccccaactctactaaaaatacaaaattagctgggcgtggtggtgcacgcctgtaatcccagctactcaggaggctgaggcagaagaattgcttgcacttgggaggtggaggttgcagcgagccaagatcgcgccattgcactccagcctgggcaacaagagcgaaactatctcaaaaaaaaaaaaaaagaaagaaagaaagaaagaaaaacagatttctgaagccatgtgagtatctggatctagcagtactgaggcttttaggttatacgagtttaaaaaaaaaaatccctttttcacctgctttggcttgtcactcccaattaagagttggggttaacaaaatttactggctaatctgcaaattattcacagctctaaaatcccacgagtctaaatttaacaaaagattttggaagtaaaataatctattgttgaatgaaatatgtacactgagaatgtttaaaagattaaacagtttgttctagtgaaagaaaaatggaccacagagttgaacaatctgaataagtataatcctaatcctgccaatttgcagtgtgaatcggaccacttaatctctctgggcctctaagaatatgagaatatgaagagtagactgaacagacaacatttaagctcttacaaagtccctgattttaagcactgtaagacaattgtcatccttggttaatttactataaagtggctatccttcattaatttaaaaggatagtctaaacagacaaatctaatctagatctcttgtatgcacagttcaaaatagggtttgcgctcttatgaggctctaatgcccccactgatctgacaggaggggaagctcaagtggtaatgcttgcccagtaccagtccggcccagggggttggggacccctgatttagagtatctattgtctaccaggcactgcactagtactgagaagacagatatgaataagaccctgtcgctgacattgaaggactcacagtctagcaggggagaaaggcaagtgaatgtctaattatcctacttagtaagtgaaataaaatttcaaatatatttcaggtacaaaaatagcccaggaagtgactgactctatctgggtagagtgacgaaaggcttcacagagcaatgatatctaaaatgaattttaatttcaacagatgaaaaagagtttgccaaatcaacaagaggcataggatagtactagactgaagaaacaggttgttcaaagggactcagaagcagttcagtattgatggagcaccaaataagatgggatggcaaggaaataaatgagtctcaagagcaattcaaagattataaatggttacataactatgctacataggatggaatctaccctgtaagcagagaggaactacctactgtaggcatttttaaaggaggggttatttatcagattttagaatgtaattttttcattagagttcaaataagcatttagtattaaaaattgtgaataacaagctacctttacaaacctaaaaaaaaatttattatgtaactttgccttttaaacagtctttgcctggtatattatctagaagattatactcggcgtttgataaatgatgactaaactgcagaagacagactgagcatcagtgggcatggcgcttaataacaaagattttaaaatgtaaaaatagaaatgtagactggcaaaaagtgcaaaaatgttttaaggttcctttcgcgggggggaagggagggaatagcctccctccttaaatgcagacaacctttctcttaatgactttttccttctatatagttatcagaacttaaccaaaaccttcttttccttcccgactctcttttccttacgtaatactcatatgcagactcttagccacaccctagtaaagcaacttccccagcattttccaatctaagtttattatctcctccaacactacagtctttagcttcaaaatttcaagagtcctctaatgttctatttctaatatgctcataaccatttcaaaatcaaatgttgctagaatatctctatcatgctcactgctacaccctctcccaaccacaccttcatcatttgaaacctgcattacagctccactctccctattcagtcctacaaacctcattaaggcaggaaggccagaatctggaattacttaagtccaggtgtatttaaagtgcgtgatcattctagaggactaactcatgtttgtctttgttcttattgtagacctaaatgacttcacaagggcccgtgtaacaccagtattgcagacccatgtgtcacaaattcaactagcacattgtttttctcccccttcttctatttctgtagaagatgaatccgcaggcaagaatgatggatgggtgaaagggagggggaatacgaaagcccagaggcggagacttcacttccgattgccacgctatatcaagaaagccaacagtctggcctttccgcaagccacaagaaaaggcagatcagactccccggctcctcgggtagttctcaaaggcaaagacaaaaataagaaactagtctgaagaaagagagtccctcgcttcttcagaactcacctgtcaagagcggcgtggacggcgccatgttgtcccggaaagagaaaccgctcgggtgagagttcaccagggccgaacccggcccctacacgtctcctcatgcgtggagacagcgaattggtgtttccggagccatcagcctcggggccaattcacttccggttacggagtgacgcggaaaaggcgcccaaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcggtaaggaaagagcgggcgcccctctgcgttccgcagccggagctgagtccgggtccctggggccgcgtcgcgttttctcccggatccggccgaccgtgggctggtgccgtggaggggtaggggcccgagtctgcgaaccgccagactgtgggggctcgggaacggaaggggagacctgtgaggtgagggggccggcgaccggcgtgcaggcgtgggagcctggggtccgagtggtttctctgcatctgaaatggtggattttcgcttttgcagagaaatgcccccgaagagaaggcgtctgtaggaccctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaatgttttgtaactccattatcagtctttgcaaagaaaattataaatatgtactatagatgttagaacttgatttaacatataccagaatctaatgtcttaatgtcaaaattgagtatattttataaaataaagcttgtgcaaagaattgattcactatagaggaaattacctgattggcattttaatgtgtgagtcaaatgtttttaggttaataaaagaaacgtttgatacatggtttaaaaaaaaagtgtcggggtagcctgctgtcccctaagagtaacagacacttgcctttgcaaatagattacaaaaaaaaggtctttcctctcttcatttatcattttaatatgcaagctgttaatattgaagtagatgtttgttttccacattctaaaattactgagatttctgtttaacgtttcactttgcctttcttcttcacttaccaattggaagctttcctgataaatggatgagagccaagcagtttatataacctgaagatgattgaatttcagctttgtgagaatgaggaaacatgcatgtgttacaggccaggccttaaaaggatgcttataaaccaaaataattctatgctggaaaaacctgttggctttggtgctttaagttctttgtaaaatgattacttatctgcaagttctcttggatacttagacataaagttcagcgaagctaagataaaaaaataactcagggatatttcattgttttatttattcagacaggcctgtcttcacttcttattatactgaagttatgtaccatttgcaaatgtaagagtacctttggattcttcagctaccttaataaatatttgttagacaccagacctattttattcaaagcttattttaatatttgctctttctttttacagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttg

SEQ ID NO: 35728 - DNA, 60664 bp, Homo sapiens; identical to SEQ ID NO: 35727

SEQ ID NO: 35729 - DNA, 60664 bp, Homo sapiens; identical to SEQ ID NO: 35727

SEQ ID NO: 35730 - DNA, 17681 bp, Homo sapiens
gcagcccagccaagcactgtcagggtaagtggcgccaggccaaggatgtgacttatagattccagtggctcttttaattacccggtataataagacatcatctgcagggatttggctgggttcatgcactgatatttctgaatgaagattgtactactaaaatgattgtagcttttggctttaatgatctaacgttaaagacagggctaatatgtagtttggtatgatggaaggggtagagaagaatatgaaaattttattaatgcatgtcttctgtaaaatgttcatcctaaacaaacagcccagatcttgcagcacaatacaggtatgcaggttagctgtgtgcagtaagttatacatttatttgtatttaggcactggaaactcagatttctttctggttctgatttgttgtaggggttttctttcactgggctgtatttttggtgcagcttaggtgtctggaagtggattttggaagtgaacagaagaatagttgcctagtctttgattgtgcctgaatttgtgtattcccttctgggtttccctggctctaactggtagtgtcttttgttggaaatgtatatctcttttttgttggaaatgtgtatgtgtgaccttacaagtttggatctacatcattggtcatttgcagcagagcgcagcaggtgacctgctgaatttttctctggaaagaaagagggagggagcagagcctgcatctgacagctgtgtgtgcctcccggccggatatctggtttgcatctccctcagcttaaagctcccttcagcctggtgaggcaagtgtgactgtgcagccagccctgccaacccaggctgagtttcactgcaaatcaaggtttggcagcttcagcccagactggagttttcatgctgagattttcctagcattttgtgtttcatgactaaatatggtttgtgtttcaagaccaatgagctgggaactgtactgttctttcccctcccatcaactcatttttggcacaagacgcactctagtcagttggagcaaatcccctgacccgggtgcagttccaaaagcagacactcgagcgtgttttacctaattaggaaatgctttgctccaaaccgaactgctcattcaggttagagaggagctgtaaaccactgagctgactctttccggggacacagtgacttcttcaatgacagtgctccttttggacattataacattcttcctagattttctttttctttttcttttttttttggccaagtaaaaaacatttttctgcattcttgctgatgctgagggccagtctcctttttctgagtatagtcaacccctcctcccaagccatcactgcccaacaaaacagttattaaaaatatcccagcattcatggtaaccataccttcccattttcagagaccatcctaatttgaaatgttttatcctcttttcagcccttacttttggtttggaaaatgcacttagcacatccatagagtgcctgcttatcccctggggctggctgcttctgacagataccccaggctcttaggcttcttcccttttttctcctttatagttctcgcctcttttctaaagcttcttaatctgctctgagggaagccaaatcacaggaatgccaaaataattcagcatctggaaagggaaaagaagggtgggaaaggaaagggcaagccattcatgagtcccatgtccattcttgcaagtggaatccacacgttgattatttttattctaagcctggagcagtgtggaaagaaagcaaaggttagaaacaaagagttctggataatgaaaataatcacacagtgatagtaataataatgatgatgaaattagtatttattgagaacttagagtatctctgccactataaattattttaaacactttaaaaaacccaatctctataagaactccatgaggtatgtcctgatatcattactgttttatagtaaggaaattgtggtttagagatgttaaataactgaaatcacacagcttttaactgttggagcctggactcaaatccaggcagtctgacttcagagtctaagctcataatcactgtgatctgaaatcttcgttgtcctaaatgtatcagttcaaggctcttggacaagtcacttcaactccttaagccttggtttccttgtcagttgaagataatattacatgccttgactttaaaatatgtcatctcaattgcagttttatgttctttgcaaagagttattttacatgaagcactgctaaggaagttttaggcctttggcaagatgcaggtttgattttgtgggaatgttttggcagaactccaactctgtaatagctattttatttccctacttctcagatgtttccttaaaagaactgccttttttatatggatttggaggtgcaatcagttaacccatttagaagaagaaattttctcaatttgaaatcctaattgagatctcaatgccaggcagataactctgggtgtccttctcttaacggaacatttcgacctaattgtgattagaaaagtggaagaggtcttgaactggaagccaaggggtggctaaagagtacctgatgtctggctggagctctgcctctaatgccctgtgtgcccttgagcaatcacttcctgattttcttatttgtgaaaatgagagcattggatgaaaatgtcctctaatatgccttcaatttctcaaatttgtaagttgataggctgctccagcctttctaattttatgaaaggatccaagtataagatccaagtataaaatgggttatttaaaattttgttttattaccaaagaaatacacattcaatatagaaaattaaaaaaatatgacagaaccatgggaaaataattaaaaacacctataaaacccaccacttcataataacctcagtcaacatcttggtaaatatgattaatctttttgcaatgcataaaaaatacatttttaatgagatttacaatgttactttttctaacctattactcttacataagaactaccttttgcttatcctcttactctacctttttaatggcagtaaagtattctaccatatgatatataatccatcaggctcaccctcacttgttggactgttagcttaacagtgacttttattaacggtggataattgcagcccctaaaatttaaagcaccttctcagaaaattttatttcaaagcttctctgagggtaaagtaaaagtcctcatgattcaaaaagatttttccattaaacacttgaccattttaacatttctaaatttttacatgctgcctgtccctcaaaaatctagctttttgaaaaaatttcaaaaaggtatagcatatctagaaaaatgtgcatttgggttgatacagacaggaaaatctagatgcttctttaacataaggtaggcaacttgtctctgcaaagatctggtctcagactctggatttcccatctgtgctctgcagtttgtttattcattcactggctctatccacctttaaagtgctcacgagaacacatgatatgccggtcactacactaaggttgtatcaacatagaagtcagagtttcagaagtcagagtttcagcttactgaaagcttatagtgtaactaaagtacttccagatacatgctatattagataagggtcagaggatagcactaggacacagaggagggcccccaaacccagccttggaggtgggagttgtcaggtaagtgccacaaatgcccaattacagctgaggctgcttcctccctgttttctatagaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcaggtgaggaaaattatgattggaacataacaggacacagattaggttcctctgtgttcatgtttatccccagattgtctatctctttctgcccagaagttatgtaaccttgttacaaatagacctctaatgattaaggtccaggagtaaatgccaatttcacatataatgtagacagattatctgatgggcatctatcagatacaaagtctgcccctttttcatgtcctttttgtctaaatatagtcattatcatcatcatcatcatcatcaaatcatttcatcaccatcagaaatgcttatacattatcctgatgtataccaaagctactgtttggaaagaaactaaaataaaagtccaggtcacttaaccatacagggctgatgttagatgaaagcaagcatcgataccaaatgcaattttacataatattacctgtcaacaaaatatatttggacagccgcatggtaattttacacattatgtgtaaacaaagtattggtggcatcacatggtaaaaactcagtaatttcacctcagaaattcttcttcacatcagaaatgtagtttgtgcattgaggctatctgattgatgtttatgcctctctgcttgggatatattcatgagaataaataatagaaacctctcccaatgaatgcagtctgtctgaattcattgatctttatgcagtggagatattctgcacaagccgctattttatgggtccatagtagccatggctgttttgtagttctaaaatagtcactgcagtgcaatttaaaatctagtaacaataattttttaagaacttcaccttaatgattttttttaaatgcagctgactaatttaggcaaatgtcttaacagttgattggtatgaacttatccattagaaatcaagcctcaagtggttatttgtagatgcaatgcttttgcttataatagttagaaaataatgctcatattcttttgggtaggtgatgactttaaaagtacagtttaaaggatttataagacacaaaatgccatttaacaaatatgtaaaattgtatacattctttcaacaaataattattgagtgccacatatgtgccatgcaatttgctatagtgatggacaagacagacatgatctctgccctaaaaaagctcatcaaggaacataggagataaaaatacaaagtaaagttgactttcccccaacatctcctgttatttggaggcaattcaggtctttttccaatcaactgcagaattttgcttaagagcatagtggcaatgagactcaatatgtttattgttgctgataatcagaagaggaacttcccatctcaatgacttaaccttttgtggcttggctgtaattgattcacaagttttgggagatgctgactcataatgtgttgaacctttttagggggtgatggtgggaatgggacaaaaagacagctacgtgggtgacgaagcacagagcaaaagaggaatcctgaccctgaagtacccgatagaacatggcatcatcaccaactgggacgacatggaaaaggtatgggaggtttgctgcagcttgggccctcaggatgcataatccctgtgttctctgatacagaacaccacactactgctggggaaataactggctcacattgctcaactgtacttttacttgttaatgttcattctgggttattacccattgaaaaaaaaatccttgtagccataaaaaatgatgagttcatgtcctttgtagggacatggatgaagctggaaaccatcatcctcagcaaactgtcgcaaggacaaaaaaccaaacaccgcatgttctcactcataggtgggaattgaacaacgagaacacatggacacaggaaggggaacatcacacaccggggactgttgtggggtggggggagggggaggaatagcattaggagatatacctaatgtaaatgacgagttaatgggtgcagcacaccaacatggcacatgtatacatatgtaacaaacctgcacgttgtgcacatgtaccctaaaacttaaagtataataataataaaatttaaaaaaaaaagaaaaaaaaatcctaaaatgtttctttaaaaaaaaatcccttgccaggcatggttgctcacacgtgtaatcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggaggctgcagtgggccaagatcctactccagcctaggtgacagagtgagatcctatctcaaaaaaaagaagaaaaaaatcctgcagggcacagtgactcacacctgtaatctcagcactggatcacttgaggccaggagtttgagaccagcctgagcaacatagcaaaaccctgtttctactgaaaaaaaaaaaaaaaaaaaggtttaattaacagtgtgtggtggcatgcaactgtagtcccagctactcaggaggctgaggtggtagcatcattcgagcccaggagttcgaagctgcagtgagctgatcataccatcagctgttgcactccagcctgggcaacagagcaagactctgtctctaaagaaaaggaaaaaaatgtccttgcctattaggttttattaactaattaaaggatgatagttctgtagatgagaagagtagccctttgccactgcagggaattaatcatctgttgctcacgtcaactctgttgccctcctaggacaagcagtgcatgagcagcagctcagagaatgaaaaccctcctttcattttcatcaggggctgcatggttatccctctcagtgcaatatagctaaaggggcttgaaatgctgggagtagtcttaaacagcccattcttgaaaggttttcattaactcactctaaacatctaaattaaaaatgtttttgttttcactatagtaaacaggagtgtaacattgcaggtttggtacatttctgaatgcctctccacacactgaagcacaagagccactgaaaaaagctatatgataaatattttaaaaattatttatctgtgttgcattacatgaggccttatctcccagacacttaataaaagagctaatgagaagaagagctaaattctaagattttgatgtttggtcattaaacattacagacaccagtgatcagagaaaaaaacagaagaaataatgagaaagtgacataaaaaattttaaatgcagcaagatatatcagaatcacgatatctggccttttatttatctatcggctcactactactactacgcacacaatttatcacttaaaagaaaaatacataatgttgttagaatttatcagcagtaatgctccaagctctatctttctacaaaaatttcatatcagtaggtttgcttgaggattctagatttggtaagattgcagtttgcacagagaaaaagatatcaatatcaataggaaaatattcttttagaatttctccatggagctgacaacatcttagaatgtatcgtcctagacagagactattggaagaaaaaactttccttatttctaaaatttaaattcaaagtatcttctggtggggacgaagagagagagaggagaaaggttgcttgctgtgactggcaggattttttgagcagtctgctgctttcactccactaaagaaacaaaactttcagaagtttcatttcccttctataaaccacaaatccaaaacaaaagaaagtggaataagatagtctttaaagctaatcttggttttgctaatttgtaagctttcaccagcagttcttgttttgctctgttttgattttgagtgaatctcatattcctggctctggtggagaattttcgtgcttttaaagattaattaatttagtcctttttgcaatggtttgttcttttcggcatctaggaattaaagaaagtgctcaaccataaataaatgtagttatgtccaaagtaccttcacatagacacactatacacaggcgtgggccttttggaaacacctgaaggccaaatgtctgactgtgagtggaagatccagagtgtgctgatagaggaagcttttctcatccctcgagagcaaagagggtgatggaggcaagagtcagagagccctgttctcttcttcatgtacactgcaaagggcaacttctctagaagcattaaaagtgtcaattaggttttcaagtaagcgtcatttattcatatatacattcatttgtctttttatttacaaaattaaatcattttcccatgaacattaaaatgggaagagagaacaaagaaaatagagttgaataataataacattgattctggaccagacactgggctggacaataactcgagggttaccttatttatttacacaaagacccgatgaggtacacactaattattttcatctccctattaccaatcatgagactgaagctgagaagggttaaaaacttgcctaagctcacacaactaagaagtgtccgagctgggctttgaacccaaggtttgatcaagggttgtgcccttaactgccataccatcctgcctcacagatctgggttagggattctgctcagtcacttagtagatgtgaatcctttgggaaggtacttacacactttgagcttcagtctctgcatctataaaaccatggacacatgcatgagtacttgtagcatttcctttggtcttggtttcaagtagcttctggtccctttttgggaaatgcaggacctcatgacagcacatcattgtgtttctcctctgtcccccaactcactagatctggcaccactctttctacaatgagcttcgtgttgcccctgaagagcatcccaccctgctcacggaggcacccctgaaccccaaggccaaccgggagaaaatgactcaagtaagtatgctaccccagcacacaacactgtggggtctggggaaacttctgttagaaggaggctatgcagcacagcagagagaaggccggagctaggagtccaccaacagactaacagccttcagtgaactcagggatcccaaaggacaggaacagcttgaaagtacttgcatccttcctgcagggaccagccctttgcctccaaaagcaataggaaatttaaaagatttcactgagaaggggccacgtttaagttataatgtctaaggagaagtcacttcaaaatgcagcatcacatacaataggaatttgggttccagagtcagacatatctaggtttgaaaactggatctgccacttatcagttatgtgaccttaaagaactccgttaatttctcagagcctcagtttccttgtctataagttgggagtaatattaatactatcatttttccaaggattgatgtgaacattaatgaggtgaaatgacagatgtgtatcatggttcctaataaacatccaaaatatagtacttactattgtcattattattacttgtttgaagctaaagacctcacaatagaatcccatccagcccaccagacagagctctgagttttctagtttggaagagctattaaataacaacgtctagtgtcaattctatacttgttatggtcaagtactgggctcagcattttacattcattgtctctttaagttctagcaatgtgaagcaggaactatgattatattgactacataaatgaagaaattgaggctcagatacattaagtaattctcccagggtcacacagctagaactggcaaagcctgggattgatccacgatcttccagcattgaagaatcataaatgtaaataactgcaaggccttttcctcagaagagctcctggtgcttgcaccaacccactagcacttgttctctacaggggaacatctgtgggcctgggaatcactgcacgtcgcaagagatgttgcttctgatgaattattgttcctgtcagtggtgtgaaggcaaaaaaaaaaaaatggttggaaattatggcttgctagcaaatgatgtcagacattctggttaatagagtaggaagggtcttacagatggagaaatgaagacccacggacatctcctgatgcacaaacttctcacaagtgacctggaggggcttggttctaatcttgtccctggactgcaccaactggggcactgacattctatgtggtcctctattaccattgggctggtcctgtcttccaggaaccagggcctctcccactgcaaccagaatggcctcagattctagggttagcattgacccagtaactacataaaaaagtggaatagattaaatagaacctcagacaaatcacagaaatggggctaaacctagccagcctgagcttcagatttaaaagttctctttctttataccagggaaatcaaaacctggatgttgtcttctctttttcttctggctttgacatagttaacaagccctaggatgtctgcactggaaaaatgggagatctcatttagtccaaactcctcctctgttaagagacctggaataaagccactattaatcaactattagtttggtgactattagtcaaagccaggaccagagccagaagctggactttcctttcccctggccaaaccttgtgtgcacactgtttcttcccctccccaccctgtcaggccattgatgtgatggctccccattcacaccttcatttctcctctttaacgtgaccagggctgttctgaacctccttactttggcctcctctgcccagaacaggtcaggcccctctgcatccatcaaccaggtgtgctctcctgaccattctttgtcagatgggcaccttcactaactcagctctttggattgctttgcagattatgtttgagactttcaatgtcccagccatgtatgtggctatccaggcggtgctgtctctctatgcctctggacgcacaactggtaggtggctgggcgggacagcaagctggttggagcgcactgccagagatgggattgaatggtcgttaacacgtgggggtgacggactggagttgagttagaatggacacggctgaacccagccctaaaagatcttcttctagtgttcaaaataagcccttgatctcatatttctagcagaacttttttctactgttttcctcttcctgttctttactttttttcatcttccccgagccctgtcccacctcacctctcctatcacatgccctgttttctctttttaaataagaggctcggaaattccctctcccccaaggcttccctctacttgtccagcaagtaaccacatgccagctgccatggtgacttatcacgcccaattgtctcccaggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactggtgaggcctgtgggagataagggggagaggggagcagtgtgttgctcagtaacttccaggaccatcctcactatccaaggagatgatgggatgaagttttgcaaatggcaaggcctggctctaatgcacagagcaaagcacatctttctttgctgtgtgaagttgcaaaatgattacactatttccttgaggagaacagttatagacacccagtgttatgcattagtcagtgttgtataattgatctttttttaatcccctccattagcaaatagaagaagattgtgcagagactgaagatggcatggtgtggtgattggcaggagacattgtgataggactcgagtcccaactctgctactcagtagctctgtgagcttggacaagttaaccaaccatagtctctttatttgtaaaatggggataataatagaccctatatcacatgattgttatcagtattaaatggaagaacgcatgtggaatacttgacatagagtaagcattcaataattgttagctattaacagtgatacttattaatagctaacacagtgacatatgtgtattcagattctaagccggtgcacccagtcctcccttcacaagaggaaagtgtcagcattgccagaaacattgtatgtcctcagtgctggtggctccagctacctgtcctccccttagcaatttggtattgtccaaacatttaggtttctgaacatgcctgaggcttattttatgctccaaatttgaggcttgagacttgaaccctgccaatgttaaagtctccacttgcaatatgaagttgaataattgcattcctcctctgctccctacaaagaatcccaagatgcctctaaaaggttcctagagcctcagatataattaatagcctagaacttcagagagcagaagtctgaaaggtctctccctgcccacttcttccgtatctcgttcagtatgcaccgctgaaaccttctggactaggcctggtcctgagacagcaccacctctttcctggagggtgagaaatgtgccaaaggtttaacctgctatccactggcccaggcaacaggatctcagactttttgaaaattgtgaggcccctgaggagctgattcagcataagatatcctggttaactgaaaatacaatataacaaactttctgtcataaaataattataacacagagtagttatcctgcccacccaccccaaaaaatgttatggtacaaaaggatccgctactgtgtgcctttctctagctagctcattttattcttgttatgcatttcccagacaatgcatgctgagggcctactatgcatgagacactgtcctaggaacagaggtggttccctggtggccctactacgtcattatcattgtggattttggattgcagaatattgaactgacacattttttgatggcacatgtcttgagggagagactgcagtagggcaggtgaatctttgccacctgtgcagaccctaatgtttgccacaatgtttgtatctggttgacagctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcggtaggcaacaaacgcccttttcctgggaaggggagtcattgtcttcttccatatcaagccagcctccagaacatggagacaagtgacggttgccccaagaccaaaagcatttctaaaccagaaaaagggaaagtgccacattttcaaggcgagaagacataatgaggccaggaaaaaggttttcttcctaagaaaacactatctatgttgcagttaagcccaaagcattcatggtgtatgatgaaagaattaaataatgcctgtgctttggagacagcggaaagggtagcaagggtgtgctgaaggctgagaatttgggaatgctgggggagagaaaaatagaagagcactcaaagtgagtctgttcctacattcacattgtcttggagagacaggtttgcatagttgtttacagaggcaggctctgagaggggtgagcctgggtttcagtcttagttctcttgatcttgggaaagtcacttaacctcccaactagtctcctcatgtataaagcggagactgtaatattacttatgtcctaggatggctgtgagaattacaggagatagataaagagcacttagcccactgcctggcaaaagcaagcattcaataattatcagatatcactagtaattaataatcaggtagtgctattgttaacgttatcattacatcacagcactgcagaagatgaaagggcacctagaggttttttgaaaacacctgcgtcagaaattaacaaaagtccagacccccacccccacccaaaaaaaatgttagcaagattggaaaaatgagccttttccaacaggataaaaaatagagtaagtttccctgataatccagccccattagctttgggggctggggcagatgcaacgtagctgttaaatggagacctgggagagctctgaagagttgttgcaacattggctcagcgtggaagctttgcagggaattggaaggcttcatcccttatttaaaccacatggagtgagtagtgagtctattaaaaaatcagtgatacctgttgtagcccacacctcaggatgctgcagcaggccttcctcattagaaggcaggcaggaagacatagagcataacaagacccttttgtctctcagacaggtggttcctagattattatgtcttcccagcctcagtccactgcaagatcatccagatgttcaagtctggtcttccatgtctagcctgggttttactctccacttaaggaccatggcctgtgtctcttttccagggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaaggtactgttcagtgacagacccagtggcaatgccgccagcagtgtcagccctataaccacagataagaactcttcagagactgtattttggtgacatgcaattgtgggttttaggggtaggtaatggacacaaatctcatattttacaggatgtaagtcaatctagttcataagaaaaattgagttactttatataaaatttgatctctatttatccttgtctgtcagctactttcagtagctgcagtcaaagtcaacagagctccccacatgctcatctctctttaaaatatgcattttgttgtttttctcgacacaaaaatagtgcatcatgcatgtaacacattttttaaaaatactgatgacctagacttatttctgaagaacttcaaacactgtagatttaggaggagcttatactcttcctccactactaacctcaatcctgtggccaagaattcaaattttatcctcattcctctgtctagcacatcttttggtacaggtgctcaaaagcacagaatgactctaggatgaccaagctcagtccctgagccacccaggacccctgtatgtggtgtgaatgttgagccctagtgaagggaactcggggattaaatggagataattctttggaggcaaacttaacctgtggctgggtcacttctcaaaggttattatcactctctgaagtcagaaggccacacttgggaccctctgacccatgtcacaggaagtagaggggcaattctagtgcagttcacacacgtgggtatttaaacaaattatctcctctttgcactcccttctgtttttagaaggagtatgcagctaacactagagagtgtgctagactgaaacatgcacactttctctctccatgataggctctggctagtcctgccctaaaagacttcagcatgagagaagagagactgttttccaacagcgtttgtgtttcttggatgccattctgatcagctcttaccccccttacttccacacaagagggaggtgaatgaagccagtagctgggctcactactgagttgatctcatgagggtcgataacagaaagaggctattgctagagttgggcagttcctagttctctaaacttggtttcttgaatagaaattaatgtgaaactctgggccccgatgtaatgagatagtatagagaaccaagaaaaacctaggacaataagatgataacatttggcaaaaatgaaactggatgagagacctatgggaactcccatagaatttgtcataggctgttcttgcgttgctataaagaaatacctaagacttgggtaatttgtaaagaaaagaggtttaactggctcacagttcagcaggctgtacaggaagcatagctctagcatcagcttctggggaggcctcagtctcagaaagcttcgaatcatggtggaaggcgaagcaggggcagacacctcacatggcaaaagcaggggcaacagagagggcaggggtggggggagggtgccacacactttgaaataaccagatttcatgtgaactcggaagaagagctcacttatcaccaaggagatgtcctaagccattcatgagagatccacccacgtgatccaaacacctcctaccaggccccacctccaacacgggggattacatctcaacatgagatttggaggagatatccaaactatactaaattctttacaacttttctgaaaatctaaaattgttccaaaataaaaaggttatttttaaaaccaaaccaaaacataaaaccacctgggagaacccaggtttgaatatcagatctgacactgatataaccggtgttacctgggccagttacttaaactttctcagcctctgtttcctcatatgtaatatgggagtaatttaagacttattcttcaagatgtttatgagaatcaaatgagataatacatgtaaaatgcttagcatagtgcctggcatataattacatgctcagtaaatatcagtactttgtattaagaagtaaatgctcagaagataaagattaaactggttagccagttttcactgttctctgtgcctaaaccattcatttatttaagaaacatgagcatgccttgcaggttaggcctgtgcactgggaaaggccaaccagtgcagcttaagaggcacctattgcaagggaatgtccccagcaggggaccctgagttccccaatgttaaacagagcatctgggtgaaaagtggtagttcacttcaccacgtggaaacacatttgtatactaagtcctagcacaattaaaacttctcctttgaataggctagggtttgtttctacagaaagtgtatcgtgttgaattctgaggcagagttcatggaaatcagaggcattgccagggttcttaagtgggggccatggctggatttggagccaactttcagtttgctcaataatgtggtcgaagagttacaggtgagaaaaacgaatgtgcttactgaagaatttctaaatccatggctccctctggcggtcctgccaagaacatgacacaattaggacacaattggcatctaacagacaagcctgtgtccctgctgaacaagaaactaggccatggtagaacatccaggctctgtcctaccgcactaacgactgcactaatgatgacattaatgaccattctttttcatcttgactgacagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 35731 - DNA, 15915 bp, Homo sapiens
actgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggtgagacctcccgggcgggccgggatggggcgcgagtggggctgaggcggggccggagggcagggcgggccaggccgggccacccagagcggggtggaaggcgccaggggagccggggagcctttacttcgcctccgcgccctgcattccgttcctggcctcgggagaagcggcacggaccgggatcacgccaaggtccgtgtgaacttcccccttctcgacacccacctcccgcccccgggcccagctgtgcgccaggcgaagtcggtgtgctcaagaggtgcctgttgggttacaggacacggaaagggtggcctcggcctccttcgagtctccaattgaccccactcatttcggatcttctaacttaatttctcttgaccgagaggctttgtaatagcgtagaatctggagacagggtggcttcgttcaaacagcaccctcaccattgactagccctgtgaccttgagcaagtttttaaacgtcccggggacccggtttcctaaaatgtttgctcgaagtggagttaatctctaaatggagataagagttatctctgaaatgttatcagttaactctaaaatggagataataagagtccccacctcttggggttgtcttgaggattcaacgagtgacacgtgtggaaacgattccaaatagcacctggcacataatcgataacatgtgtgttgaatagtgttatttattgagtctccagttcggtatacatttcttgaacacctgtgctcagttctgaggcgggttcacagaaggtcagcctcttcagaaacaaacttcctcctcttccctctccctcaacatctgagcttttcttggcagtgagttcaggagcgccgaagcagaactcagaggacgctgccctcccctccccttacctacacattcttagggtacaagtagctaaagcaaagagcaacgatgcttgaggggtggggggtagagtttagcactatttcatggcctcagcatttagaggtgcctaacacctgagctagcattctgacccccctaggcacagtgaggtcgtgttaattggtgtaactgcaggcctcgggattctggtatttcccccaggacttgataccgctctacttagtacaggcagagattgtcaaaaggtaagaggtatgcccctctaggaatcctgttgcctaaaataatgacaaaactgccgggtgcggtggctcaggcctgtaatcccagcattttgggaggctgaggcaggtggatcacctgaggtcagaagttcgagatcagcctggccaacatggtgaaaccccgtctctactaaaaatacaaaattagccggtcgtggtggcgggctcctgtaatcccagctactcgggaggctgaggcgggagaatagcctgaacccgggaggcggagtttgcagtgagcggagatcgtgccattgcactacggcctgggcgacaagagcaagactccgtattttaaaaaaaaaaaaaaaaaaaaaaaaaaaaaagcgttccctttagggatatctgtgggtagagggctgtaccggtagttacgggctcagaaacatccttcctttaggcacctgatgtaggttttcttcttcttctgcaagtcaggttcattgtttcctgtatcagtttgcagggtccccccccccccgccaccttacagtaggaagaaaattgagttccagatatgaagtcacctttgaaagtgcccaggtatctttccacttggtggtgtaaactcttcagataattagaagttttctgtgtcactcaacttgtcatggactaattaggaaccattcctgaagcttttaaggatagaactaaaagtttcacttttatttttttaaagggtggaataataaactaacgtgttgactctttgtattttgtaattcttcatacttatggatgtctttttacttaactataagtaacaaaatagatcaacgttttagttttttatattatacatgtaaaaagacattttgcatataagcctttcacaaaaatcttgacagtaaacaataagcagtggctcacccaaattaggcagacttactgcactagactcctaccatctgtgtgatactccatgaagggagggagaaggggagggagaagggtaggcagctggtctgatggctgtgacacaagataatccccttaacctcccaagacgctgtgtgttttttccttttttattctccctggtttactttcgttttgtttgagacagggtctctgtgtcacccaggctggagtgcagtagcaggacagctcactgcagccttagcctgctgggctcaagcgatcctcctgccttagcctcctgagtagctgggaacacaggcatgtgccaccaccacacccagccaattaaaaaaattttttttttactagagacatggtcttgctacgttgcccagtctggtctccatctccaggctcaagcagtcctcccacctcggcctcccaaagtgctgggattactctcactctcttaaaaccaggcaggtagggagatttatctcaggcttaaagattgccattgtctcatcaaagagtgtttggtgtgaaactttgaaatgaatatcaagattgtgtttttatttttgaataaggtttatagttttcatagttcttatttcatggaagaagattgaatgcatttaaaatgttattttattgtttgcatttctgtatggctccttttgtgagatctttactagcaatgttttggctttataagtggtaggtaagagttttaatttacactgttagaatctggaatttttgaaacgtttttcctctttcacatgaatggttcctatgtatttaggaagttaaagttttacttttttttaattaatttttttttttaggctggaatgcagtggcacagtcatagctcactgtagcctcaggtgtgtgccaccatacctgactaattttttaatatttatttttgtagagatgagagtctcatgttgcccaggctggctttgaactcctggcttcaagtggtcctcccaccctggcctcccaaagtgctggggattataggtgtgagccatcatgcccggcctagtttttattttttaaaatttgagtgggttgttcgtggtctctgtcagagaggaatcccatttaacagagaatctttttatggctctccagagaaaatgaatggtaaacttatcttttcaacaagctctcactcagaaatgatacacacacacttctgataggacttttagcttctttaactttgttcctttcactcatatcagtggttcttatttttgagatacacagtaatgaagccatgggagaaagtatctaagtagctttctggcagtcctaatctttgcaggcgcaagattacaggcgcatgccacagcactgggccccttcttgctctttattgtatagcattatcctgcctcattgtttcaactctaggattgagaaagaagttaccttttctctgttactgtcgcctggctggtttggactcctgccttccaaaaactgcagtttctgtagttgtatttggaaatttatttcacaatacaataaatttctggccccacaaaatatttattaactgccaagaataacacatctgtttgattgctaaatataaccattgatttgctgtttcaccttctctcagctttacttcttcccaaattcctaaatttccttcactttttctgagatacattagtggactgtctctgcctgtaagttaactgaaacactgattcctagtatttcagttgttttcctccagcactgtcattgtctgtgtttgttggctttgtccaataatggtctattgaggggtgaagatatacgtaattagctttctgcctattggcttgtacactccagggtatacttggcagatcagtcttaactcttctcaccaagatcagtccagtgctggattaggtaaggtatgaacacatcagatgtgctttttatggagaaatcatgttggtttacacgtcagtgtgtgagaatgtggcagaagggagctaaaatagtatgataatactactggataaattttgtggtctaacctaaaccttagccattacatagaatacttttgctgtgagcaggtttgctcagttgtaaaactggaaaggaatcatttctcaccccccgcctccaagctttttacctccaaacagtgacagccacccaaacatcaagagaacagtgtttcagagaacatttctactggggcttcaggaggagcctgtccaagatttaggctgttcaaattataaattataaaacagctggctcaagcccattgtgtttaagtcagagagtgctaagtatcttttcttttgtcttgtctccctaaagtatttatctcatacttcaatcaatttaaaatattttttcttacagatccaatttgatagaagagtcaagtttgcctagagtggagattaaatcatagttttatttgaagtataattttggcttgctcaaaatgaacagtatctggttatgactaagaatggcatgaaaaggccagacgcagtggctcatgcctgcaatcccagtactttgggaggccaaggcaggtggatcacctgaggtcaggagttggagaccagcctggccaacatggtgaaaccccatctctactaaaaatataaaaattagccgggcgtggtggtgggcacctgtaatcccagctactcgggagactgagacaggagaaatcacttgaacccgggaagcggaggttgcagtgagccgagatcgcaccactgcactccagcctgggtgataaaagcaaaactccgtctcaaaacaaacaaacaaaagaatggcataaacagacacagctcacagatgatctagtctctttagccactaatttcattatattctcactataatttctttgaaaacaaaggatgggtttgttttttgcccctctttgcgctgcttgccttcagatgcgggataatcctgtttcattggccaaagcatggattcattttggaggccaaggaagatgcaaacacagtgcacagggtggaagagaagcctatgaatatgttggggcttattaaatttccataacttcattctgataactgattattatactttccaaaatagctgacaattaaaaagtactgatttgtttgtatatttttgtcttttaaggcaagcagagtgctggtagcatcccgtaattttgcaaatgatgctacatttgaaattaaggtaagaggtgttttactttgttaataattttttcacaggtacactctgatatacagttttacctttagaatagaacattttgatgttcatgcttagtcatcattttcttctaaatgttccaggatcagaagttcagagaagcttcacgaaaactagaatttattattagcagcttgctgttgttctgtggggggaagggggaggagctagaaaatgaaaataaaaataaaagcttattcaaaagtttggaatgtaattcagtgaaatatttgaataagaagagtcttagttgtttctttgaaggttctttcaacctataactcagttggcttctaggggctttcagtgaaaatcatcttagaaagatttccttcccccaagccccatctcattgcacagtgaggtttatggatttaaggaacagaggcgatatgaagcattactgatgtgctcctttgcagtttttcaagttcaatattatttgcaatggagttagatcttagagtggtcaacagtgtttgcaatgtagtatgtggaggataataactaccttattccatttcagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggtgagtggtaggtttgtggtggaactgtgttatttaggtactgaagtatggcttgtacttattgggctttaccctgccatatgtatcagaagagtttgaggctggtaatgtaattttcttttatttatttatttttttgagacagtctctctctgtcgcccaggttagagtacagtggtgatcttggctcactgcagcctctggttagagtacagtgtgatcttggctcactgcagcctctgtccactgggctcaagcaatcctcccacctcagcctcccgagtatgtgggaccacaggtgcacaccaacacacccagctaatttttgtattttttggagatacggggtttcactatgttgcccaggctagtctcaaacttctgggctcaagtggtccgcccaccttggcctcccaaggtgctaggattacaggcgtgagccactgtgcctggctgaagccagtattttagaattaaaaagtagaatgccaaaacctgctatgaagcttaggctaaagaattcattcacacataacattgccagttttctgtacctgttcttagagttttactattttaaaactttctggcactatgatcgcctgtactgtatataatttggagagaaaggattagtttgttttttgttttgtgggcttaggtcaagggttagagtcaaatacctacaagggccagccaggtagaataaatgagtgaagaaggctaggtatacaaaacagaaaatggtgacagggactcatgctgaactggcaccagcatgccctacccagaggaatgccatgacttggttccagccagttggtgccatgtggaaatcaggggtaatgtttcctgttttccatgtctaagagaaggcggaagtctggattttcatgtgaaattccccagtgttttaatgttgacatctgatgtaggcttttcttttaggtcatcatacaggagaaaggaaggaagtggcacatgtgtgggttgccagtttattgcttctggtttgggccttccactctgtattttggtggaaaatagctactttctctggttattaatgacaggttctactagcccacatatttcactgtggtctaggaaacgtttttatttagaaacatgtatcatattgcctcatagtttctccttcctctaacacaggaagcttgctgtgtgggcctggaggccggcatcaaccccacagaccatctcatcacagcctaccgggctcacggctttactttcacccggggcctttccgtccgagaaattctcgcagagcttacaggtttgctgttgatttacagaaaggggaaatgagtggattaagtttttaaatatctgtcattaagatgctattatgagttaatatttgttaaaaattttaagtttctttttttaaccctctctcctttggtgctctggtacttctgttgtgctcttgagttaactgaccatttgtgaagttctctggcccctcaggtaaaagtttaaaacaggttggtgctataaaatcacagtaggtttggttatcattcaagcatgccagaagaagtctagcagtcatagaaagtaagttcggttgaagcactccatggtatgcaatgtaaattctagaaatcttcttaatattccccttttctttgtcccccgtgactatttgtttgttttggtggtttttttttttttttttttttgagactgtgtctcactccgttgtccaggctggtgtgcagtggtgtgatcacggctcactgcaacctccacctcccgggttcaagtgattctcatgcctccacctcctgagtagctgggactacaggcatgcaccaccacacctggctaatttttgtatttttagtagagatggggtttcaacatgttggccaggctggtctccaactcctgacctcaggtgatccacctgccttggcctcccaaagtgtgctggggttacaggcgtgagccaccgcacctggcctgttttgtttttttgagacagagtctcgctttgttgcccaggctggagtgcagtggcctgcctcagcctcccaaaatgctaggattacaggcgtgagccactgtgcccggtcctcctcctcctccttttttttttttttttttgagacagagtttcactctttcacccaggctggagtggctggagtgaagtggtatgattttggctcactgcagcctccgccccccgggttcaagcaattctcctgcctcagcctcctgagtagctaggattataggtgcccaaccaccacacctggctaatttctgtatttttagtagagaccaggtttcaccatgttggccaggctggtcttgaactcttgacctcaggtgatccaccctcttcggcctcccaaaatgttaggattacaggcgtgagccgccgtgcccggccctccttgactcttgaactatggttgtccctctatatatccaggggattggttctaggaccctcgagtatacaaaaatcctcaaatactcaagtcccaaagtcagccttccatatcttcgggtttgcatcctgagaatattctattttcaatacatgtgtggctgaaaaaaaatctgtgtataagtgtacctgtgcagttcaaaccctgttcaaggattgaatatatttagtgtactagtataggagaggtcctaagatgtttgtaactggccagaaaacccagaaaagtccagggtatcatctggatggaacatctgaaggaaactaagtgactagagagtaggaaaagctggaaaggttgaagcacatggaactagtgaaaggacaaggagaaacatgtgtttgcctggagggacaggtacttagacgactgaactggcctctgtgttctaatggttgagcctcagagtacatatttggggtgcggtttggtttgctttgtagagttggtttgttctgcacatgtgtatgttctgccatttccaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggacccataagattataatggagctgaaaaattcctgtcgcctagtgatgttgtagtggcacaacacattaccttttctacgtttaggtacacaaatattttgcctacaggattcagtagagtcacatgctgtgcagggttgtagcctaggagcagtaggctctactatacagcctaggtgtgcagtgggctgtaccatctaggttcgtgcattacagtatggtgttcacatgacaaaatcgcctagtgatgcaattctgagaatatatccctgttgttaagtgacgcgtgactattttgggggcttggtttgcttttaaagacctagtgcttcatatcctaccgtttgagagatgagtagatttggatggtgatttataatgtttccttttaggtgtctgctgttttataagtaagcaggaacctctagcagtggagccataccttccccttcctatttatatttcagtacattaattgctttatcttgtcaacttcattttggggtccttgttctcatcagttagtgaatgatgaagaattaacagcacaaaattatatccggactgtttcttttcctttctaatatattaagattctattatgtgttgtttttttttaaacctaggttttatttttccttttgaaatggagtcttgctcagccgcccaggctggagcagtggtgtaatctcagctcactgcaacctccacccccgggttcaagcaattctcctgcctcagcctcccgagtagctgggaatatagttacgtgccaccatgcccaaccattttttgtatttttagtagagacggggtttcaccatcttgtccaggatggtctcgatctgtggacctcgtgatctgcccaaagtgctgggattacaggcgtgagccaccacgcccggccaggttttattttttaactcttgaatgcagaaatgttagtgcttactggttaaaatagaacatagtatttatatattactttagtgctttattgaaaatatcggaggtgggataaacagagagatagggttggaaggagagtttgtagcagcagtgtaatttctgtgtcagattctggccaggagtgaaaatgcagggcattaattagtatctcccctcatggatttctgtggttcctttctcggttgtccttaatgttaggtgcccctgggcgctgggattgctctagcctgtaagtataatggaaaagatgaggtctgcctgactttatatggcgatggtgctgctaaccaggtaattatgtctcttaacttcccaaaaacagtcttattttcaaagtctttaatatttacagttgaatttctaaagaagtagcatattgcttattaggtgaaatagcaagtcctatggctagctcaaatttggttgacttatggccagattagagattgacctcttagcgttgtttcacaagagacttacgggggcacattcctgtgaaggagctcacctttgctctacatcagtgcttggcaaaggccctgtggtaaaggacctccccacaacctattgcaaaacaatacagacccattctcttggatgtccgggctggcagtgtcaaattcggataatagcgtctgagtcctaactcagtttctatgcttctcttgttaccgagtaatccccagtctgtggccagcactctgtgaagccctgttctagaggctgattcttaggtgctggttcactctggctatccagtgggcctgatagatttcatattgatcttttttccagtgtgttccttactgctagcatggccccaaagaaacaagtagtagttggtttgtcaccttccttagttgcaagagtatgatgcctgctacttctcctccaccacccaccccgctttccctcaccacccaaagctcggttttagaagaggaggctttctgtgctttatgaaagctttctgtgccaggcagagcagcagctgttagagatgatgaagcctggagaaagaagccaaatgaaaccccttttcgtaactacttccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtaaggacacctgtggtggggccggggccaaggccaaggccaagggtatgtccttgtgcagacccttgacgatcttagaaacattggagagtttcattctcatacaggagcaggtcatgtgaaagtaaaatggtttggggcagttggattcatgcttcgcccctcccctgtttattaccaggtggatggaatggatatcctgtgcgtccgagaggcaacaaggtttgctgctgcctattgtagatctgggaaggtaaggctctaaagccctctgggctagtgacatttatctctggaagttcaaagactgcctcccatgtgcctgctgaagctgttagtgggtacctgctaattgaggtgcatgagatggaagcagagtgaagggagcagggctcctttgggtagcttggtcttggtagctcacctgctgggaagcctacgtttctctcatttgggggaagtccgttctggtgcttcctctgctttggcctgtcttcatgacaactgatttgccttttccttaggttaattctgtccctcctccccaccccccattaatcatgagtcccttgaaggaacagattggggatccccacagtgtccagcatagaatgtcatgtatacaataggcatttaatatgtgtgtcttatacaaattaaacagtatggtagaagctcgtaatcttagtcttgctcagtcctaaggatctttcccttttcagtgtatggcagtgagggagatggtaagagggagactggcctaaagaggtttcacttcctttggcactagtataggcttaggaggtttgggtgttctccctaaatcagtgttctacagcccagaaacaaggtttctgaagttggcacttcagcgccataccatgtacgtttaggcagtgatgtgaatcagatgtggccagcaatgatggaaatgtcacaaagtggagagacagggaagtgagggtgggaatgtagtaacattaaataagagctaatgagtagaatgaactagagcaggaccaagactacagcttgggtacaatgggctgagcagtctatgtcaggaccctaaggctgggagtgccaggccctgagtgatgggtattgacgccacctctcccaattcctgaaaagaatacatgggggccagccctggctggagacaaggggagttgtagaatgtagttgtagaatgtgtgactttcccaaacagataaccttcacaattctgagttaggtgttattgttttgcccattttgcagacaaggaaactgagccatagagcagttaaaggtacacagctactctgtcttggagccagctccccactcgcccattttaactgctgcaccaaaccaaccaaggatcctcaatgtttctccaccccagtgttcagagccgtctcctggaagtgggctagtgtagaatgagcgagcccaactgtccagactcccagcagagccttggggtttgggtagcagaggttgttggtgcctgccaactttgttacacactagcaaggtctgtgaagtaggagtggctgccagccccacaacacaccatgagaaaggagcatgagatggaaatctgtctagccaatagcaggaggctctagaacatgctcagagcctttttcttttttcacagggtctcgcgcagtggcacactcacagctcactgcacccttgaccttccagaatcaggtgatcctcccaagtagctgggactacaggcgcacgccaccatgcctggctaatttttgtattttttgatagagatggggttttgccatgttgtccaggctagtctcgaactcctgggcgcaagtgctctgcccacctcagcttcccaaagtgctgggattacaggcatgagccaccatgcctggccttcaaagcctttttgattcaaaacaagctgttggcagattgccttattaaaaatgagaaagatgaaatatgcaatcaatacttgctagaaatgagaacagatcagtcaaccaataagaaattcgtgacaactcagaagatctgataagactacactggacgcttaataaagggcctgcgtttgaggccgtggattgccggcctgttcttccagtcatcgttcctaactaactaactgcctaccggttctgttttaggggcccatcctgatggagctgcagacttaccgttaccacggacacagtatgagtgaccctggagtcaggtacgctcatgggcagtgtggtttccataggggtgggctttgaatggtgttacatggcaaaagcaacacatttcagtatttgcttttggagctagataccagttcacttcatgtacgcagttgtgttgggcatcaagttatctgaaagcagtgcctcctaataagaaagctttctgaaaatgcctacagtgtatagtgtgtgtgagcacaagcagcaatttttaaagaaagagtgttatataccttaattgtagagggaaattgttacataaaacagggctgatggtagtgtagtatcttgggggcatttagcttttgtaggcattaccccaagtctacacctggcatactctacctgaagaggatcagaatttggagatgttcctctgtctggtatagagctaagggtaactgggtgttcaatccgttgaaatacatcaatcaaaaaagctaggttccactaggaaggcatgaattttacttttttgcttagtagctctggcctgtgattctggaatcccagttttgacacagttgaataaataagcctttgtagagtggacttctaaggaaaaatcatgtagagagcacagtatatggaaaaatgcactttgtgtaaatctattgttgaaaatggtagaatccttttagtgttacttcagatgatataggcataagatacattggttttgctggctgtgcttctttagggggacttaagggagaaaggcaaggcacatggatttcctgcttggcgctctgatgtctcaaagtctaattatcaccacacacaccatctctgctgtccccacccatgtagtatacaggagcccaaatgggtgggacaagtgacacttctttagaaccttacatctaaatcaaagcagcaagcaaaaacttggcccctgttgtcggaatgccagggaagccatgtgactcaccagtgtacggttttctagaaaagacagaagcagttattacagaatgttaggctgcgttctggtattttgaaagtataacaacaactctgccacgcctatagtgacataagcattggtatgcccctttgtttcagaaacacacttctgtatttcacctcattgggacaatccaaccccatatcatgtttcatcacgccgtccttgctctactggaactgctcttactgatcgattactacttttccctccccatagttaccgtacacgagaagaaattcaggaagtaagaagtaagagtgaccctattatgcttctcaaggacaggatggtgaacagcaatcttgccagtgtggaagaactaaaggtacagtcacttgttcatggtggtttgaaggttggctttaaaagttgccacccctgggtggccacagagtttgtgtgggttcctccaagcccagaaagtgatgtcctgggacataaatagttccatagttccaaagtcccttggggtgggggcttttcctttagtttcctctattcaaaattgtattactcttcagatttcagattttggtggactgtgaaccaccatcacagtggcaaagcccccacagtagtatggttcttttttcctaaaagtatactgtggatttttaattcataaaatagatacaccctagaaatctgtattccaaaatcttctgaattagcaactgttcgtacttgtagttaaagagttacaccagcaacaggtcctcagcagaactctagttggtacctaagctgctgttcattctaaaaccttttacactgttacctaatttttaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctt

SEQ ID NO: 35732 - DNA, 56723 bp, Homo sapiens
gccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcggtgagtgggctgaggctggagaggggagtcgctctgggaaccccttcccgggggctgcagggacacaagaaataagcgcccagtcatcggctgatgggtaccccccgccaggagcagggacgggagggcgcggtaacccgagagtgtcgcagactgggtgtgtctggggagcgcagcggagcaaatctggggtcggggcggagaggcgcgggcggagggcgccctggctagggggaggggagggagtcccgttgctgcagagggtctggttgagggtcctgggcgccggagctgagccaggggctggtcctgccggccttaatttgggggggctcaagagactttgaaggtccggggttggggtcagctggacgccagtcaaaggacccgcagagaagggtgtggctgaggcccaagactgagagcaagagcgttggaccctccagctgcttataaaatggcttgtgtgtggtgtcgggggagggctgcctgcgtgcagagagctgaacgtccggtcgtacatacctcagggcctcattggaccccatcccctttgggccactgcttgtctatgaatgcagtctcccaacggggctccgaggcctcctatggtgaggcaggggcactacccttctttctgcatcccctaagcggtctaggccttcccaaagtttgggggcttcaaataattccccatataccagcatgggagcaaaataccctgaatcggaatcccagcccctgttgcagtgtgactttgggcggtggctttccctctctgagcctggatttccttctccaagtccatagttgagaaacccagtctctttcaaaggaaacaatggctttgaaaactgatttatttgtcagctgtatggaatgattgcaggtttgggagtcttgattatagatttgggaagcctggcacaacccttgtaggccctacaaggggaaagggcaggaggtcctttgggacaactaatctggccacggcttcctgcctcctccttcctttccctagattctagtgggtcttctctgacaattccaaatttggacatatggctcccgggtttgtgaaaggactctggtttccccccaagagtccgcccttttccctccattattccttcccccttgcccaaaacatgcttgggattgcttccactgacccagatggcatatcctgacctgcgtagcccttcatggtgaagtgaatgaccgccccagtttcagcccctgtggaccctgacctcctagcaggcaggccctgagccacgccgagggcactggcctggggtcagaggaaagcccggttacagtccggatgtgctgggacttcttgagcaagccctttctctaaggctttgtgccccatctggagcaaagtctgctgaactggctgccactgccagtgcagacattctaggattcaactgttctaagatttaggattctgggagttggatgggactggggagggcaggaggcagaggctttcatccccctctgcagctgtgacaatcactcatccatctttctttgccttatctaccctttgttcctaaggcagcatctgctgagatacagaaaatacttgcagtttctggataagggccacagctgttgctggggcaaaatgtagatgtgagtgtgcagaggaggggccagggaagcccaaggcctggcctcttgagactgactcctgggatgaagtgggggagactgcagtgctggatagctgccagtgactggcacatccgcactgcagcatccagagggagccctgggccaccaggatccagcctcggacccagcccctgccctgccactaatcagctaggcgccctgggcacacctactacccctctggggcttagccccttcctctctacagggataggacatatacccaggacaccccactggtattaataaaatgggttgggtctgaatggcttttgctctaccattctaggattttctggggaggcccagtggaatcaccagcctcaccccacccagcctctccgatatacttcctgggtggcgacaaagcacaggatgtggtctctaccgtgattcctgagcatgcatgcaccccttctcctgccaatagaggggaggaagtcggaggggtgtctttatgcctataaacttgccttggaatccagcctcactccctttcctcctggagttgagaagcccccacagagactggctatgggggagtgactgtctataggttccttggatgtcctgcctatctgcaaaatgagaatgagatcgataccttcatgaggctgtaagatggcagatataaaagtgctgtgttatctcaaaagggtgtggtgcttgagaaggcaggcgacctgagcctcaagttcctcttctgaaaaatccatgtcctggtggtccttaaataatagcaataaaatggtaaccactattacctctcgaacccttaaatttgccaggccccggctgaagccttgctatgttagacgctgttattaatgcctattttgcagacatggaaactccagcccttaacagtttaaggaagaaataataatgacaaatgcttataaaatatagtgcttcctgtgtgccaggtcctcttctaagctctagacttgtcttaattttttttatcctcatcataactcctatgagggaggtgctatttttatcccttttttttttttttaatatgaaacaggcacagagaggctcaatacttgcacaacaccacacagctactaaatatcaccctcaggcttcaatctcaggcagtctggctccagcatctatactgtgagacactactttgctgcctctcacaaaagtgacccaagctggggttcaaacctaggctagactagttccaatcctgaggcagagagatgatctcctgaggccttgtccagtcctaggatcaatggttctgggtcaggagaggaaaagacactgctccctaagaaaccccagtcgtcaagctggggggtgtgcccacgcacagagccagggaaggcatttaccccagcttcatcagaatcaaggctcctggagggttatggagcgggtcctgggtgtcttcctgcagaccgggggagaagccagcaagaaagggcaaagagggaaggatctagattttataggccaggggccttctaagtgggatggatataccccaggacgcactgaagatgatcttttgggggtacaggaagaaactattggactccttattaaatgtacttttaatgtcatattttaaaggtatatttctgtttatcatggtaaatactcaatttttctttggttatgggttgtgtatgggatcaatatatatatatatatatatatatatatatatatatactgcaaactgccatatgacatcaccttatcaccagctttgtggggccaggagccttgtctgtctcattttctgttcaacccccaacttctaccagtgggcctggtttgtaggaggtgctcaaataaatgtttatggaaaaacacgcccctgcttgatgactgattttcttctgatgttgggtaagtgacttaacctctctagtttatctcctggctatagaaagaggagtaaagcacagtttgaaaaccaatagtagatggttccatttgctgaggtcactaaagaaagcatgaaagccacttagtgcattttacccccaaccatccataggagccacgccctatgggagggggtgcaggaaagaggcatatgcagtaattttctaaaaagtgtaaaattatgactcatgcagatacaaaaatgatcatgtgctgttctacttattaatcaatgaccacaccaggccgatgttataaccagctcaaaagacacatttgtattgaaagaaatgtgcaattagagacaaaactctttttttacctgagggggtgggaaatcaattggacctttacaaaatagggcaaggagtatgtattagaattactttgtgttaccatcaattatttgcaacttactgacctgtaaaatcactcaaagacaatgaaagtctcgagtcagacaacctggagggttttcctttgaagtacagattctttcccataataccttggaggctggcagcccttatctaatggagaaatgataaatccacagtggttgaccaaagccagtcaaatcaaggtggtttcagagcaccctagcgggggaataccttctggcttgttagaaaaggcggcatttgaatccagcagataacagtggttctcagcctccttggctgccattaaaatcacctaggaaagtttttagaaattaccaaaggccaggcctcaccccagcagttgagtcagaatctctaagggctgaccttaaatctttggtagttttgaaaaattccccaggttctgttagtgaagctagaattgaaaagcactggtatagattctggaaagctggattaaaaatgttggtggaaggcgttcctggtttagcagggaagacagggcaaagaggaaagtggtgatggcaaagaagtcagtaaggagaaccaatggcctcgactgctgagcttagaggcccagtattaaggggcaccattggagacttgtgagcagaggagtgctgtggctcaggctgtagcccctcaggcactcccctgaggcagaggtctgggtgggtttttttgcatgattttccatattatttcttttttctcaaatcaccctcccaccacacctggtttcacccccttacgctcaacatctcctttccctcaaaagtgtactctgttcctccacagcccaagctacctttcgatgacagaaatgctttttcttaccctggtgttactattcttcctggcatgcccctgcctccattccattgaatccagattttgactgtgcacctctatcagcctgcacccctaatattttctttaactttatacatgtataacaaataaaaatgggacataaaagggcaagattaaaacatttggaaagtggtgatactcttgtcctgcaccccagtggattgtcatacccattacccctttttggagactactgctgtaataatgatgattgtggcaacagaagtcaccgtttgttaaacatttaatctgtacctggccatgctaagtgttttacctgccttatttcattgaatcttcacaaaaaccttacaagagggtcatttcaggatgaagaaactgaggcagagaaattccataacttgcccaagttactgagctcggaatttgcatggtcaggatttgaacttgggcatcgaccacaaatcctgcattgattctaatgccacattgcctccattgtaaatgtttgggcttattataataaaagccaccatttattgagcctttactgtgtgccacgcactgtgctaagtgttttccccccgttacttcatttatttctcagtacctataggtatttctatctgcattttgcggatgtggaaattgagattcagtttaagtaacttacttacatcacaaactgctgggcaacatctgtgcctgaaggcccatgccttcacatgacttggataaaacccttcccctatccacatctctgtggttgggcagtggtgagccgttccttctagagtcagcctggaactctcgaaggggaaggaggaaaacgtgattgattgcaggcaaaaggatgaggcaaggggtggccacagcagcacaaagccacccaggccattcattctgctcctgtgtgggtttcacgaatgatcagtcatgataagtcgtcacagtatatctcatctagatctgagagaatcagggttcctgggaggaaagaggcacaggtctggaatgaccctgtttactagtcttgaacagctctttcaaccaaggtgatgaatgttgcatattggcgggtggagatggggaggaatcctgtggcctgggagatgaccctcctaggactgatattctgctgtgaaaatcctgagttgaagtctctaaaagcctctaactatagatcctaccaaagagggagtgatgtattgtcccactttagagatgaagaaactaaggctgagagagggatctggcttgcctgaggttacatgggggcagactgggaaccagaaccagggtcttattctttggactcttcctggtgtcccattgcagccaagacccacagttgtgtggggacttgttatgatcgagggctgctaggcagagatgttggctgcttcctgggccctggcaagtcactttctctttctgagatgcctttaccccgtctagaaaatgagggacttggagtcatggattattaagggcccttgtgggattcagaaacactagatgtaaaatattcagccaatttgagcagtatggtctaggttgctctgggagggatcagaagccatcttaaagccagggtaaatggtgtgtttatgattagctcaggagcttcccagaaccctcagaggcggggctgtggaatcagcagggggactggccctcagaactgcagtctgaacatctagttctggaaggagcttgctttttacatatgaactgtgcactcacacaaggcacacagaaactgctctcagagctgagaatattttcccaaacagtaagaggcccctccttgaagccatctctccttggaaaggggagctcctccagatgggcctgggctgcagccagcagctgaaattgccagcaacaagcccagaggaaagtgcttcaaggctggagatgcaggtgacaggcctcagccctccctctgtctgtgtcaactaacttcctgggtctcattcagtccctggttctctgctagccttgggcttccttcactgtctccccctactatcccccaggtcagaggaaaccgagagctggcctccagcctcatcccggggtagatgtgggccccctcctccccccaccacacactggaaagggggtacagtttccatttcctggtgagagctgcacagttgtaccaaggggcccctggttgccagggaaacagcaaggtttcctgaagctgagctgagctgagctgcatttgcaggcagatccgtcctctgccttccactcccaaccccatatgatgactgtcctcagctgactgcagcttggggaactcataatcagccagtgaagacacagaggcaaacacgacagaggccctgtcctcaacttcccaccagcacagtaaatatcaccatttactaagaacaggtcttgtgcctggcctcttatgtgctgcctttgacataacttaggtcttatcctccaacaaccctacaaagcagaaaagggaaagcttcagttttgtgcttgagatcaccttgaactcaaaaatgagcaataagcccacggtcacatggctaagattttccctaagtcttgggggaacagggaatatgtggagaactggaaggcattgagctgaaatgtctccatgatttctactctcctagttctgttccttttaggtcttactgggtaaatctgattgactttgttatgtttacttttttttttttttttgagtcagagtctcactctgttgcctagcctggagtgcagtggtgccatctctgctcactgcaacctctgcctcccagctcaagcgattcacctgcctcggcctcctgactagctgggactacaggcacacaccatcacacctggctaatttttgtattttttcgtagagacggggtttcgcatgttggccaggctggtctcaaacttctggccccaggtggtccttgccgcttggcctcccaaagtgctgggattacaggcatgagccactgctcctggcctctgttatgttcacttttaaaaagcaatacatagacattgttaaaagagatcaggccaggcttggtggctcacgcctataatcccagcactttgagagactgaggagggcagatcacaagggcaggagttcgagaccagcctggccaacatggtgaaacccatctctactaaaaatacgaaaattagccaggtgtggtgccgtgcacctgtaatcccagctactcaggaggctgaggcaggagaatcgcttgaacccgggaggtggaggttgcagggagctgagattgcgccactgcactccagcctgggtaacagagcgagactccatctcaaaaaaaagagatcaaattgcccagacctgcttaaagtggaaagtagtggtcctttgtttctcttctccttctcttaagaagattgttaaactttcatctgttgccctcctgagtgctcattagccagctccctacctgcttctcttatacttcccaaatcagttacatctctttttgcatttatttttacgtatcatatctttgttccttcactgtagaccctgtctcctgatatcctccacccgcattccttatccattttcaatgagatatgtgtcctgttttcctgtgtgttcctgtctttttttttttttttttttttttgagacagggcttgccctgtcacccaggctggagtgcagtggtgcaaccttggctcactgcagcctccacctcctgagttcaagcaatcctctcgcctcagcctcccaagtagctgggactataggcatgtgccaccatgtccagctattttttttttatttttttttaatagagatcgggtctcactatgttacctaggctggtctcgaactcctgggctcaaattatcctcccacctcagcttcccaaagtgccagaattataggcatgagctaccacgaccagcctgaaaaatccagtctttacagtggcctcaggcaccggtctcagatcctacatcctaccacaccactccctgctaccacaccagccacactgagctcgtggtggttcctcacttgcaccaccccgcggtgtgccccagtcacactcgtgagatcctctgacccctccacctgggactacaccccttgtcactttcctgaccaagccttgtcttttctctgtagttcttatctcagcctgatgagtgcatttgttattcattcccattacagcataagctctagagaaacagaatttaaaaaattgctcatatttctgcatgcacagtgcccagagcaatgcctgactaggataggcgctaaatgagtgcatactcacttgttcaggaatgacagtccttcagatattgcagcaggtggttggaagcactttgagtcctatctgcaggcggtcaagctctgggttctgaagccatccttgttgacttgaaaagggggcatgcatggtgcagatagtatagactctgggatctagaaattgttgaattcagttctaagctgtgtgatcttggctcatttattgcgatgctccagcctcagtttcctctctataaaaaaggagaatctgatgtgtggaaggatttctgagagtagtaactgagacggtgctgagacaggtaccctgcctagtgtggaggagtcaaggggtcagtggtgggtcagtgccatgcccgccctcccttggggatccgcgtccctttcccatactgctgtgaatgtctggacaccatctagtctgtccattgtcttctgaaaaaaatgtgattggccttgagctgggtcattgggtctgatttaacctgaagggctgggggcagctggaaaacagcagagggaggaaatgtaagggaaagaaaggggatggttagagttggggggaatctcacatgctgtctttcttctctacagtggattctgctgcgaaccggagaccatggccaaaccagcacaggtaaggggcctctctttcctgaaggtggtactcagccttctctgggcctgggatcctcctggagccactaggcctgctacagagacccctggtaccttcagcttgaaaaaaggaggaaaggttcttaggctttgcttgctcctgttacaagtcatggctcttcagatgcaggtcaccataatgtaatataacccacaatatcctaagcagaaaaggatgtgtattggcttatctgacagagaggcccagggcttcaggtctggttgaatccaggggtttccaaatgatagtgtcaagattctgcctgtgtgagctgggcttcttccggtggcttcattcttgggtaggttcttccttgcattggcatggtagtcatcagcagctccaggcttccattctgctgtcttggcagcccagggagaaaacaacataactcatgcccagtgattccaggggaaggcccaggtctggttctcattggctgtgcctgagtaacctgttctttcttggagcaaggaggtggagttggtcccacctgaactgtttggcctgacgaagggaaatggatacttgacaggtagaaagacatccttgttgacttctctgctctggatatagaaatgttctctgtcacacccatttgggattgaatttccttggcttgggagactctaacctcagtctctcatgtctgactgttctgccgggcaatagaattggaggcacctgagaacttttactcccatgtggctgagactaggttctggccatggtcagaggtaggattctgacctcgactgtgctctgttgaggctgggcacggtgactctcacctataatcccagcactttgggaggctgaagtgagcagatcacttgagcgcaggatttcgacaccagcctggacaatatggcagaaccctgtctctagaaaaaatacaaaggtggcatgtacttgtagtcccagctgcttaggaggctaaggtgggaaactcacctgatcccaggagattgaggctgtgatgagctgagatcatgccactgcactccagcctgggctacagagcaagtctcaaaaaacaaaaaaccccactctactctgttggggtttgcctgagggtgctgtctgttggctggcgttggagaaagccatgcagtcagtgtgacgatgggattggcagggagaagaaacttggggatcttgaagaaaatcatgggactgggccccgttgtcccttactccaacccagaactactggccacagaatgcacagacagaagctgtctgtgaggtctttgggcctcatgttccccttacggaatggttgaattcagtaataataaaactccatccatccttgacatcatgactgcccccagtgaacctgggcttataggatattcacagtttctgaagagcacaggatgttataggatcagtaccctcagagaagtcctagctgtggccttcctcacagccactgaggagtatactgtgtgtacaagtggcctctctgaccaggaggagaaaatgttactgattatgggcaaaaatccaaggtggaactttcactgttccccatttcctatgtgtagtcatactagagctacttcctgaaaggcatttgaactgcaggattctagatgatccaagtggacaggccaggccctggaagatcagagaggccaggacctagggtgcagatctttggaccttggtccagtgctcctgggccatgccttctgcctggctgatctgtggtttcttgttgccatggactagggttcagtagacctcctgcaagtgagtcccagggtggcagggccttagggaaccctcctcctatgggatgagttggcaccctccatgcacagtgttctggtggggcagtaaaggagctctggggcatgcaggagggcaccccacctaggttgaggagagaggggaggctgcctagggagagctactcaggggaggaacaagggggctcagagtggtctaggcagggacaactgggacagaggctagaaggagagcaaatgcagcgtgctcaggggagtaaaagtaatttggtatgcttggggtgcagtggtttgggggagaggtgagggttgcagaagacaataacagagaaatgtgaaaaaagcctccctgccgttgagctgcagttgttccttccagttattagctcggctttcaattattagcttgaatctggtgtcctccaaaactccaacacacgcacacatgcatgcatgtatacacacgtgtgcatgcacacagcaaactgctccgtcttctctggcctagacaccccccagttccttccactgtggttattgtgctgttctccctatctctccttttggaagaggagaacttgaggcccaaagacatgaagaagtaggatggtgccatggaagacccaggaggcatggcgctgtggcctccatttcacagggacgttctgggtttgaatgcaataatgaacataaaaacaccttgaggacagggcaggataggcaggtgcttgtgcctgggacttctaggagctgtggaggtgagacctaggtcagcaccggccaaggcagctctcagctggagtcctggccatgtacctgtctctctggggacatcatctctgctcccaagaggccactaggactcctgctccagcagcagcctgggtggggcccagccccacagagccccagggcccggctgctcaccagctggcaccaggacctgctgaatatttcagggtggaaagtcccttctctgctgtcccctgccttgatcctgggttcccgcagccgggaacctgtctgccggaggtgtgacaggcagtcagggtggggtgggtgaggagaagcctgtgtggttgcacaggtggcgcttagagatgcagaattcatgaagttggtgtgagaatgacacggtgggaagcctgggcctggatgatttgaggggctgtctctgtatctccaaatgtgactagtgctaagccccccacctttgcttctagtggctatgatcctgtggggtcccaggacaactaatctagtaggtcatcacttggaaggtcttattagtcccgtgcaaagaactgtgcaggagcccgagcttgctgctcaagaagcttgtctctaagtgagcgtttggatcaaggcttgtgtaggtcattaagcacccttcccccagcatggcacttcagccccttctccagacactgctgtgaccacccacattgtatgagggggagaacagtggagggggaggagcagcaataggaaattggggtctgcgtgctgcctcatcctccgcccttcatcctggggacatgcttccctcttctccgcatcccttcccggcagcttacaatcccatgactttagcgactttgggcatctaactgtgagctctgaagaatcagactctatcttaagtacttgtcaccgcccacacacccctgccccagcagacaagttaaaatagtttctagatcccacatatcaaccagacaggtatttgtatgaaatacctgtcacatgaaccatatgaaatctgctgctatttgactgtttttaatctacatacaaggcaagttacatggctcaacgtagtaaagaatgccagatactagggacagggttgtgagtggtcagctgagtttaatgggtaaggaaaaccacactaggatgttagagtcttgcccttacccaggtcctgacttaggtgttgtgcccaggccagcccagcagggctagagctgcccttacaagagtctgaattgtttatccccatcatcttctccagcctcatctctttgccttccccgcttctagtggatgatcttagtgacagccagcatctgctctgagccctgcagactctgggctggctttcccgaatgccccttgcttccctccaggtctttgtcatgtgtctcctctgtgtgatgccttcttcctcttcgccttcccctccctactctactccttggggccagcctgttgctcatccctcaggactcagcttagacgtcacctccagaaagccttctctgatctgcttggaatatattcgcagtcattcatccatccatttatgaaacatattcagtgagtgcttgattgctccaggccctgtacttggtgctagaaatgcgtcagtgagcaagagagacacagtccctgccctcccggaacttcgaaaggaaatatttcctgggtcccatgctgcccttagcatcgtatctgccacactgtcttgtagttgaagctgtcatgtatctctaccagattctgagttcttagtggtccctggtcctaagcatctacttagtagactctcagtaaatgttgcttgcttgcttgattgaatgaatgaatggtagggtagccctagctgccctggaattgtgagtatctgaatgtgagaagcacttaggatgctgtggattggacagcattgctgcctttttatagccttgaatatagggtcgaaatggcatagaggcaaacagcacagggcaataactcaaatgcttcagtattcaaggagaggggcaggctggcatggttgaccaggaggaagcagtgggctatgtggtggttgtcccttcttatctccagctcccacccagatggaatctgaggggaagggagagatggtctgttagaaagagccttggattcccttcccagctgggcctctgacttgctgtgtggtcttgacatgtcacctgccctctctgttctgggtcttctgggacacaagtggtaatagacctaccttcctcatttagttctcagcttgtggttctcaaagtcctttccctctcttattccaagtgagccgtgggagggacatcctatgactgaagtggattggagactggtgctgctgtggattaggacaggttggtcagacaggtggaaggaaaaacagccatgaatcatggcaacaggctagcctgcagagggcccggacagaccctggaggacctgcccctggtggcatctttcaaagcttaatatttccacactggtcccaggaggtcctgacattggagacagcattgctagggatccagtgccagggaggtctcccttcactgtcttccccttcggcgtcctccatctcagagcttgggccgtcatgggtgtctccatccattcatttagcccagtcacagttacttccagcctgtatgccaagcctgtgctagagctggggctccacggttcttcttaggcagaatgatttgtcttattcacgacagtctccattctccatggactcaataactgagtgggaagctgaactaaaaggtctttaaggatcgttgcaaagaaataattttgagcctctgaaccttcttgtttcctttttttttttttgagacagagtcagtctcattctgtcgcccaggctggaatgcagtgatgcgatctgagctcactacaacctctgcctcccaggttcaagtgattctcctgacccagcctcctgagtagctgagattacaggtgcctgccaccatgcctggctaatttttgtatttttagctgaaacagggtttcattacattggccaggctggtctctgactccctacctcaagtggtctcccgtctagcctcccaaagtgctgggattacaggcatgagccactgtgcccaggcacctcttgtttctccatccatcctagtagctaatattgcctgctgtgcttttttgatatcgctggactggaggtgtccagaaagaaagagaaaaggatttagaagtgaaattcctggaggaccccagttgtttcgtgttcttgttcattttattcatgtggcaaatacttgagtatttggtcaatctctgtgcagtgggcagatggatctggtatctgctctcagaggtttctggatcaaactgcccaccggggtggagaaggcagcaggaatttctcaagctccggccgtgaggtctgaagtaaggccaaggggagcgctggcagtaaagcccccatcctgcgctcactgagctccttgcaaggcgccctgctctgggtattcggcatgtgttactctttaagtctctgcccaggggcgtgatcaggttgcaggggattcccaggtggcaggaagagagctgtgttcctttctggtcagaactttaaatagtaactccacgccgacgcatgcatacctcagaggagccagcctctgcagacagagaccagagagcatccagaggcctggccggggtcctgcagtgcagacgttgggaggcacggagacggggagagggggaggcggtccaggactcactctgctccacctctgactccttgaaggcaagatctgtgtggcccaccctccattccctcttttttggattctttcctgatttcccgcagctggatcagcctctgctgttttcccacattaccttatttttgtcttaatgtatttactacaagctttatagtaattgatgtgcttgtctgtctctgccactgggccaggagctcgtgaaagacaggaattgggtcccctttctccccaattcctcagccattagtgtagggcctagcacaaatgaagtgccttgtcactgtgctgtgtgctcggtgacaggctctggcatcctccactctgccagctctcagctgctctcccagaccccccacttttcagtgccatgtaactgacccacatctgacttctctgtgaaccagtcccattgtgcattcaggttcaggttcgatgtctaagatcccctggctctctgccgcttctctccttcccctcaaagaccaagccagcttgtcctcagatgccagttcacagcgcagtttactgggcccagaggggcagtgccttgtcttggcattgaaatgagagtgtctctgggccccctgtgcccaggaccccaccctcagtagctggcacctgcaaggttcctggagctggagagcagagcggggctggagagcagagggaaaaggtctgagttctgtgtgacctcccacaagtggctcttctttgggcttggcttctgtgatagaaataatcttaagagcgtctacaaatggctacactaatgacattcacagaggtgaaagtgtaaacataaaatgccataaaaatatgaggggctggctgggtgcactggttcatgcctgtaatcccagcactttgggaggccaatgtgggaggactgcttgaggccaggcattcaaaactagccagggcaatagagtgagaccccatctcttaaaatatatatatatatatatatatatatatttgactcttgctattcttgcagggatcattttcatctcctatactcagccaggcttttttaccctctcctggatgctttggaaggtggtgcagggctgcaggccttggccaagcccccctcccttggggaaatggcactgtcctttgggcgggttgcagcaggtggtatgggaaagtcatccacaccgctccccagggtgtatgtggccagcactggattttgcagggaaagcagctcagcctggaccagggtaggcatctgacctgaggttggggctgggagcttggtctcagtccggggttggcagctcaccctctacttttttctccacagggtgccaagtaccggggctccatccatgacttcccaggctttgaccccaaccaggatgccgaggctctgtacactgccatgaagggctttggtgggtgccaggcttcatgggagcttgaggggtatcccccaaaagtagacacagcccagagcccttctggtggtggtggtagggtctgtgaaatggtgaagtgcacttattcatttttttggtctcctctttttattaattttcatgatgttataataaaatgtttcagaaaaaaagtataaagaataatagaaatttcacccatagatttaccaccaaatttaagaactagtgcttcattagcatagttgaagtttccttggtagatccccctcctgataatgccgcccgctgcctttgcccagaggcagccacaatccgaaggtggtgcttatgttcttctttgtcttgtggtggaaagaaccctgtactgggtgttaggatacctgggttttctaagccaggttcattgtgagaccttggacaagttcttgcccctctctgggccttaatttcctgatttgtgcagtgaggagctggatcaggggccttctgagcacagatattgtgtgtgctgtgtccactttcagtcgtgacttaataaatccccatgaccctctgccctgacaccagcacctgatgagtggaaggctcatgctgaggcctgcagggagctactaggcctgtgtccagggaaggaagtggccctggtgggcttcctggaggcagggtgggtaggatgatgattgctctcccctattccaggcagtgacaaggaggccatactggacataatcacctcacggagcaacaggcagaggcaggaggtctgccagagctacaagtccctctacggcaaggtaaccacagcaaccggagggcccatggggtgcgggtggaagaatgatttcattcacctgtgtgctcgttcaggttatttcctggatatggcactccaggttagcctgtgggctgacaccttaccctgctctttttcttctcatcagctgggcgtctttcagcctttaatacacccacagcacctgctgtatgctgggctcgtgctaggtgttagggctgcactagtgaataagatgggtgaggtgtcaactctgtggactgccagatagtgagagagatacacagtaaacgaggaaacagacagtggtggggaagtggcacagggctgtggacctgaccctgcatagccgtttgctagcagcatgacatggagtaagacctctgttgtttctgagcctgtctcttagggttggtaacagtacatacctccaagggtgatgatttaatgagattacttagcccagcacctgccagagtaagtgctcattaagtgtaattcttaccgttgtaactactcttcctctttcctcttctatctcctcttcttccccacctgccaggacctcattgctgatttaaagtatgaattgacgggcaagtttgaacggttgattgtgggcctgatgaggccacctgcctattgtgatgccaaagaaattaaagatgccatctcggtaagaagtgggggtgtatgtggtgttggggtggggatgtggttaatgggaagattctgggctcttccaaaagcaactggtgagccccatacccacccagcacatgtgtcctgcttcaaagacacatctaaatttatcccagaggagcatcccgatccgcacacagagagatgcagacagatgtcaacatgatgcagacccccttaccaggagcttgtagtccaaggatacaggttatagggacatggagacaaattgtgtccaacactcctgaggccaagggcacactaaaggtaatcaacatgaccctgggccaagggttgtttgagagggcatcttaaaggataataggatcaagttaagccccaaagcccagagaggatttggtggatagcagtgtcaaggtcattgcagggtgtaaaaatggcaggagaagttgtggatctgtgtttagggtatgaagagtagttcagcccggttgaggtagaggtagagaattgccccctaggaaaaagagaggcaaagccctttaagtgtatctagcactttacagtctataaagtgctatgatctttgtcttctatgagctattaagcatgaattcattttataaactgatgcacttagcaatgtgagattattatcttctcaatctccctgtgagtttggcagagcaactaatatcatctacattttacagatgagaaaactgaggcccaaaaagatagtttctgaagagaattcacaaagctggaggaggcagaactagaacctttgtgttttagtccattctcacatcgctataaagaaacacctgagattgggtaatttataaagaaaagaggttgaattggctcatggttctgcaggctgaacaggaagcattgtggcttctgcttccggggaggcctcaagaagcttccagtcttggcagaaggcaaagagggagcaggcatctcacatggtgggagcaggagcaaggcgggaggtggggaagtgctacatacttttaaacaaccagatctcacaagaacttacgatcgtgagaacagtagcaaggagatggtgctaactattcatgagaaaccgcccccatgatccaaccacctcccaccaggccccacttccaacattcaggtctacgattcgacatgagatttggtggggaaacacatccaaatcatatgaccatgtcttatgagtctcaaggcaggagttcccaatcagtgcctaagagctgggtaggaacctcctgagtcctggggtgtcatagctctggccactccctgatcccaacctgtgtccagtgacctcccatccctgcccttaattcatgcgctctttttctacccccagggcattggcactgatgagaagtgcctcattgagatcttggcttcccggaccaatgagcagatgcaccagctggtggcagcatacaaagatggtgagatgggcaggaggggccgcttaggatcttcagatacaaaatgaggatgattgcaacagtggggacactaagattctagccatctaccttctctcctcctttcctctgatccatttgtccacccatttatctacccaataagtacttgctctgtgctgggtgatgtgctaggttctcgggataaaaccaaaggggtccctctctcttaggccaatgagataatgagataatgaaggagacacacaataaacaggtgaacagataaacacagtgatgatggattttagctaagtgttgtacaggaaataaggtaacaagaatcaaacttttaccagtgaggtcttgggaggaaatgaggaaccaatcgtataaagaatggagagaagatccttccaacagaggtcacggcaagtgcaaaggccctgaaatagaaatgagcctggtagccggtacaaggctagacaggtagaggacagggcaggatcacacagggcctgcaggccaagagagagatggtgttttattctgagtctaatgagaagttggggagtatgatgatcagatatgggttttaagacagccatccttgttgccgtgggttggaaaggaattgagaatagaggaggagagaaccatcggaaagctgtagccactgtccaggtgggccgtcatggtataggtgggctagagagaatgaacagattccatttcatcatatcatggtcagtacgaagagctgtgaaaatataccctgggtcttgccatgatggacgtgtagactgggttttggaattcttaaaaatatctgatcattttgggggcagcagggccctttatcctagatccctgaggtctctggggatgagactagagcttgcgttcctttctgcagcctacgagcgggacctggaggctgacatcatcggcgacacctctggccacttccagaagatgcttgtggtcctgctccaggttggttcacagcctatttttttcctctggagcttgggatagcttttgtctggctcatctgggtgtagatctgaatgtccagggtctggtcagcttcccctggtttgcacaggcaggtgtatttggctaatcctctttctctttggcacacagtcctctcgtgcccaggagtgtcttctgctgtgattttcttcctctctccacactcgctcctcccgctcctctctgggcctccttcctgccattgcttctgcagctgcacatgcagcatttctggaccccagcattcctgtggctactgtgtggagtctcccacatccgagccttattgcctcctcaccgcccgcccaaagtatatcacaaagagactattaggaggctacaaattggtgtctgtggctgaattcaacctgccaagttggattttttgtttgttttcccataaaatgtgttttaagaaagaaagcaaaacaagtttgagttagttgctaacatttaaaaattgtgagattttgctcaaaaaccagatttctggattattttaatgtattgaaagttgcggtagcagcagacctgcattctgcacgactgcagtgggctggagagcatatgcgtcctgcccgtttcaccgtgaatgttatctacctggctctgtaggtatctctgtgaccacaggcacgatgggaacaggcattgagatgtctcaagctcagctccaaggaccaaatggttatgaaactttatatataaattaagccaccactatgtttcctcgttcccccatttcccttttataccagctcctcccaactctgttcctctcattgccataacaatcccatattaaccagctggggaatgatcaggagaaacctcaggagtgggacagtgtgacctgtgccccattttcaaagctgcttgttctggagaggagtgtcctatccctgtatcttggagtcaagcgttttgtatcctcaaggtttgacaccaagcagcagcgcggcacacattgtaagcttgccagctctgtcttctgctcagtcccaaagagaaccctgggggtttgagatcctggaatgcacaatccagggggaagaggggatggccatagacctctccaggccacctgcagacctctgcccacgtaagaaggagttgagtactgctcgcccctcttccctttgtgcatcctcctatgtgtaagcttcctctatcagatgaggcaaagggcatgggcagaacaacagaagcaccattaggatttggtgactttgtagcttgtgagctcagatcttgggacctgagtcccaaatccttattggtgaattctttaagttaaggtataagagctcctaatagaatgcaaatgttcagatcctttgcccctgtggaatcgttgctggaggagtgtcatgggccatgcaggatctgtggcagggaccctcgagaacctggggccctgtcctcagagaggtcctcagggcaaggctctgcctacctctgggctggggacacctggaagaaccttggttgttcttgggactctcctgtgtggacccagccctgacgaggaagggaaaggccagagggagggtcccttttgattggctcacaaaatagatactgtggtcttcatgcaatagcagtcactgcttctggacacatctgggccaccagggttttcctgctttccctgtctccaccactggcatccaggcctccctcctgactttgcagtgtttgaaacacatgttctttgtctttctgcccagggaaccagggaggaggatgacgtagtgagcgaggacctggtacaacaggatgtccaggtaaacaagcaccactgaaagtccctgaggcacagcagaagagccttgggaggggagaggttggggccctgggaagggctggaggtgaagtcatttgcatcaaataccagaaataacccagccacagctgtcatgtataccggtgctttgttgaagaaaagatataagttatctttcaaaggtatatcccatatgtaatattggtatattggtgaggtgtactttggagctttctttattcattcagtttttagatattattgaagtaaaatacctagcatgtgctaggcactctgccaagcatttagaaatcactaatgaacaaaatcaagtggtaccgggagagacaggcatacattaatcacacaaacaccttctctatcaatatactgtacattgcaggtgttttgagtacccagtacatgccagcagcactacaggggctgatacagagaatgctatgacatagtccctgttgttgaggagctcatgcaatagtgtggagatagacaggtgaagaaatcattatcatatacagtagatcaaagtgataaagaagtagaaagctatgggagcctaggagagggaggaaaggagggaaatagaactgtgcctgggggcatcgggaagtactttgagaaaaaaatggaatacttaatctgggccttgaaggttgagtaggagtttctccagaaagaaaggaagaaaggcatataggtatagtcatgtaccacataatggtgttttggttaatgatggaccacatatatgatgctagtcccataagattatggaccagatatgtgatgctagtcctataagattataaccccatattttcactgtgccttttctatgattatttatgtttggatacacaaattcttgccattgtgttgcagttgcctacagtattcggtaagataacacgctgaacaggtaggtgtgccgcctaggagcaataggctataccacggagtctgggtgtgtagtaggctatgccatctaggtgtgtgcgagtgctctatgatcacacaatggcaaagtcgcctaacaatggcagttctcagaatgtatccccatcattaaatgatgcatgactgttttatttgcaaaggtcttcaggctaccaattactcgtgtgttcagggatcaggcagcagttctgagtggcttggtcagtgtgtcctgtctcctgaggtttcctctttcagtcaagtgccacctcttccccttcaggacctatacgaggcaggggaactgaaatggggaacagatgaagcccagttcatttacatcttgggaaatcgcagcaagcagcatcttcggttgggtaagctccagagaagacctgaagctgctcccttgggttgatgccaataatgcctttctttatctcttttcttttctttaccactaatggaacatgatacctacttcattcccaacccaaactttagtcctgagtttattaggttggtgcaaaagtaactgcggtttttgccgtttttaaaggaatggcaaaaaccgcaattacttttgcaccaacctaatatcagacagcagtttgtatagtccctcagcaaagtcattaacaggatgcttggccttccatctcagtgccagtcctgtctccatgttaggggatgagacacagtctctcaccagctatgaagctcatctgcacagcgctggtgatgtgcgtgacctcccagtcgcctccatcatagcaccagccctagcttcatggtggacagtcgtcctggccactgtgcccccctgctcttgaagtcctcatttcttctcgggggtacagaggcactctcaaacctccctgtctctctgtctgacgcagtgttcgatgagtatctgaagaccacagggaagccgattgaagccagcatccgaggggagctgtctggggactttgagaagctaatgctggccgtaggtatgtcctgacgttgcattcctgggggctttaggggattctggaacactggcctaggaacaaggggctgagaatggaaaggggaattacatggtatagaattgggaaggagaaaaccatgtgggccgtgaattctaaaggtttctccagggcagcatggctgaggctggggacgggaagggggtttgagcctcaggtactgacttcctccagctcccttctccaccactggcagggggacaaagagctctgaacttgggttgaggataatgatgatcataatagttgacttttgttgagcatctagtgcatgccaggcactgtgctgagtgtgtaatctttaaaaaagacccagcagtggccactgccatgatctctatttcacagatgaggaaactgagtctcaccaggctgatcatttcctgaggggtagttttgtaatgagttgggggtactgagaacgtgaggatgtgaggaactggctagtcagtggtggagccaagattcaaaccagggcttctcccacatgggcttggagcaagtcacttctgcttgctggacctcagtttcctcatctgttaagtggggtgcagggtgtgggggcaggaaggatggactgccttaattgcctccccagaagcccttccaattctggcattccagcagttagcatgtctgagtcagggatatgttgtgtgtttgtatttcttgggggaaacctgcagctcctttatcgtccctcccagagccatcccctgccctccctgtttgaagtagtcagccagtgggactcacggtgattcagtgggattcacaatgattcagctgccagtacctttctggtgtagcaggtctaaaaaacaccttttcctccttcgccccagaccctacccccaccccagctcaattccctgttaaaaccaaaaggactagaaagataaaggcggtctttgtgatggacttcaaaaggattatttcaacaagattatttcctgtttattccctgggtgtgcggtaaaagtgggttggtctggggtgatctggggctgtgagctatcaggaacggtggttcttcctgtattgagctaggtggccctcaaggaatagaaacaaagagggagtcaggccatcccatcccccttctgaggcagccagaataactctacctcttcctccctcttcacagtgaagtgtatccggagcaccccggaatattttgctgaaaggctcttcaaggctatgaaggtgcgtggtggggctgatgtgaatggggtttggggagaggactattgggagtctttgacaagtccttgggatccagtggccaaagagagcccttcagggatggccacaggactgaccctggtgaaggtgctctgtcgcaggtgagctgtagagccaggaatgctgctggtcacatgtcctgccacctgcatacctgcctgacgtcatgagtcaacagatgaacttagggtggcagcctgcacctgatccctccagccaaatgggttggcggctcggactttgaagaagtattaaccagaatgtttttatacagcgtatgtaggcaagaccactttggccttgcctgctaagactcatgatgctcaccctgtgacagttccactctgggtgtgtttctgagaaagcttcccaggcttttacacatatgacgcacaaagaaactggtatttttgtgatgcactggaggaaatgaatgcagttatttgctgccagaggcctgaggcccgagacacaggagcttgggcctttctggccctggttggccattccgaaaggacaaagtagactgtcggccattctctgcccaccagtgtgccataatgaggttgggcagctcagccctagagagatgtttgcctgtatgcatgaattcattaagaatgcccatcacaaggctgagtgcatgcagtggctcacacctatgatcccagcactctgggaggccaaagtgggaggatcacttgaggcccaaagttcaagaccagcctgggcaacatagtaagacccttgtctctacaaaaataacaaatagaactagccagggactgtggcacatacctgtagtcctaactactcgggaggctgaggcaggaggatttcttgagcacagggcccctgggtttgaggcttcagtgaacgcagtgctatgtgatcacgccactgtactctagcctggacaacagagtgagaccctgcctcttcaaaaaaaaaagaaaaagaaaaaaaaaacttataacagtattgcttatattaggaaaaagctagaaacaacccagtgaccatcaggaatagtacagcaaaaacctaaatgcacagtggtatatttgcagagttccaaaatgtgtaaatctaagtgtattgcttagagttacaaagctatggtaaaattataaggaaaatcaagtgtggaaattatacatgaagagagaagaggtttataacagtgagagggccgggcatggtggctcatgtgtgtaatcgtagcattttgggaggccaaggcagcccttgaggccagttcaagaccagcctggccaacatggcaaaaccccatctctactaaaaatacaaaaattagccaggcgtagtggtgggtacctgtactcccagctgctcaggaagctgaggcaggagaattgcttgagtctggaaggcagaggttgtagtgagctgagatcgtaccactgcactccagcctggacaagagtgagacactgtctcagaaacaaacaaacaaacaaacaaacaaacaaaacagtaagaggagcatagagagagcttcaatgggaatggcaatgtctgcttcttttgctctaaattttaactttttattatgaaaataggattttcaactaagctgggagctatcagcactctagcctcctctcaagtccatgttccccaaacccacttgtcttgcagggcctggggactcgggacaacaccctgatccgcatcatggtctcccgtagtgagttggacatgctcgacattcgggagatcttccggaccaagtatgagaagtccctctacagcatgatcaaggtcagcagagctcatgggggcagagaagggagcaaagagctttttgccaagacagagggcttggggactattcccaggaaaaggaaatgtcctaggaagtgggagtctcttggacattccaggagctcctgccttgtggctcattcaaggaatttaaggatattcaacagaaaagcaagtgttaggggtgtttgtgagtggtaaggctacagaaggaggcaggggctgggtcatgaaggacacgcaagctgaattaagtgcgaggactctgccccaagggcagtgatagttcagtctcctggaagaaggctgggaaacactgaagaacacaaatgagggttaaaggggaacctttggcctgggccgggtgattggtgatgactctgggacatccggcccctgaggctttatcaggagacatatgtaaagctaggggttttccctttttttttttttttttggatgactgaaataaaactttatggggtgacagagaaagagatccaagttgtattctccaaagtatgtttccaaagggtaatttttttaggtgttatgtgcaaaatgttctatgggaaaataagtttgtaacaaaccacaataagcaaagataaataagccagtttctttacctcagaacttctcacagcctttcacattttgaagtccattatgaagccccaagagggatatggaatatgcatctatacggatatgtgcatctgtgtaatatatatttgtttgatttttttgcatttcccaatatttttgctcatggaaccccatttccatgcatatttcatgtggaaggactgggctggggactgtctggtggcagtgctgtgctggggcactggcttgaaagggcagcgagcatctcttctcaactccgcatattggtagcaaagtcatattggtaacttgaaattgtccattgctagaagtatttacaccacagaaataggcaaatgctataaattagggcttcctccaacctgcccgctgagaaccagttattcaatattaaccagcacaggagggccagggctgctatgaataagtgttcattcagccttcccctctttcaggctgtgcagaaccttcacctccttgtctgagaggagcccagggctgggtgagaggtaacctttctttctttctcttcagaatgacacctctggcgagtacaagaagactctgctgaagctgtctgggggagatgatgagtaagtggcttcttggcccctggctggagggcatggccttggggtgccaggcggggactctcctggctcgcatcctgatgggtggattggatgagctggggattcccctgagccaggagcgtcgcacaagtgaaaggcggcttttgctggtagctgctgtgcttgtgggtctgtgtgtctgagagtgtgggggtctgaacgtgagcgtggtctcctgtatatggagatgtctgctcttgtgaacttggaaagtcagtctggggttgtggactaggaaccagaatatgagcatccaatccctgctatttcatagccatttctcggtttcatcacctgttaaatgggaaaaggacacattcctgctctgcctactcatttatgcagcatatttgtgttaagtgccttctgggtgcagaccctgtgaggaagcccctgatgaaggccacagcgcagaagggtatagaccagtttccagaagggagcagtcctgtgctggggagaactggctgtgccacatagaaagcatatataaaagcacacagagatgccctagcccagaccaaggggagactctttggagatacacggtgagacccaaggaggaaggggaagagccaggtgaagagggtctggggacagtgtttgggtggaggaaatcacctatagaaaagccgaggagtgagaaggagtggcctgattcattcatatgtccgaagtcatgcatttatggagtactagagagagaaataaggcagagaagtgggagggcctgggggcctcttcccagaatgttaaattgggacattacttgaccagatttgtgtttgagaaagggaacaggctgcgctctgatttcctttctctggatcttataaagatccaattacagaagggatgcaagaatttcctgtgaacctttggtaaggaccataggggttgatgcagttcagcagatattactgagctcctgatgcatccaggcactttgcaggaggagatgcagggctggcatggccatagcttgctcaatggcctctttgagaggggagagttggatagaagccattcaaattctaaggaagaaaggggaggctgaaggattggaaaaatcctatcctgcttggactctgcagccaggaaggctgcccttaaaagccagcattggccggacacagtggctcagcgcctgtaatcccagcactttgggaggctgaggcgggcggatcacctgaggtcaggagttcaagaccagcctggccaacatggcgaaaccccatctctactaaaaatacaagaattagccaggcgtgatggcgggtgcctgtaatcctagctacttgggagactgaggcaggagaatcgcttgaacctgggaggcagaggttgcagtgagctgagatcgagccactgcaccccagcctgggtgacaagagcaaaactccgtctcaaataaaaataaaaaataaaaaaggcagcattgcagggggtctcaagagatggaaggttctcagaaatggagggaggactctggcgaatggaggaggcataggctggagagaaagaaagcttaatgtgtgtgtggtgtgtgcacgtgtgtgtatgtgttggggtgtgtgtgtgtgtgtgtgtgtgtgtgttggtgtgagtgttgcccatgatgacattccttcctgtcctctccctaaacccctccattccagtgctgctggccagttcttcccggaggcagcgcaggtggcctatcagatgtgggaacttagtgcagtggcccgagtagaggtcagaccttcccctcctcctgcttgacctcttgaccacagcttctctgcttgcaccttcctgctgctctggttggcacccagctgccccctggcggccaacccgacacgttgattctcacatctgaagcttccttttctcccttggagtggtgaactggtggaggggcgcacctggtttctgcattagcttctgacacgctggaaagggttctggcccacttactaacagggcttgctgaaatggagacctggctggttccatggaggggcctgtcccgtctggagtcgaaacagttggcctcagagacatgaaagctgagaacagatgggcatccctgggtgcactggaggatttcaggttgtcctcctgagcatcctcagactgggggtccacaaaggacaggaatgaaaggtttcactaaagtactttaggcaaaccattccagagactgcaacacttggtccacacaaaaaagcatgggaccttggagctctctgttacttattcgctatgtaacctttggaaggtgccccctccctctgggcctctatgtctccatctttaaagtgaggggttaacatggcaatctcggtgatctcttagggctcttgagctctgatgttctaggacagtgttccccaaatgataaggcaagagatctttgcagatgattgtaggtgatgtgagaagtgaatttagtttggcagggttgaataacgctgaactccacagagtgaatgagaaaggcactcctttccaatttcatcagcgtttctgattacgtcaaagaggaagtcttggtttggtgccgccgtctctgcaacacttgctgattttcctttttcacaaagagaaagctgagagagctcgctttaagtttcagagcttctggcaagtagaggcatcatgttaaatttcatggtatatcacctcttttgtttttattatgttgatttttgtggtaaattgtcagtttatgatacatggtatcaacttcctaattcatggtagttatataaaattaatttcatccattcctttttttttttttttttttgagacagggtctcactctgttatccaggctggagtacagtggcatgatcatggctcactgccacctccccaggctcaggtgatccttccacttagcttcccaagtagctgggacctcaggtggacaccaccacacctggctaatttgtgtagagacagggtttcaccatgttgcctgggctcatcttgaaccaatgggctcaagcgatcctcctgccttggcctcccaaagtgctgagattacaggcatgagccattgtgccaagcctcattaatccacttaacaattattttttgagtgtgcctattatgtcagacactgttgtaggcacctgggatatgtaacaggataaaacggatacaattccttgccttttgggagtaattttaaatgcacttcaaaaattgatgcatttaagtagacagaaaagaagttgaattacataaaaccattaagagatggcatagtgtgtgtgctaatttggaatagtgaaagtcctttaggagtgactgaaatttgggaaactctgttctggtatttcagaacttttctgctgccttttcagggggaatgactctttaagaggcagagggggcctcgggggcagggtaggattcagaagaattggggatgccccggtggaataagcagccaaggggcactagaaccgaggcagatcccgtggcaggcgggagcctagccaatttctcttgatcaggacttgccctgctcccagccctgagtccctctctccctctctctatatctttctgtctctttctctctctctctctctctctctctcagctctcgtgcagggtctgtctgctgtggcttcacctctgcctctttccccacccacgccgcttggtttgggctcatggggtgagcttcccaccctcgcatgctgtctttcagcctggtccccaggggggccttcagacacctgctgagtctctttctgcttctcacagctgaagggaactgtgcgcccagccaatgacttcaaccctgacgcagatgccaaagcgctgcggaaagccatgaagggactcggtatgggggatgggaagggagcagggttggtctccagggcagcaggtgtggtgggtttggccgtgggctggcaggggatggagtgaggtttcaaattagagtctgcaggatgaggaaggcttgatctcaagtttccaccctcctagctcccagagtatagagaggaggggcaggagagggttcataaggaacttggcagaagccctttccagggaccaaggtgtcccccagcctcctggaagcagtatcctggcactgaagaaagtaccaggtcacaaaattggcatggtgccctggctctgctgctgactcaccgtgtgactctgggtgagcctctccgccactctgggtctgaatttccctatgtgtaaaatcagggctgtggaccctggaacccaagagccctccctcattctgtggtgggagtgtgccctgctgggcaggtctttcagacctatatttggcaccagtgggaagagtactgcacccacaggttcagatcagctgggcctgtgctcagaaagtccagcctgggacaggccatctagggtttggctttctttgcctttctgccccatctgtctgacagcaactcccaggaggctttaggttaagtccatcaccctcctgagcctcctttccatgtgtctcatgggaatgatgatacctgccaagctcgcctgggactgtaggatgctagaggtaaaaatgccatgaaagacccctgtgctgggtctgtggttgatggcattaatctgagaagcaggaagtgatattctaatgccttccagagtcaacctgctgtggttagagggactcagggtccagcttccagagagctgaagagaaaggacatagagttgctaacaggacttggactgtcagggttggaaggatcccttggtgactactccagcctcttcatgttacagatgtggaaaccaagtcccatcaagggaaggggacttgcccagggtgggcagccattgccagagccagaactagaactcagaggcactgactcccaacccagtgctctctacctcccagctgtcctttttcctcagcgtgtcaaaaggaaagggagggaggagtccagcagaaatcagtggcctgagccataggcaagcggactgcagggactcaggagcacatggccgcttagccaggcttctaccctgacaaagatcgatgaggggccatcagtgggcggtgcatggggaaagccgagagccacaggccttcttctgaggcatgtggctttggtgactcagggactgacgaagacacaatcatcgatatcatcacgcaccgcagcaatgtccagcggcagcagatccggcagaccttcaagtctcactttggccgggtaaggacctcctcctgggctctctgtgcaacatgcatgcaccttgcctgattgagctcagcctgtccccatcggttctgcacagttgggcaccagggtcttcatggcagagggaccctgtgtggtcatatgatctcagagtgtctccagcactgggtttgggcagacatatctttccatgcccccagttccttgtgatgggcaacacttgtgtgagttgctcagtggactcagaggcacagcatggggccaagatcagggctatgagttgttttcagtgtgctttgggcatcttgcaattcctctgcacagacagagctggcttcaaggccccaactgagtgtcagggattattgcacattggtggcatctggcttaggttgatgcatttccccctgagtggaaacagtgtccttcagctctgctgccttcccgttcctgtctcctgtgtcaaggagagtgggtcttcctcctggttgttttttccctaccctctttggcttcatctaaataataagtacaacatcagcaaagacagacacaagcttccatgatccctcatgtggaacccctgttttctctttccatctctcccatcctgagtcatgtgtgggcaagtgctgatgttggcatgactgtggctctgccctttgcaggacttaatgactgacctgaagtctgagatctctggagacctggcaaggctgattctggggctcatgatgccaccggcccattacgatgccaagcagttgaagaaggccatggaggtacagtgtggcaccagggggtctagtgtctgcgggtgccaatagggatacaggtgatcctcataagcccaggtggattagctgtaacttcttggtagaactcctcccatactcagttcaaactggcataaacacaaaaggagatgttggctcctataactgaaaactacaggactagctctgagtccagagactcaaatgatgttctgtggacccttggctcacccctgtcttggctctgctgtcctcccttctggcttcactctcaggcagcctttctcctcatggtggcatatgtccatcccgccagctagcggctccagcagaaagagttccttcttcctaggagctccaacaacaggcttggcatttactccaagttgattcagcttaagtcacatgcccactggtgtcagaagggtctcatggagccgctggaggaagtggggtgggtctcgaacgaaagcaccagcagttggagtctgtactccagcctagacctgccactcactcacagtgtgactgggccattccttacacttcccaatcctctgtgccttcatctgggaaatggaaatggtcacctctgcccttcaaactaggacaggtcaatcaaggtcacaggtatgaagggcattgttaactccgaagacctgaccctacattaaacaagaaagcattatgtcctggcccagaagttgctagaactgctttgcttcccaaggtaccaattgtactaatggctactgtttataaagagcatatggtaactctcccaggttaggtacattagttcaattagttgcctcctcaagccacaaggcagggctcttattttgtccccattttacagatgaggaaactgagacttggaggttaagttgcttggtcatggtcatagagctatgaagtagcaaagctgaggttcagaccagtctttctgactctagagcctgtcttgacaaccgcataaaaccagtagtgcttttggccccttgcgcattaagaggagggcagcaatggggagctagaggactttataaaaacattgcctaggctaagcagattgagatgattgtttcttaaaatacctaagccaaaaagcaaacgatctaaagacacagggttcagaaatagaagagatcgatgaggtaacccaactgaatcctttccattttcaaagtttccaagtgggaaacagagaggctcagagagtcagtgagttagggggagacgagggctagacccagtctcaggactttcttgattgcctcaccacacacctgcttctaacaaagaaatgattgaagatctcaatcaggatgaatctcctaggatctgagaaggcaggaccattagagcactaggcagtaacctctttgaggacagagaacatgtcttgcctcttgcctttctctttttttttttgagacggagtctcgctctttcgcccaggctggagtgcagtggtgtgatctcggttcactgcaacctccacctcccaggttcaagcgattctcctgcctcagcctcctgagtagctgggattacaggcgcacgccaccacgaccagctaatttttttgtctttctagtagagaaggggtttcaccatgtttgccagcgtggtcttgaactcctgacctcaagtgatctgccctcttcagcttcctaaagtgctgggattacaggtgtgagccaccacgcccggacttttttttttttttttttgtagttgtagccccagcaccttgcacagtggctagcacataataggtgtcttaacaagtacctgaatgagtgaattagtcattgactcattcagtcaatcaatcagtcaatcttgcctgcctcctctcctccctgatagtttccctgcttccctgtgtgcagatctttgcatgacaggtccccagcctgccttagtccagggcatgtaacgcctcagttcataaatcactcctcaaatccaagagtaaacaaatgtaagccagccatgatggctcacgtctgtattcctaaaactttgggcttgagtccaggagttccagaccagcctggacaatatggtgaagccctgtctctacaaaaaatacaaaaattagccaagcatggtggcatgcttctgtggccccagctacttgggaggctgaagtaggagaatcacctgagtctgggaggcggaggttgcagtgagccgtaatcatgccactgcactccagcctgggcgacagagcaagactctgtctcaaaagaaaaaaaatttagcattttatcttaagcacaaaactttttttcttctaacaaaataatacatgttcactgtggagacttgaagaaatagagtaaaaaagaagaaaatagcaatcatctgtgatccttcactcacacagagaccaaactgctagttaacactgtgaggcatgtgcgtgtccttctgttctcttccaatacttacaagtagaaatttctattcagatgttcatgtgtatatgtggtgttatacacacacgcctatataccttttctgtttggggggctggaaggcaaagcagttcacatgggaggttctggggatcttgagaggctggcatagtcagccttggttgtgccaaggtcttgggcctgagggccatgtctggaggtgaggagaaaatccaggaatgcttggcctgagctttagccgtccgggccccatggacctctgcacaggaggtcagaactatggctgagatcatctttgccttgacattccagggagccggcacagatgaaaaggctcttattgaaatcctggccactcggaccaatgctgaaatccgggccatcaatgaggcctataaggagggtgagtttgggaggcctgggcccagatgctgggagaacagccaggccccccaacttccaaccccagcccacagctctgcccaggactctggcctgtctcctttccctcagtccttgaggatttgataagcctcttgggtgtgcccatccctgtgtctggggaaaagacaggtgtcctggtaggacaaaggcctggaggtagaaaagggcttggctggaagtgggaacagagaacattctggcctgctggagagagggagggcgactctaggggtgtgtagtccatgcagttctacagggccccacagccagaagggccccacacttggttgcaagctatgctgtcactgtccagaaattcttcatttttaagcgagtggccccatattttcattctgaagaatcttgagtaccagtcaaaaatgtttaaatcggctaggtgcagtggctcacacctgtaatcccagcactttgggagtctcaggcaggcggattgcttgagcccaggacttcgagaccagcctgggcgacatggcaaaaccccgtctctacaaaaaatataaaaattggctgggtgcggtggttcacccctgtaatcccagcactttgggaggccgagatggtggatcccttgaggtcagaagttcaagaccaacttggctaacatggtgagaccccgtctctactaaaaatgcaaaaattagccaggcgtggtggcatgcgcctgtagccccagctacttaggaggctgaggcaggaggatcacttgaacctgggaagcagaggttgcagtgagccgatatcacgccactgcactccaacctgggagacagaatgagactccatctcaaaaaaaacaaaaaacaaaaaaattagctaagtgtggtggcatgtgcctatagtcccagctactcaggagactgaggtgggaggatcacctgagcccagggaggtcgaggctgtagtgagccttgatcatgccaactgcactccagcctgggtgacagagtgagaccctgtcttgaaaaaaaaaaaaaaagtttacattttttatcttataagcagctttaaaatggcagaatttttgagtacaggagtgacatagtcagagctctgcttttgggtttagcaactgccatgcaggagggaaggtagaagagagaatgacaacagggaggtgacttaagaggctgttaaatattaaaggcgagatgcaatgggacctcaactgggacagagctgaggggatggaggggagatgatgggttgatgggaatgcccattgtcttacaaaatcagcaggaggatggctggatgcccccatgagccagttacaaaccctttcatccccacctccccctgccaatactgccctggctcaagcctgagtttcctggacctccctccccgcaaccaaatccttcttggccagcagctacccacaccccctttctctgcctcagactatcacaagtccctggaggatgctctgagctcagacacatctggccacttcaggaggatcctcatttctctggccacggtgagtgaattcatgggccccaggtcggcttgcccatcgggaggcctgggaggaagggaaggtttactgagtggagggcacaggggagttagaagtgcactcctgatggagagggggtgtctccccacttgcctccttagagttccaccgcctacccctgttgttcccttgtcaaagttggcgtggtaccaccttctccagacagtcctccctggtggcccttgtcctggcttgttgggcccccagctcacaggacaaagccatatgggtgaccctctcctgtgttgttacctgggagcttctgtcaccatctcttgaattcccataaccaaaatggcagaccctcattgacagttaccgagagcttgctgtgtgtcaggcattggtgctaagtgtcttgcacacattctcagttaatgaccacaacagcctaccttatagaggcaggattttcgtccctgtgtagctgatgaggaagagcattcagagaggtgaaaatgagcagggtgtgtggtggtacagagatggagatgggtcgatgtttggggactgaactttcttgctgctcctgctgcaggggcatcgtgaggagggaggagaaaacctggaccaggcacgggaagatgcccaggtaagacccccagcccaccccagtcacctctgccgggtgtccctgagatgtaggtccagcttatgcgtgtctacgccgggccctgtctgtgagtgaaggctcctggcaggggcgtggttggtttgattggttgatacttagactgtagaaatgaggtttagaagtgtggtgctggtattactggcatttcctaggtgaatagcaggaccctcagagctggcagggacctgcagatcacccaggtcaaagccctcatgttacagtgggaaaatggaggtccagaaagggcaaatgacttctgaaagtcacacagcaaatcagtggccccagtagaattgacccctagagagctggtctgggaacttgctgagaagagggcctgagtgctaaaggcctcggtttattatctgtaaaatgggaccgagattggagggagtgtcctgggacgagcctagaaagtaagttcctcaagggctggaatcttcattttgttcactgatatatccaaagtaacacatgatcagtgctcaataaatatttgttgaatgaatagcagggaaaagggttctctaggagtctcttggctgctctgcctcagccctgctccttagcctagtgagcttgaggtctggaaatggcttcttctggaggttggacaaccccaaattcattttccctgagggttctatggctgggcagtccctactgaggccagtgcattgtcccccactgacctgcaccttgatcccagcacccagtagcctgacccaggtccatgtctccatctcttctgactgcctcattttcccgcccccaaaagctgtgtccagggatgtggggcacagacaccacagacttttatagacatccagcccccttcttttatagttggtgagttgaaaagagcactgatggattgagagtcagggaaccaacttttctgttcccaggtcccataacagaagtgtggtttgctacaacagcatctgagctagaaaaatctttagctggaacctgacagttacagaattgtaattataatttttagaatgcatactatatattgagaacgatgccaagattattctatacgtttttatgttctccctttttactagaagaaaatgaagctccttaacctcttcaatgaaagaatttctaagtggtggtggttttatttgaactcaggcttgcctgatgccagagtctatgcttaattccatttacagtaatatcttccaagacccagtagagttaaggtcccctgcagcttccacatcaaatagctgttgttgtccagttgtccaacccttgctttggaatatggttgtcaaaagctgcagggttacatttaaatgtatggcatttcagctacattgtgggcacatggatgggggttaggctgagaacccagccagacactagggtggcttgctgaggccacatttcattcactcattcaacagacgtttattaagtattactgtgaacagcctcgtgtgctgctgagagttttttaaaaatctcagctctcaccccaaatccatcctccaaccctgaattgatcttccagggaatgcttctgcctggtgcctggtttgccaatgaggctgtgcttccaattgccgctagcagggggcagtggtgggccttgctgacagctgcttcgcaaaaggagagaagtggagagagagaacccgggtggaaatagctaagggacccttgagcgagatccctgcccaactcggctgcttctccagatttaggatgctagacccaagctcattttcttataactagcagtacattcttttatagaaactagaaaataaggagaagccaaaaaagactccataacctaatagtaataagcattgtcagtattgtggcatacattattctagttgcttctctatgtatatataaaagtggattctttatttctgacagttaaaaattaatactatgtgaatattgttgcatttttaaatcaacgatatcatttaatggctatatactgttccatatctgaatctaccatgttatttaaccagccttcttcctagtagcaaactcttttatcacattcatgaattattcattagaatgaatttccagagatgaaatggaaatgtgggagcaaaatgtatataaaaattaagggcatttgatagggccgagtcaagctcccccttagataacgcacatgagtacttggcagtttgtatttgcctgttttacactgcctccctggcggtctctcactctggatgtctagaacaccctcaagctcttagaagtctgggactgttattaaccagttgaacatatgtccaatttccaactgtggccccacagtgattgttaattgcttcccctttcactctgttgtccaattagagcaataaattataaataattattatagacctaccatgaaatgaaggattgtggtcatttttagataatcaatactcagacttttttttttttttttttttttttttttttttaagacggagtctcgctctgttgcccaggctggagtgcggtggcgcaatcttggctcactgcaacgtctgcctcctgggttcaagcaattctcctgcctcagactcccaagtagctgggattacaagctcccaacaccatgcccagctaatttttttgtatttttagtagagacaggatttcatcatgttggccaggctggttatgaactcctgacctcaagtgatccgcccgcctcagcctcccaaagtgctaggattacaggcgtgagccaccatgcctggcccaggcttttaaaaatataacagctttcttgaaatagaattcatttaccccactattgacccatttaaagtgtacaatttggtggtttttagtatcttcacagacttaatgcaaccatcaccacaatcaattttagaacattttttcacccccaaaagaaactccatacacattagctgtgactcctcatatcctactaaccccccagccctaagcaaccactaatctactttctgtctctccagatgtgcctcttccaaacacctcatgtcaatacagtgatattaatacgtggccttttggactggcttcttcacttaagaaaacactaacctaaacactatgttaaacacttaacagtgttttcacgggtcatccgtgttgtagcatgttggtactcccttttcattgccaaataatagtctattatccattcatcagctgatggacatttgggttatttccaccttttggctattatgactaatgctgctctaaacatttgtgtacaagtttttgtgtgcacatatgttttcatttctcttagatagaattgctgggtcatatgagaactctaagtttaaccatttgaggaactgtccagattaatttttgcatgaagtagctaggctaataagaacaagcttttgtggtgaatattaatttagtgtcccaccactttttttttacattacagatattattatcttaaagatgctttgaaaaaccgagtatgtctagggtactctgacccgcgtaagtgagaacaattgggactttggattcttttctgttaaattttttaaacatgtccctctctctctctttttaaaaatgataccgttttatttagcataagtttttacaaatttttgataaaatacatatcaactttaccatattaatcattttatatatttatttattttgagatggagttttcctcttgttgcccaggctggagtgcagtgttgcaatttggctcactacaacctccacctcccggattcaagtgattctcctgcctcaccctcctgagtagctgggattacaggcacctgccaccacacccggctaattttttgtatttttagtagagacagggtttcaccatgttggccagactggtctcaaactcctgacctcaggtgatcaacctgcctcagcctcccaaagtgctgagattacaggcgtgagccatcatgcctggccaatcattttaaagtatacagttcagtggcattaagtacattcacattgttgggcagctgtcaccaccagccacctccaaaactgttttcgtcatgcaaaaccaaaactctggacccactcaacagtcactccccattctcccttcccccagcccctggcaaccaccattctttctatgtctgtgaatttgactggggacttcatgtaagtgaaattatacagtatttatgcttttatgactggctttctttacctagtatgatgtcctcagggttcaactaggtttttgttttgtgatgtttgagatagggttgagacccaggttggagtgcagtggcacaatcttggctcactgcaacctccaccttctaggcccaagcaatcctcccacctcagccccccaagtagctgggaataacggcgtgcgccaccatgctcagctaattttttggtagagtagggtttctccacgttatcccggctggtctcaaactcataggctcaagtgatcctcccaccttggcttcccaatgtcctgggattacaggtgtgagctactgtgcctggcataggttgtttttaatacagaaaaatattttaaaaaccagaagcagcccataatcctagtagccttgataactcttatttaacatttaaatttaaaatgaaataatatctttgcatctttaagaaattttcaggaagaataaaaaaaatgcgaaagctttccctcatagtccctctcctcaaaggtgtctcgacagtttcttaagtacttcccaggaagtatgagaaagtgagtgtctatttttttttgaatctagataaaagaaacactatattacacaaaaatatgctatactttacttctttacttaatttaaatggaaactctccttatcagcattgtagataatcttatcctttgtaaaaactgcatggattgtttccattgattggataagtcatagcctgtttaacaagtcaatctcaggatggtttacagtttttctctagtatgaaaaatgctgaccaggtgcagtgcctataatcccagcactttgggaggctgaggcgggtggattacctaaggtcaggagttcgagaccagcctggccaccatggcaataccccatctctactaaaaatacaaaaaaaaaaaaattaactgggctggtggcatgcacatgtaatcccagctactcaggaggctgaggcaggagaatcgcttgaacctgggaggtggaggttgcagtgagctgagatcgcaccactgcactctttgggaggccaaggcaggaggattgcttgaggctagactggacaacaaagtgagaccccttctctacaaaaaataaaaaaattagctggatgtggtggcacacacctgtagtcccagctactcaggaggctgaggcaggagaatcgcttgagcccaggaggtcaaggttgcagtgagccgagattgtgccaatgtactccagcctgggcaacagagcaagaccctgtctccaaaaattaaaaagaatgctgcagtgaacagtcttgtattctatcgtggaaggcttttgccagtatacctgtagggcaaattcctagcaatataattgcttgatcaaatggcatatgccttttaacttttaacggacattgccaattatgcaatgaaaagaagaggaaggtttccagagtataggctattgtgaagtttataaagagttcagtctatccaatagaataaagtcagcagagtttctgggggaacggcgaaagcaatacgcagcctaggtacatgagcctgggtattttgttcccaggctctccaagtcacagctatttgcctaacaaaatagtgtcctaaccacagaattttgtgctctgcatagtgcagtgattaaaagtaacccttgtaaaatgactttcccatcactgtttgctgtgtgcctccaggcaggtcagctccccttaaggcctcagctggccagtctttcctgtctgtaacatgaaggctaaaattacatgtctcttgccttggaactctgaatatgctaaagggtgcagagaactttgcactgctcacatttacatctcagtggttctgtaaggaagtggcagggattatttccactttcagacaaagaaacaggcctggaatctcctctgggttttggggtgcgaagggcagagttccccatttctgtgtctttctcttacccttcaagtgaacacgtttttagttattgccaggcctatccgcattctgagctccagcccaaaaggtcataggaaggtatttttatcttgtccctaccccccttcctttcgcatcccgggttctctcaggtctcttgggacctctcccactcccagccaggcccctcaccctgcaccccagggccccagcaccagcctccccaacctcctctgactcttgcctcccttctctccctcctctctcccctccctgctctcaggtggctgctgagatcttggtgagtgtcctgttcttcatttgggttttaacggcctctgagtaaagtccgcctttactgggccgagcggggcagtatcgagcagtgatttgggagcttgctgtgcggcttctctctctccccttccgggccctgcttggtaaaagataggccaggcaagtgtttcccaaacttcagctaatcatctctggcacgatttgtgctgtgtaaccaccagctattaatactgatctttaaatcgactcactcttaaacccaaaatgagttaaggggaatttactatcagtataaatagaactagtagctagctagaagacaatcatggaaacactaatgtgcagtgtgatcgggtgtgtttgcccttgaccccgcttggggaaacactggccaggccatcttctctgcatatgaccccatacacccttcccagaggggcttgcagaaaggttgagggatggaaggggaactcccagttgctatgctcagagtctatgtgggtcctcctaggagccccagccccacggtcctgaggctaggatggaagtacccagtgctaaggccatctttgtcagttcacagggtccttgtgaactggagaggggagtatagaagccattgtgcttgaggaaggaagaggggaccagtctcggcccccttggatggctgggtgagcccagcttctgactgccctcagcccaggcaaagacatgaaagtgaataataaccaaggctttctcatgtctcccctcccaaatccttgctccaactggggctctgcaggaaatagcagacacacctagtggagacaaaacttccttggagacacgtttcatgacgatcctgtgtacccggagctatccgcacctccggagaggtgaggcctgacctcctcccttcccagctcagcaggaagatcccagaatctgatgagagcctctcagctctctgtggcaagaggagcccgttgcccacccacctcctccttaacccagcagtagcgtgtcatgggtgacggcgactctggagccctgggttctagtcctggctctaccacttatacctcaccttctttctcctccttagggaagcaggtgggatgcccgggattaggtatagcaactggatttcacctcaaaggccaactctgattggtagtagctgcctagagtgctgtgttaaggattctggggtcccgcgtcatgattcactggcgatgcctgccaggagcaaggcagcgagaggtggtggtggcacaagacccacatagacatctttgaaccacaggctgccgcatgctcagggcacacctgtatgcagtggccctggcactcggtaatcatgaagtgtcctgcactgagacatttacattttaatgtctggcactacattaaatgtctacatttaatgtctggcacttctcagtatttaaggtgctttaacatagtggctaaaagaatggacttgggcactggacggccttgatttgaatcccccacttaacagccatgtgacctcaggcaagtcaccgaatctctgcgcctgagctcccttacgtaggaatcagggttttagctctacccgagatgattgttgtgaagatacaaaaaacataacacacataaagcactggcgcaatgcctgactcagtgagtgtttcctgagtgttatcattgtgtcttcatcccaagcggacacaggaggaagaggaggcccaggaaggagagggatcacccaaggtccctcagtgagctggggcagaaccatgactaggacccgtgctccttttactaccccagcctgggttcccagaacttggccgaggttctaagaccattggccaggcacggggactggcgtgggacagatttggctctgagcccacggcagccttgatgtcagagcttctctatcgggatgatcttgcccaatgcatttaggcctgggctgtggccatatttgctgcccttccactttctcaggcacagcctgtgggaggcactgggtggggctgaggaggggtcctccgcctcctgcactgaagctcacccccacctctggggcttctcttgtggccagtcttccaggagttcatcaagatgaccaactatgacgtggagcacaccatcaagaaggagatgtctggggatgtcagggatgcatttgtggccattggtaactggcagggactaagggaagggctgggggcactgggaacttgaacagattctctggaagaatagaaccttggcagcctccgaagctactactggaaagtaaacactgtcacagttcgcctccaggggtgctgccaaatgtgtgattgtgcaggaatgtcatgaggtctgtgcgaggctgcaggagagggtgagaaaataactgttgctagggaagaaccaggaagactggggcaggcaggggagggggcacgctgtcctgcacaactagggtgtatacacacacacaccacacacacacttgacacacacacctaacatatacaagacacatactatacacacacacattctcacatgtgacacacactcatacataaaacacgttacatatgcatgtgacaggtgcacaccacacatacacacatcacacacagaacacattatatatacacatacatgctacacccccacaagacactacacctacacacacaccactcacacactatgcacacatgacccatgcacaccacatatacgcagcacacatgcacacacatacaagacacatacacgctagatgcagatgacacacacacagaccctcgtctcctctcagtacctggctttttggttacgcttatataatttgagctcttgactttgaaaaggtttttcccttttggatcttaattccaccgtgtataaatatggatgagtggatatgggttagggctgaagttattctcattaatattcatcattagtggtatcttgtttcatttactataaaacacattgcatcaatgcacttttaaaaaatcttaccaagaggtatccgtggaagattttcacataattgccttcaattataaaacacatcttgatttcagagacactaaaatgtgggggaaaggtgtgttagatttgggtgaagtagaggtggtggtaggggtgttgtttagcacgtgatgggcctttaccacccaggagcaatatctaggaggcgggatagcccgacgaataaaagcatggaatccaggttgaatccctgctctgccacttactcactatatgtccttgggcaggtcacaaaacctctgtgtctcaatttcctcctttgtaaagtggagataacaacagtgcccagcccatagggtggattttgtgaggctgaaattagttaattatatgtaaagcacttggaacggtgcctcttggcatgtaatactcactggacaagggttagtttgtatttgtattgttgtttcccaccaagccctgcgcaaagttagttgcacgcaggtttagttacattctcatcaggtgctcttaaccagcttattttacaaaagaggacactgagttcagagaggcttatagcagtagaaccaggactcaaaccacaggctgcctacctccaaagctcatgttcttaacaccagaataattagcctttggagacactttcagattcctaccctcctcgtgtatttccctcttccctttctcctcccaccttgaacaggtatacacgtgcaaacacacaccacaacacaccatttcacactcctccatccaatggcaggcatcggggtcccatgtgacagatggacaggctcagtttttaggaagacttgtggggttggttacagaggagagaagtttctgcccagcgtgcttcttagccagactgataaagccctaggtctgaagtcagggaaggcttcctggaggtgatgtcatgactgggggcatggacatcaagtacagccttgaaggatgggatttgatttagagagataatgtagtgaagggcagataggaaatgcatctatccaggaaggacagagagacacaggaatttgcagtttgttctgggaatgggggagcaagggccatgaggttgcaaaggaggccaggagctttgacattcaagccaaggagcttgggatttgtttgggaggtagtagggagatatgtaaggagctggagatgggaggtgtgtgatgtgatcttttccacagggttcctgagcctgttgcagaggagtcttgcttgactctgccactggggtacgcaactccagcctcttgccgtctgttctcattatatccagagtcattccagctatagtactggtgtctggttcctcctttttaagctgtctgagacacctgtgcgtgggctctggagccttgcagtcaagcagctgtgaagggctagagaaccctaggctttgagaaagggcggggttggtgaaaccaggcaggcattatctgcagccagggtagggagcaggggctgccaatcctgcaagattgttcaggccctggggaaacactcagccccagggatttgcatggtcccttaaattttaccaacggacagtcattctttggagcaatatttctctaaatcagtaactctcaagcattaggctgcaccagagtagggtggccaaccatcctgatttgcgcaaggctttcagtgctgttaggttggtgcaaaagtcattgcagttttgccattgaaagtgatggcaaaaattgtaattactttggcaccaacctaataaaacctggagtgtcccaggcaaactaggacaagctggtcactcacctctagagtttcagattcagcatctctggaatctggaatctgaggcatgagaatctgcctttcttccaagttttcaagtgatgctaatgttgttggtccggaaaccacactttgagaaccactgctcaaaatctttccaaaatctgaatctttagggtggagcctaaaccctgagttttaaacaagctttttgggtgattccaatgcatttaaaaatttgaggccccgtgccttgggttcatgaggagttaattacctttgaatcctctcctgaccttggttagctgtaagcaccttagaaggaagagagttgcaaccaattgagagccaggcctaaggatgggccagaggaggaagcatggggaaggggagcaaaggtgtcgtctgagcatgaccctggggttgacaatgatctgcagacccatgcagggatagacgaggtggggagatgggggaggccggtccagagtctgggttcacagcctctgaccacgttccccgcatctctctgctcttcctaccagttcaaagtgtcaagaacaagcctctcttctttgccgacaaactttacaaatccatgaaggtaagaaaacatgctggcgttcctttcccttcaagcactgacttacatacacacacaaacacacagatgtgcaccatcccccagatcaggattcctggcagctgtttcttcccatttgacatttattagcatctgcccttgtctggctctaggatggtatttcccagttgggggtgatttcccccgccttcccccgccccggaggatatttggcaatatccagacacatttttggtcatcacaacttggagattgttgctaccagcatctggtggggacagaacagggatgctgttaaacaacctcagtgcaaaggataagcttgcgcaacaaagaattatccagccccaaatgccaaggttgagaaatgtgctctggaggcacacagggctgggtaggacacagtctctgccctctcagagctcacaatctatccggggacacagggtctcctaggacaaatagtcatcaaaggtcacaagcgctcccctctgagtctagtcctgcccttctgggagagcccaagccacactggccaccctctcagccactggagtctcaactgcagatagcctgggcaggtgggagggtaggaaggaacctgagaccctcaccctacagtctccaaatgtgacagccattcattgagcactcacgatgtgtcaagcctgtgccaagggcttcatctctctgaccacagctgaccctcatggcagtcctgtgaaattgtggtagcatcctcatttgatagaggaggaaactcaggcctaggtagggtaaaacgttgcccacatttacatagctcctaagaggcagagctgggactcgaacctagctctgactcctaggctggtgcttgtcgctccctgggggcagaggcagctctggctgcccacacattccatgccctgtgcctgctccttgggcccggtggtagtttcctagggctggtgtaacacattccagaaattgggtgacaaaagaaatttattctcatagttctggaggccaaaagcccaaaatcaaggtgtcgcctgggttgggtcctcctggaggctctgggggagaagcactcccctgcctctcctagcttctggtggttgccagaagtccttggtgtttcctggctgtgaatgcatcactccggtctctgcctctgtcctcacctagccacttttctgtgtgtatgtctgtgccctccctcttctaaagatattggttattggtttaggcttcaatctaattcagtatgccttcatcttaactaattacatgtgcaaataccttatttccaaattacatcatgttctgagtttccaggtggacatggggacactattcaacccacacacatcttttttgcgtgtcagtctggccagtcctgggcacagagggattttggtcaggactgtttgcagaagacagaggtggaacatccgccctgtttttggaaggaacaagggagaaaggcagatgggataccactgtttcttgcctgactgggctctatctctccttccgcctgtgtctccctcctgcctggctccaccagggtgctggcacagatgagaagactctgaccaggatcatggtatcccgcagtgagattgacctgctcaacatccggagggaattcattgagaaatatgacaagtctctccaccaagccattgaggtaaggggaggggctagaggttagcaggaagcgggtgagtgtcagatccctaatataagattagaagtctttattcccatggacttttttccagtgggttaccgcttagaacagccaggatattgaaatgaaagggggtctgtattgcattgtttataccgaaatcaattccaaaagaatcaaaggtttataattaaagatttccaaataaaacaagagcccattttttgctttttttaaagcaatgttatggaagtataacttacatatcatgggcaggcatggtggctcacacctgtaatcacagcacgttggaaggccaaggcaggtggatcacttgaggtcaggagttcaagaccagcctggccaacatggtgaaaccctgtctctactaaaaatacaaaaattagctgggtgtgttggctcatgcctgtaatcccagctactcaggaggctgaggcaagagaatcgcttgaacccaggaggtagaggttgcagtgagctgagatcacgccactgcactccagcctgggcaacagagcaagactccatctcaaaaacagacaaacaaacaaacgaaaaacttacatatcataaaattcacctgttttaagggtacaattcaacagtttttagtaaatttactgagttgtacaaccattcccataatgcagctggtttccaaacacttctatcatcccactaagctctctcatacctgtttatctagttccatccccagccataggcaaccaccaagctactttgtgtctctgtagatttgccttttctgaatatttcatataaatggaatcacctaatatgtgaccctttgtgtctgactttttgtttgtttgtttgtttttgagacggagtcttgctctgtcgcccaggctggagtgcagcagtgccatctcatctcactgcaacgtccacctcctgggtttaagcaattctcctgcctcagcctcccgagtagctgggactgcaggcatgcatcactatgcctggctaatttttgtatttttagtacagacagggtttcactgtgttggccaggctggttgctagctcctgacctcaagtgatccacctgccttggcctcccaaagtgctgggattacaggtgtgagccaccacacctggctgcgtctgacttttttgacatatggagcttatatttttgctctttgagatcagccaagatcttaaagtctgatgcttggttctacttggctaacgagactatgggcatctcagaggcagtctcttacagacttagtaggaatgtaagtaaattgttggcacattttgatactatattatgttttaaaatcatacatcaaaaaatacaaggacaaacaaaatcccgaaaaccatgtctcataacaatgataggagtccctcagaagggagatccataccataccatgggtcaggaagtttggcctccccagtctgaacgtataccagaccactgtgatgtgtggtgagcgtgatggtgtttgtacccattcccagcaatggcttggcagttagcactcaatgttgtttgttcaaataagaaatcacctaacacgatatgccaagggccatgggggagggtatcagcagagtgccaggggaaccaagggaggccagagttcactgtgcctcctgacgcaagagagtggccagagtgcttctcagaggagagggccctgctggcaaatgggattgggggtgcacaggggcatgttggacaggggagtgacaggtggagagaggactgagatgctcctgggggaaaggaacaggtgaagctgcagagctctgcacaggtcagatcccaaagggccttgaagccaggccgggagcttgcatatcttcctggggataaacaaaagggacgtggtcacatttatgtgtctgggagatcccagtagcctacatgtggcatgggatcctatgttggtcatggagagaagccgagggagatgtccagacagatgggcagccgggaggagggggcattgagactggaaggactgttttcactcactctgctctctgcctctgccagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgt

SEQ ID NO: 35733 - DNA, 33467 bp, Homo sapiens
gggccggggggcggagccttgcgggctggagcgaaagaatgcgggggctgagcgcagaagcggctcgaggctggaagaggatcttgggcgccgccaggtaagaaggcccgaaggcctgctggggtttgggtgagccgagccgaggtggcggcggcagtctgggcccgggcggagggtctgtgggggctacccccgtcctcgctttccactcgacccctgccgggcgagcctcccgaggcctggcccttccaacccgtcaccgcggcccggtgtcctagccgaacgctggcttcattttatctacgaggaaggagaaacggggagcgcgccctctcccagaagcagccccgttacccccgtcgcgccccccattccctcgggggcagcctcgcacccgggcccctgccatcgctttcgtctcaagggaagctctagcggtccagagaaactgcgccgggggaaaggccagccctccgtggtcacggcagttcctctctcccctcgcggtctaaatgtgtaattttgaaaagcaggtgtcgggcgaaacggacttttttttttttttgagatggagtttcgctgttgcccaggctggagtgcagtggcgcgatctgggttcaccgcaacctccgtgtaccgggttcaagcgattctcctgccacagcctcctgagtagctgggattacaggcatgcgccaccatgcctggctaaattttgtatttttagtagaaacggggttttcccatgttggtcaggctgatcttgaattcctgacctcgtgatccgcccgcctccgcctcccaaagtgttgggattacaggtgtgagccaccgcgcccggccgaaacggacgttttaagtacaacgtgatgttttgttttcttgggtcggctcgggccgcacccttcttagagtctgactgctgacttttcaaaaaacaacattaacccgggaggctgaggtagcggtgagccgagatcgcgccattgccctactgcctgggcaataagagcgagactccgcctcaaaaacgaacaaaacccacaaagaacaaacaaaaaaaaccaacattaagcagtgtgccttttatggccgtttagtgatacccaggctcttcactggtcatttctggaagtatttaacagcacttgatgggtaaaacaataggcttcacttcacagggtggttgagatgattgacggaaagcgctcagcacaaacgcggcggctgctaattatttcaggtaccctgcgatccctgagcagttgttcaagttctccactcctggcggtttactcccagttccctgaagaaggcacagagccccgaatgttgagggagatggcaacgtttgccaaaatgtggctatttacgtggcagtttatgaaggagaggcagaaagggaggctgcctcccctacaagccaaacagtcctaaaacttgtggcctctgtattttcacagtggaaactagaaactgtttgctgaacttagctgtaagaaaaacatcccattagctgagtggcttaggagataaaagcctaaataaaatggatcttagggtgagagagtggggtgcctaatggcattcatctttgacagctgctggtagaagctcttgaaaagtagagcatggaaaattctgggccacctctttaagaacctcagccaaaccgccacagacattgccaagcccagaagtgcttgaggctttctaaaggcaaagacttctttttacttatgtcctatatcttaggaaacatattcactaaaccttggttttgcatgtgtacttaacacgggaggggccgtgagtgcggagataggactctttggagagttagggattggcattccggaacaaactgcaggaaaggcccttgtaggggaagctgcagatttgtttggtccaaagagttctggcctaataagtgggagctgaccaatgagaacacttggacacagggaggggaacaacacacactggcgcctgtcggcaggtggggtgggtggggatagagcattaggaaaaacagctaatgcatgctgggcttaatacctaggtgatgggttgataggtgcagcaaaccaccatggtacacgtttacctatgaaacaaatctgcacatcctgcacatgtaccctagaatttatatgtatatcacacaaagagttttggagtggttattcctggcatgagaaccttggctggattggaaagccttttccgttatgatggttgttttctctttgtctcttcctgctgatgtaatttgttccgtgaactgagtgatggatgtttgtctgggcgcttcaacaggcatggctagagcaggtattgtgtatgtctccaaggtgacacgcagacctggggttcaaaagctctagttctctgacattgctgacactaggtatcttgtgagttgccagcccctggcgaatagaaacaagatccatccagggtggttttgcgactaacatgttgccttgggacaggtaatttcatcccactgggcctccactaatttcctataaaataaaaacattgggttttattttgaggacacttctagccttaaaattcttcagtctgtaaggcctcaggctcctaggaggagtaaccatactcatgggcaactgtgaatcttgtggaaacaccactgatgtcaactctcttctctaatgacctcagcttaactaatgtatttcagaagctgaatttataagaagtctcccgtctccccactagagtttaactatggttcgttcactcagagcttagacctgggtttaaatgctgttctaccagtttccagttcagaggttgctataataattttaataatttttttttttaattttgagacagtctctctctgttgcccaagctggagtgcagtggcacagtcttggctcactgcaacctccacctcctgggtgcaagcgattctcgtgtctcagcctctcaagtagctgggattacaggtgagtgccaccacatctggctaatttttgtattttttttagtagagacagggtttcaccatgttggccaggctggtctggaactcctggcctcaagtgatccacccgcctcagcctcccaaagtgctgggattataggcatgagccaccacactcggccttataataattttctactgctgctgaaaccaccacaaatttagctgtttcaaatgccacaagtttattaatctttccattctgtaaatcagaagtctgacacaggtctcacagggctgtaatcaaggtggcagggctctgtgctgctctggaggctctaggggagagtctgtttctgtgctcattcaggttcctggtagaatatagtccttgtgactggaggactgaggttctgtttctttgctgagtgtcagttgaggaccattcttagcttctaaaggccgcctgtgtgccttggcttagggaacccttcgtgtcttcatctcattcttcaaatttcttgcctctttttctgttgtcggtcatgagtctttgacagactctgctaccttcttcctctttcaatgacccctgggattacattgggcccattgaataatccaaaataatctccttaatctcatctacaaagtcacttgccatgcaaggtctcctgttttcacaggttcctggagttaggatacggacatttttggggaagagaggcattattctacctaccacataagttagttgcataaattagttctcttcctcaatcttgtttcctccccctgtaattggaggcaaaggttcagtttaccttatggtattattgtgaggattaactccagttactatgtcaagagcatctatcttagcaactggcccttgatatttgctcaccaaatggaagttaacacaggaacaaggtgtattagtccattctcacactgctataaagaagtacctgagactgggtaatttataaagaaaagaggtttaattggctcgcagttctttgggctgtataggcttctgcttctgggaaggccttaggaaacttagaatcatggtggagaaggggaagcaagaatgccttacttggcgggagcaggaggaagacagcaaagggggaagtgctacacactttcaaacaaccagatttcctaagctctgccacaagacagcactagggggatggtgctgaactgttagaaaccaccccataatccagtcacctcccaccaggtccctcctccgacactggggattaaaattcaacatgagattttggaggtgtattagtccattttcatgctgctgataaagacataccgaagactgggtaatttgtaaagaaatagaggtttaatggactcacagttccacgtggctagggatgcctcacaatcatggcagagggtgaaaggcacgtcttactggcagcagacaagacagaaatatgagagccaagtgaaaggggaaaccccttataaaaccatcagctcttgtgtgacttattcactaccacaagaacagtatgggggaaaccgtccccagtgattcaattatctcccaccaggtccctcccacaacacgtgggaattatgggagttacaattcaaaatgagatttgggtgggaacacaaccaaaccatatcacaaggtcttgcctaatggcttgcattcaatgtcataatcatatgggcccttaaaagtagaagcggctcctaaatatttaagaactaacagcttcttttataaccctgttggaagaaacatttccaacccaatctaaagtaacctggcccttatgccaggtcaccctctaacccagtggttcttagtgtgatccctgaaccagcagaaacgcagcacctgagtgctggctcaaaatgcacattcttgagccttacactagcccacctgaattaaaacctctagggctggagtctaatcatctacttaagagccctccaggtgattctgatgctccctaaagtttgagaaccactgttatgaccctcttttattttcgtcctagtctttagcaccagttggtgtaggagttgagacctacttcacagtagtaagtatactgatgagtgaattccttaaatgttattaaataattatttgatgtgttaaatgttttatgttcaatttctttggattgcatatatatatgtgcatatatatgtgtatttgtgtgtgtatatataatgtatgtatatgtgtgtttttacgtatatatgtaatatatattatatatgtttatatacagttgaccctaaaacaatgcagggttagggacactgaccacctacacggttgaagattcaagtttaacttttgactcccccaaaacttaattactaatagcctactgttgaccagaaactttaccgataacataaacagttgattaacacacatttggtgtgttatatgtattgcctactgtattcttatgataaagtaagctagagaaaagaaaatgttacttagaaaatcgtaaggaagagaaaatccattacagttctgtactatagttattgataccatcagtttatgtcgtctgtttacaagatgaattacttgtctgaaatggcaggcggccacaactgcagacctcaatctgtagtacatatcaagtagttcaactgttttttggtaacatcatgacttttttctgcttcttgggagcgtggccagcatcacttgtggcaccctgtaagggtctcatgtgtcattcaagttttacactattgcgcttaacacgataaagaaaatactcaagaactgcaagagatcaccttttactgtgatgtgcaatttcttaaagaggcaaacagctcacagataattagcatcacatgatactaatcatatccctgctgataagtagatccttgcaacacttgagctcactgcaatagcaacaggaggtggctatggcattattaacagtatatactatagttgattttatgcagtatgatttaatactgcatctttacatttgtttacatttctctttactttggtgccatgtctggtctgtgtttgtgtgtgtaagttttaataatttatttttttgagacagggtcttactctgtcgcccaggtgggagtgcagtggtgtgtcttggcccactgcagcctcaacctcccaggctcaagcaatccttccacctcagcctcctgagtagttggaactacaggcacacgccaccacacctggctatttttttttttgtagagatggggttttgccagtctcgtctcaaactcttggctcaagcaatccacccacctcggcccctcaaagtgctgaaattacaggcaagatccaccatgcctggctgacacattttaactttataatagatttgtgtatgtttttgggtagtgataaaatagactagtatctatatacattttatacattcatgacatacctaaatttttcttaattttaaaaaatatttctaggctatgcagtttatctaacagttttttcaattgcaaatctccaaaatattttccaatatattttcagaaaaaaaattgcatataaatggacccctgcagttcaaacctgtgttgttcaagggtcaaatgtgtgtgggtgtatatatatatttaattgatatttggggggccggttggggttttggatgaacagtaacacgttttcctacttaaaatagtggaaatagactcattacattttctacccaaatacccagaacatttgctatctaaaacattttcaggaacttgataagaagtgcctgtattttttttttttctcggagatacggggtttaagttcttttttaaaaattatactttacgttctggggtacatgtgcacaatgtgcaggtttgttacataggtatacatgtgctatgttggtgtgctgcacccatcaacttgtcgtttacattaggtatttctcctaatgctatccctcccccaccccccaactcccgacaggccctggtgtctgatgttcccctccctgtgtccatgtgttctcattgtttaactcccactgacaagtgagaacatgtggtgtttggttttctcttcttgtgttactttgctgagaatgatggtttccagtttcatccatgtccctgcaaaggacatgaactcatcctttttcctgcaaagaactataactcatagtattccatggtgtatatgtgccacattttctttatccagtctatcattgatgggtatttgggttggttccaagaatttgctattgtgaacagtgctgcaataagcatacgtgtgcatgtgtctttatagtagaatgatttataatcctttggatatatacccagtaatgggattgctgggtcagatgttctagatccttgaggagtcaccataccgtcttccacaatggttgaactaatttacactcccaccaacagtgtaaaagcattcctgtttctccacatcctctccagcatctgttgtttcctgactttttaatgatcgccattctaactggtgtgagatggtatctcattgtggttttgatttgcatttctctaatgaccagtgatggtgagcattttttcataagtttgttggctgcataaatgtcttcttttgagaagtgtctgtttatatccttcacccactttttgatgaaattgtttgttttttcttgtaaatttgtttatttgtagattctggatattagccctttgtcagatggatagattgcaaacattttctcccattctttaggttgccttttcactctgctgacagtttcttttgctgtgcagaagctctttagtttaattagatcccatttgtctattttggcttttgttgccattgcttttggtgttttagtcatgaagtctttgtccatgcctatgtcctgaatggtattgcctaggttttcttctagggtttttatggttttaggtcttacatttaagtctttaatccatcttaagttaacttttgtgtaaggtgtaaggaaaggatccagtttcagctttctacatatggctagccagttttctcagaaccatttattaaatagggaatcctttccctgtagcttgtttttgtcaggtttgtcaaagatcagatggttgtagatgtgtggtgttatttctgaggcctttgttctgttccattggtctatatatctgtttcggtaccagtaccatgctgttttggttactgtagccttgtagtatagtttgaagtcaggtagcgtgatgcctccagctttgttcttttggcttaggattgtcttggctatgtgggctcttttttggttccatatgaaatttaaagtagttttttccaattctgtgaagaaagtcagtggtagcttgatgggaatagcattgaatctataaactactttgggcagtgtggccattttcatgatattgattcttcctatccatgaacatggaattttcttccatttgtttatgtcctcttttatttccttgagcagtggtttgtagttctccctgaagaggtccttcacatcccttgtgagttagattcctaggtattttattctttttatagcaattgtgaatgggagttcactcatgatttggctctctgtttgtctgttattggtgtataggaatgcttgtgatttttgcacattgattttgtatcctgagactttgctgaagttgcttatcagctgaaggagattttgtgctgagacgatgggattttctaaatacacagtcatgtcatctgcaaacagacaatttgacttccttttttccaattgaataccctttatttctttctgttgcctaattgccctggccagaacttccaatactgtgttgaataggaatggtgagagagggcatccttgtcttgtgccagttttcaaggggaatgcttccagtttttgcccattcagtatgatattggctgtgggtttgtcataaatagctcttattattttgagatacattccatcaatatctagtttattgagagtttttagcatgaagcgctgttgaattttgttgaaggcgttttctgtgtctattgagataatcatgtggtttttgtcgttggttctgtttatgtgatggattatgtttattgatttgcatatgttgaaccagccttgcatcccagggatgaagccgacttgattgtggtgaatgagctttttgatgtgctgctggattcagtttgccagtattttattgaggattttcacatagatgttcatcagggatattggcctaaaattttgttgttgttgtgtctctgccaggtttcggtgtcaagatgatgctggcctcataaaatgagttagggaggattccctctttttctattgattggaatagtttcagaaggaatggtaccagctcctctttgtacctctggtagaattcagctattaatccatctggtcctggactttttttggttggtaggctattaattattgccttaatttcagaacctgttattggtctgttcagagattcgacttcttcctggtttagtcttgggagggtgtatgtgcccaggaatttatccatttcttctagattttctagtttatttgcgtagaagtgtttacagtattctctgatggtagtttgtatttctgtgggattggtagtgatatcccctttatcattttttattgcgtctatttgattcttctctctttccttctttattagtctggctaacagtctattctgttgatcttttcaaaaaaccagctcctggattcattgattttttgaagggtcttttgtatctctatctccttcacatctgctctgatcttagttatttcttgtcgtctgttagcttttgaatttgtttgctcttgcttctctagttcttttaattgtgatgttagggtgtcaattttagatctttcctgctttctcttgtgggcatttagtgctataaatttccctctacacactgctttaaatgtgtctcagagattctggtacgtcgtgtctttgttctcattggtttcaaagaacatctttatgtctgccttcatttcgttatttacccagtaattcaggagcaggttgttcagtttccatgtagttgtgcggttttgagtgggtttcttaatcctgagttctaatttgattgcactgtgttctgagagacagtttgttgtgatttctgttcttttacatttgctgaggagtgttttacttccaattatgtggtcaattttagaataattaccatgcggtgctaagaagaatgtatattctgttgatttgggatggagagttctgtagatgtctgttaggtccacttggtccagagctgagttcaagtcctggatatccttgttaatttcctgtcttttgatctgtctaatattgacagtggggtgttaaagtctcccactattattgtgtggaaatctaagtctctttgtaggtctctaagaacttgctttatgcgtctaggtgctcctgtgttgggtgcatatatatttaggatagttagctcttcttgttgcattgatctccttaccattatgtaatgcccttctttatctcttttgatctttgttggtttaaagtcttttatcagagactaggattgcaacccctgctttttttgctttccatttgcttggcagatcttaattcattgtgagtagccttccacgcccattacttttcctggctatgcggttccccaccatggaagtgtaccatagtatactcatttccttattgttggatgtgtgtatcactaaatttttgctattttaaagaatgtttgtatgcccttgactatttcttattcctgtgatgaaaggcctacttggagctcccattacggaaatgactttagagtcaacttacgcaccacccaggaaagcctgccgttccttcatcatgggggaagacttgttcctacatatcttctttgagggatttttcagttgtgcattctttagaatgattaaaaatcattcagaacaatagcagtattattagaacagtcgttagggacaaacccaccgttattaatgaatcctgaaatgtttggaaaggagttgagtgttgatgctttctgagtgtatcttgcatttaagtacttggtttgggtggaatggcaacacttttggttcatttaccatcttatctacacttaacttatgggcatcttcttttttttttttttttttccttaaaatggagggtgttttagtctagggagtagttttaccaaaagatagatgatctatgactactagaaaaggaacattgtcatgtgtgaattttcctgatgtttctgattgtaaaagtaatacttggttaattatagaatatttggggaaaggatggcaaaaagtaaaggatcaggaagaaaaataaaaagccataaatgatcttgcttagtgttagttaccatctacattgtagggcatttataaaatagctttaaaacaatcagctgtttctttttctgcctcccgccctcctccgccccccatacacatacacatactccatatgaacgttttgctcttggaaattcatattttggcagtggttcataaaggcctggtcttattttgatggaacagcccgaccttggcatctacacatagctacttcctttctctgctgtcttggcttcccctgcagcatgtcatgggatcagctatagcaacaaccagccagtcatgtggaactgaggctaagacttgacactccccaaccatcccagaaaactgagggcttccttaggtttgatgcctgaggtctcccctgctcattcaacccagggtgtttctctggcttcctcacctcacatcaccctctgtctgccttcccaccgttcaccccccaacactccctccccacacaatttcttcctcaagtaacctcattactcctgagtagcactaacagtggccacagctttttgagtgccatctttggccaggcattgtgctatgcagtacatgtaactatctccatgcttactagccaaagcgtgatcagaggttaacacatagcaaagaggtgacagagccagaactatctggccttgttcagaggcctccagattggactggaatgcctgtgctctgaaccctttcattgtgttcttcctgctttcttagcaggccacttctttctaaggtacttcaaagaacagctccccatcaggggccctgtgtgttgtggcagtgtgatttatgtcaaggaccattccaagggaagtgtcctgaaccggcagctcctgccagcctgacacctttccagtgcctaacccgagtcaggagattccttccttcctccttccgtggggatgcctgacattgtagctacattgggtttttgtttgtttgtttggagagaggaccttgctgtgtcacccaggctggagtgcagtggcacagtcacagctcactgtagcctttacctcctgggctcaagcgatcctcccacctcagcctcccaagtagctgggactacagttatgtgccaccacaccagtctaatttttttttaatgtttttatttttgtagagacagggtctcactataatacccaggctccgatcatgctatgcttaacttttaggaagtgtctggagctctctgttcggggacctcagaccaataccttcctctccctgctcacttgtagcagttccttgtatactggagccctgtctaacctgagtctataaatcacccttcctactcagaaacccctgaaaatggggaaccaagcaagccgctggcatgtgctggagcccaggtctcctgggaaggtccacatgggggatggtgtcccgtagcaggctgtaggtttcagagcccagcgggtggtggggagccctcaatttgtaaggaaaggccagatgacaattgtctttcttcctggttcctcacatatcataaaaccacctctttctcatctccaccacccccatctccaggcttgactcactgattgttttcttttttggacaatgtcagaccctgcccttttcctggaacttctcagtcctccactggcctgcgtcagcaaattcctaagtagcagatgaccttcaagatgtgtgagaaggaagggacaggaatgattgtcaggattgtcagttccccagggaactctgcatttctgacttagggagggtagatgactcacccttccaagaacccatctgtctgtccgggcctgtggggctctggagaatagaatatggagtaccctggtttacaggcactgccacctccttatttcaggatgggttcagggatgtaggattggagttgggagatttcttagttctgctatggatgctttgtacttaggcaagttcaaaacctccctaagctttggcttctttactgggtaaagtagggttggaggcatttcaggctttccttcttctcacctgatgctatcactacacatctaggcattcacgtaatggaaacttacaaagttgctcaatacctctcttcatgtccccaaagagagcaagcaagtgtccccattatacttcttacagtgaggagccagagcttccaggtatgctaagccattgctccctgttccactgctgaatgcatgctggtgccttccagagtcacccctttggtctgattcacttagtgctgtggctccgagaagtggccctctctttcagccagcagcttggggtggggccagtagagtgggaaccacagtggctatatgagtcaatttgctcatattgtcatttgactcactgaccctgatggggaagatagtgttattcccacagtgtggtagtacacactggggcttatagggactgagcctactcaagggtatatggtgctgtgggtcagagctggggcatggcccagggattcagtgtgccttgactccccctgtaaatgttcctctcagaagccttcttggccttccagcccttggtttttgagacaaccagcagtcatttgttcgttcctgacattccttcctgtcccttccttccaggttctgtggacaatcacaatgggaatccaaggagggtctgtcctgttcgggctgctgctcgtcctggctgtcttctgccattcaggtgagtgctccagtctcaggacatggatctaggctgccttggccatgaactcccttcttaagcctcagtttcagccccagctgctcctccaggcctggctttggttcttttgccttccagtgttacaggtctggggttgtatgacagctccttcctatgttatgaccttgtcctcagtggggcatcgtcctgagttacagcccgtcctgagttacagcgtggcttttggcaggggtgggtcaacaatcggcggctgaagtttcactcctgtcaccataagctgcttggggacaccaatggataccattcttagagtgctgtgcaagtccctttggggtccactctgcttagagccatctgagctcagtccttctgctctgaggctcctcctgtgttttaatgatgatgatggtcatagtgacagcagcagcagctaactaaccctgaagcatttatgtgccagtcactactctaagcattttacgtgtatttgcttatttaatcctcatgccaacctgatggagttggtggtatttttatccttgttttacaagcaacaagattgaggcctccccaaaattaataacttgtcaaataacacacagaagtggtacacgggaatgtgaacacacagtctggcaacagagtccctgctcttccctcctgctccaggccatctgtcactgggccaccccctctcctcagccacccctcccctggttgctggaggaaattgtgtgcttctgagtcaacttctataacagtggaaacacacatgcttcattgtaaagatcaagtgtggttgtctgcctgtgtcatgttggtataatatcttggccactgctggttttttgttttttataaatatggttggtggggggagcagaaaagaaagtggcaatacagtgagcaatttaaaaaaagatttccacaccactgtagcatgtcttagaatattaacagcaaccatatattcactgtttattgtttactggggactgtgccagagcctgtctcatttaaatccgtccagccattccgggaggtcggtactgttacctcccatattacagctgaggaaatgaaggcaaagtagtaacttggcgccaggacacactttaatatgttctccctttctgagcagaaagagaagtcatggcaccccttcttccccaccttccgtgattctagccagggtgcactgtaatgtggttcacctgtgttaaaacactatattttttctataattattttttatttattcatttttcttggttccttctttttttctgtctctgctgcttaagttggaatattttctagaattttaatagcccagtgacatcctacttccagcagtctgcatttgtttatggagcaagcttgggaccatcagcttctctgtgacaagtcttggggtgcacttcagccctttctcagagaattgagatgtgaagctcacatgcccacagatgagaggccttctttgctgctgcccaaaagggtctcaggaccctgcaggggaactttcctctgagctctgcctcttatggcccaggggaaacctcgtctaccctggcttagtggctaaaatatcaaaccattgtccactgacctattgcttgtttttttttgtttgtttttttcagggggatggagtctcactctgtcgcccaggctggagcgcagtggcgcgatctcggctcactgcaacctccgtgtcccaggttccagcgattctcctgcctcagtcttctgagtagctgggattacaggagcatgccactatgcctggctaatttttgtatttttttttatttactttttaatttttgtatttttagtagaggcgggctttcaccatgttggccaggctggtctggaattcctgacctcaaatgatccacctacctcagcctgccaaagtgttgggattacaggcgtgagccattgcacctggccctgttgcttgtttttgacctcagtttccaccataatctagagtttccttctcttcccactcaggtcaattagaagaacatcatggttaaccaagcttggattttagaactgacagcctgagtttgagctcagctcggtcacttagtagctgtgtggctttgaacaatttagttaacatcttagtcttagttttctcttgcaaggtggggatgaagataattgagcctagttctcttaacaatcctatgaagagcttagcacatagatgcacatatatttgaacactgaatgaacatgtttgccatgaatatttttgcccacagacgttccaaccatgggttttagcctttccttctaaagctttcttaagaggccaaatgagcccgggatctagccaccacaaaaatccatgtctacaggtaaccttttaaaatggccctcaaacatggccagtctcaagaacaacacccttcatcttagactcttttcatttcatgcgtgtgaatacatgtctggcacaaggaagggaccaaagaaaaattgcatctttgcgccttctccttgtggcttccctctcacacgggcatgacagccacaggctgacagtgggggagaacaaacaaagcctggtggatggggccctgcccacaggccccagggctgccgccagctctgctgctttgtagccaggtgtccttgtgtgagtcacatcacctctccagacatctgtcttgtcatctgcaaaaaagttggggaggaggttggtttttattttattttattttatttattttttagacatggtctcgctctgtctcccaggctggagtgcagtggtgcaagcttggctcactgcaccctccacctcccaagctcaaatgattctcatgccttagcctcctgaatagctgggattacaggcatgtaccaccatgcccggctaatctttgtatattttgtagaggcgaggtttcaccatgttggccagggtggtctcaaactcctggctacaagtgatccacccacctcggcctcccaaagtgctgggattgtaggtgtgagccgccacacctggcctagtttgttgttgttttttaaaactaatatttcaaggcattaatctgtaaccttcacaagtcagaggatcctctattgggtaggatttcacacctgtgagggcagacatggccatttcagatgctctagagaactgggttcctgtgtgtgctcagaaagtgaggacccaccttgcttccactggactttccactgaaaaatctatttccatggtgataaacctagccttcagccttagaactagaagtcagctgttgggctctaaaacccacacttggtttaaccatgacattcttttgtgagattttacgtgtttcatctttgaaaatgtcttttcacagaggtaggtacttccaaatactgattacatggtagaagtcatatggcatgaagatagtttatctctgatgatggaaaagggggtatccatacaaaccaggaagatttccttccaactcttgcttcctcagtctctccccatcacacgtgtggactgtaactcatctttttgttgtcactgttgttacaaaaatggagaaggaaaaataacccagcaaaaactgacagctagcaaggatgagtcttaagaattgactgggagcaataattgtttttcaaactagggaactggaggcaatttgcttctgatgtaagatgaccctcacgttgtgtctgctggtacccagctgtcctatgcccatgggtttaaagtgcacagctgttgtcttgtctttgacagtgtgtactcctggcattcggtcagtcccttagaagggagtagttcagtaatgataccctgtcccagaggttaccaaactttttctgtacaggaccagatagcaatttttttttttttttaaacagagttttgctctgtcacccaagctggagtgcagtggtgcaattgtggctcactgcaacctctgcctcctgggttcaagcgattctcctgcctcagcctcccaagtagctgggattataggtgtgcaccaccatgcctggctaatttttttatttttagtagagatggggtttcgctatgttggccaggctggtgtcaaactcctgacctcaggtgatccaccctcctcggcttccctaagtgctgggattacaggcgtgagccactgcgcctggcccagatagtaaatattttaagctttgcagaccaagaggcaaaatcaagggtattatgagacttacctcaataataagaaacaaaattttcacagatttttttattgacaaaattcataacataattattgagtccagcataataatacacatctactaatgaggggaatagaattctttttagggggataaccatttgcttaattggggttcaaaattagtgttccctcgcatcaaatcaattgcagatgttcatctattaatactaatctgtgatgacattttacatatttcattttgaaaatgtattttcacgcagataggtattgccagacattgatcatcaacccacgaggatgtgatttaattgggcatattcattgcttggaagacacttatagaattctgtttgtttctcggtaatttcttcttaacacatcattacattgcagactaatctccttccagttgcaggttaggaggaagcttctcaattgcacagttagatggatattcaaatgtggatatttcctttgtgcttgcatcagggtccaaaaaatgttgctggaactgtagtttgaatttggaaagatataactgctatacatttgtgcgggagtggaagtataccacaagttgctgactttgggcccatattaatggagatggtgggctgccaggggacaagtcagtgctgctttaagagatcctgactttcttcctgattctaggtcatagcctgcagtgctacaactgtcctaacccaactgctgactgcaaaacagccgtcaattgttcatctgattttgatgcgtgtctcattaccaaagctggtaagagcctcccctgtctgtctcctaaatgtaatggggtaataagtgcctgggaaaaaaattgtgccactgtaatcctcattaggcttgcatcaagtaatagctaccatttattagcgtcaggtgtgtattgggctaagcactttcttcatacattttaaatttaatgttttgcacttctaagggtgatcttttatttccatttgataaatgtggaaatggaggttcagattaagcaagaaattatggttaagtaaccgactcaggaattgaacatggaagtccatctgattccaaagcttgtgctcttttacagcagccctgtgctgcctcccagaccttggagaacctactgtgtgcccagcagagggttaggagctagggatgcaaagataaagaaaggacacatacaattaaaattatgacaaaggcctgtttggctgtcctaaatgtcattatatatgcctctgtctcattccatggggtatctggtatattcagagtcctgaggagactcaagctgagctcaaaggacacgtaggaggtaagagggctaagaagggaagggtgtgcctgggaggggcaacagcaggtgccagggctcggtagcctcagagcaaggtgctcatgaatttggggatgggcaatgctaacatgcacaagtcctgtccagtctgcattttccaaatttgttagactacagaatattcacctccatcaccctgttaaaatagagtttaggaagtggtagacagaggaaagaaaccagcaaagacatgccctctgttcttgctggggtgtggttctggatagaatcgatgtgtgcaaatgatgccagcgaggaatggcagtttcagaatgttcttagtgtccaaggtaaaaccctcaggcttagatttctaagagattaataataaaaacactccacaaggttatttgtactcttagaccttctacaccagctccccccagtgtcaacatcaagaaatggtgaacatgtcaggtaaactcagaaaagccttgggacacccacatgttcagaaaaacctgagataaagatgattaacttccccagaaaggagaaatccctcaataactaaagacaaattatagttaccctgtctaaaaaaacaggggcatctgataattttgatatatttagctggatttgataaatttgatatagtttagctggattgcagctaaaactccaaaccttccattcagagctcttgattctgtagggcaccagtccctctgcccccactggaagaccatattcattcactgttaatgtaggaagcgtagtaaggcccctagcgagaacatggtcattatgtacgagcacagaagacttggctctttagcttgatcaactgtgtctcttggactcctcactactaagtataattaaactaagtatagtttccaaatgagacgataagggcaattactatgtgttgaatgaatattacagcagcaattagagctctgacttctgtcctgccaccagctagctctctccacctctgtttttcatttatgaaatgtatgtgttggacagcagaggtagggaggagaggaaaggaggtcaaagccaagatctttttccagctcttaaatcccaaaatttcttataaatggttaatgtaaacaaaaatgagacacacctattaaaatggccaaactccaaaactctgacaactccagatgctggtgaggatgtggaacaatgggaactttgtttttctggttttttttttcttttttgagacaaggtcttgctctgtcacctaggctagagggcagtggtgcaatcttggctcactgcaacctctgcctccagggttcaagtgattctcatgcctcagcctcctgagtaattgggattacaggcataagccaccatgcccagctaatttttgtatttttagtagagacggggtttcactattttgcccaggctcatctcaaactcctggcctcaagtgatctgcctgcctcggcctcccaaagtgctgggattacaggcgtgagctaccacgcccagcagcagtgggaactttgattcattcctagtgggaatgcaaaccagtatagctactgtggatgacagtttggtagtttattacaaaactaaaatataacacaatatataatacttgatattttgataattatatacagtatataatattttataataaatgtgttactggtttgtgtatttactatattttttatcatgttagcatgtagtccttctacttactaaaaaaattaactataaaacagcctctcgggaggctgaggcagaagaattgcttgaacccaggaggcagaggttgcagtgagccaaggtcgtgccattgtactctagcctgggtgacagaacaagactctgtctctacaaaagaaaaaaaaaaaaaaaaacagcctcagcaggcaggtccttcaggaggtattccagaagaaggcattgctctcctaggacaggacagccccatgagtattcttacccctaagaccttccagtgggacaagatgaagaggtggaaaacagtgatactgatgatccagaccctatgtaggactaggctaatgtgtgtgcttgtgtcttcatttttaacaaaaacaagaaaagtttttaaaaatttttttaaataaaaaagcttataaaataagaatagaaagaaaatatttttgtgccactgtataacatgtttgtgttttaccctgttttattacaaaggtaaaaacatttacaattaaaaaatttctaaagtaaagtggcagtaaactagggttgattttttaaaataagcttagtgtggactaaatgtacaatatttaaaacatctacagtagtgtacagcaatgtcctaggccttcacattcgcccaccactcattcactgacttccaatctcacaagctccattcacagtaagtgccctgtacaggtgtaccatttttaaaatcttttgtgtcatatttttactgtatttttctatgtttagatatggtcagatacacaaatatttaccactgcattacagttgcctacagtattcagtatagtaacttgctgtacaggtttgtagcctaagagcaataggacataccacatagcctgagtgtgtactaggctattccatgtaagtttgtgtaactacacgctatgacgtttgcacagagacagatatgatggtgctatacaaagtaagtctagaagagagacaggttggctgctaattcaaccaatatttactggcatcctagcagtataaaccatggaagtgtaagcaaggttaaatgtacttagtcttgaaggagcctctgatgacagtgtcaagtggtcactgctgtaatgacgttctgaacaagggccacatttaagggtgcctaggacagctgaagactgttgactttagatagacttgagccgaagtcttcaaaaagagtgaggaggagaaaacctgtaacactccagggattctgatataagccacttttatgtggataattccaaggctggctttggtgagattattaccatcgttaaggctgttgtttgaatatgataattcaagtaaagcactttggtacgctgcacgacacatagtaaatgattaattggtagcaattattcataaattactgtctgttctccccaagcttctaggcttccctaattaaaattctgatagctttaaagcttttcaagttccaatgcgtaattactgttacaaagcagtaacttgtctgaatcaccagcagcctctagtacaatattagaagcttccagttatttagttaagacttcagcaactagagccatttctggaatactctatgtggactctgccacttgactaaacttcattaaattccaatccagatacccatcccctcagaggaggaggacaggacagttatgcctgcagttataaactgagaagtgttgtgttccaagctctgcatggaattgggtaaattagctacaagcctgaaataaggaagtatgcatctgcgtttttttctttccagcacagaagataagaaaccactttcagggcaaggacaaataccttcttataccccagtatctagcacacaggcactcagttatttttggagaagaaaatctaccataataccactctctcaactaatacatttttcacctaacatgctttttctgaatattaaaaaaactgtgataagatacttggagtatatacttctggcctttattttcctgtgtgcccaaggctatttttccaaaaatgggaccatgatggcgtgttttttgtagaaacttttccagtattactgaataatctaatgatttttaaaatgaagtttcaaatattttaaaaataaatcatccatgtggcaaattaaaaaaactcaatagaaacataaacgaagtgtattcttccatgatgataacactattaaattacttgggaatccttccagagaaaaataaatgcacttacctcaatgtatatgtgctttatttccacaaatgggtcacattctatacactgttctgcatctagggtttttattgagatataattcacagaccagaacgtttacattttaaagtgtataattcagtggctcttagtatatttacaaggttgtatgacttatcgcaactgtctaattccaggatctttctgtcaccttgaaaagaaacctgttagcagtcagtcctcattcctccctcctgcatgccccagcagtgactgatgtactttctgtcttcatagatttggctctcctgggcacttcatatgcaaggaatcatacagtattgtggcactttgcgactagcttttttttcactaaacataatgtttccaaggttcactcatgctgtggcatgtatcagtacttcattctgttgtggccacatagtattctattgtgtggatatatcacattttgtttatccattcaccagtaatggacatatgggttgtttccactttttagcaattttgaatcatggtgccatgaacattcatgtggaaacttgtgtgtgaacgtagttttcaattcaaactacgataagatacttggagtgtatacatctggcctttattttcctgtgtgcccaaggctatttttccaaaaatgagaccatgatagcatgttcttatagaaacttttcctgtattactgaataatctaatgatttttaaaatgaagtttcaaatattttaaaaattatccatgtggcaaatttgaaaaactcaatagaaacataaacgaagtgtattcttccatgatgataacagtattaaattacttgggaatccttccagagaatggcagaagtatatacacttgtgagtggaattgctcagtcaaatggataactctatctttaactttttgcagaaatgccaaatttgtccagagtatctacaccattttacattcccaccagcaatgtttgagggttccaattttttccacttccttgcaacatttgctatttaccattttcttgatcttagccatcctagtgagtataaagtggtatctcactgtgattttcatttgcatgttcctaatgactaatgatatcaagcatcttttcatgtacttattggccatttgagaatcttctttggagaaatgtttattcaaatcctttgcccatttttttttaaagaggcaaggtcttgctttgttgcctaggctggaatgcagcagtacaatcatagctcactgcagccttaaagtcctgagtccaagtgatcctcctgcctcagcctcccaagtagctaagactaaaggcgcaacaccctgcctggctaatttttttattttttatttttgtagagttgggatatcactatgttgcccaggctggccgcaggcaatcctctcacttcagcctcctaaagtgctgggattacaggtgtgagccatcacactggcctcattgtccatattttaattgggttagtctttttattgtagagtttaagaatgttttctatatcctggatactatgctcttacatatgactttaaaaaagaaatagagagggggtcttgccatgttgaccaggctggtctgaaacttcccgcctcaaacaattctcccatctcagcctcccaaagtgttgggattacaggtgtgagccaccgcacctggtggtttacatgtgatttgcaaacattttctccctttctgtgagttatctttttattttttgataatgtcctttgaagcacaaaagttttaaattttgatggagtccagtttacctatttttctgccccccccccacctttatttttttttttttaaatcaagctccttccatgttagcacttgaaggcccacgtcatttcttatctgcatggaacttgcattgtaaggaattctattgtaatttctttaacactttttaaaaattaatggactgggtttttcaggtttttttctgaccattcttgagcatatatcttatacatagctttggctgggcatggtggctcacccctataattctatcactttgggaggctgaagcaggaggaccacttgagcccaggagttcaagaccagatgaccgggcaagaaagtgagaccttatctctctaaaaaaaaaaaagaaaagaaaaggaaaaaatccccaagtaacttcatagcgtaaattctaaaagtggaattgctggatcaaagggggcatgtgtttaaaatcttggcagatattaccaaatttccctcttaacagtataaatgcctgttcctcctccgtcccacccccataactatactggctctgatgagaccttggttttctgtaaaagctctatttagaggtgtatcattatttacttaattgttctcctttacaacccacctgggatgagcatcttgcctagaagtctctacttgcacaggatacatacgaaatagaattgaggattcaaaagcagatacagaactcttcccacttactttcttacccttgtgtgtgtctccccacagggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcgattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttct

SEQ ID NO: 35734 - DNA, 17162 bp, Homo sapiens
agtctgcactggagctgcctggtgaccagaagtttggagtaggtttggtgctgggcaggggtggggagtagggtggaaagcatggagtgaagaggtctagggagggggtctcctcacccccgccttcctgcccgccttgatctcgggggtctctataggcttgcttccacctgggacttctgcctcctcctaccccagcccctcccgcctcaggcctgttgtgctcagccccccaggacctcccctcccccacgcctctggcctcattgtttggttaaagcaggaccccctccccctcccaccacctcccctccgactgaacagatggacagagacccgggcccacggggagaggaagggccagccggtgccgggaaagggaagcggtttggggaaaacaaaacagagggaggagccagggagaaggtggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggtatgtggtcccttgtgggatgggggacgggggtggagacgggaggcgggatggtgcggggtgcgggcggtggctgaggattaacccttcaggctccggggaatgaggagagctcctcttgggatcattgagtgtgatccttgcacacgcactcgtagatggtggaaagagctcaggactcagacagatgcaagttctaatcttggcgggccatgtaggagctgcgcagcgtggtcctgaggacgtcacttttctcagcctactcctcctgatttataaaatgttgaataaacagatcccaccctgtccaccaagcaggcttggcaggaggatcacatagggcaaggagatgggaagcattttgtgatatcaaagcaagagtttgttgtagaaaagagctgtggggaggagaggtttggctgctgtgacacagacggtggtcccaggctagggcctgtgaagacagggaagaatggtagcaaacatacgtgggtctgggtgggggtcaatagcagtgagaggtcccagtggtctgggaggtcatggactagaaataaggctaagaagtgcaggatcccaggagaaaggtaggtaggggtgtgtgtatgtgcgtgtgtgtgtgtgtgcacgcgcaagttggtatcacatactcagcagatgatgtagttatgagcagggagtttggaatcagagaccttgttttgacccctagctgtttctcccatttctgtgagaccctggactagttaatatgtgtcggtatgagtttctctacctgtgaaatggagctaatgcgtggtttctcagtggaggatctgttgacattggggctggataattcattgctgaggggctaccctgcgcattttaggatgttttgcagtatatctctagcctctacgcactagattccggtagcatcttccctgctgtctccctgtgacaaccaaaaatgtctctggacattgccaaatatcccctgggagtcaaaattgtttcagagccgctggcctatactacttctctctccctcccttcctgcctcccttctttcctccttccctttcttcgttcccttcctaatgtgtactgtttttccacacccactaatgggttgcaacccacagtttaaaaatttactgttctaaatcaaggagcacaagttcaaatgtctgtactagccaagcaagtgagtcaaacaggtagatatttacaggaaattgcaagaacatagataaatgacaacactcagcttcactgtttggaaaacaacttcctacagggcagtaattggtcagagattacagagtccctgactatccctcatcttctgcagagcacattcctgtgcacccccaccctcaccctgtattgccccttctctgaggaattagtggtggtggttctaagacagattgctcatctgccgcactgtcagaaattactctcttgtacaggacattttccacatccacaccttctcttcctgctttgagtattttagaggactgtgcctcgtagtaagaaaaaaatgaaactcagtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggtaagaccctgcttgaattctctccaggtcatttgttggacactcccataagagtcaccaatccagacacttacaaagccatgcctctgggaagaagctgtaaaaatgggctattatatattgggggtggggtagagggatgtatcttttcattcttgaacattccatcatttcacagtgatgtaataggcacgattgcttgtaaaactctgtgactatacaagaacatataaaataaggtcgcagccactaaccatgtttcatggcaaggagaggtgataagaaagatgaaattaggcgcagtggctcacgcctgtaatcccagcactttgggaggccaaggcgggtggatcacctgaggtcaggagttcaagaccagcctggccaacatggtgaaaccctgtctctactaaaaatacaaaaattatcagggagtggtggtgcatgcctgtaatcccagctacttgggcagctgaggcaggagaatcgcttgaacccaggaggtggaggttgcagtgagccgagaccgcaccattgcactacagtctgggtgacagagcgagactctgtctcaaaaaaaaaaaaaaattatcagagatagacctagagtagatgtggttagtactgccttctagctctgtgaccttgggcagatcactttaacctctctgagccttgagtcctcttgtgtaaaatagtgatgatgctatctacctcaaaagattaagaagcagaaagccaggccggatgcggtggttcacacctgtaatcccagcattttaggaggccgaggcgggcagatcacgaggtcaggagttcgagaccagcctgactaacatggtgaaaccccgtctctactaaaaataaaaagaaattagctaggcatggtggtgcacacctgtaaccccagctactcaggaggctgaggcaggagaatcacttgaacacgggaggcagaggttgcagtgagccgaaatcatgccactgcactccagcctgggaagactgagcaagactctgtctcaaaaaaaaaaaagaagcagcctagtgtctgacttagtgggaggtcaaaaaaatgtaaatcctctgccatcttgagggattactgtcaagtcccatttggtaattaccctaggaatggcacaaacaaattactacaagcagtggggacagagctattactccccagagagaattctaaaaaggctacagaatctttcttggctgggcacggtgactcacacctataatcctggcactttgggaggccaaggcaggagttcaagaccagcctggccaacatgttgaaaccccatctctactaaaaatgcaaaaattagccaggcatagtgatgcatgcttattgtcccagctacttgggaggcagaggtgggaggattgcttgaacctggagattcaagtgagctgagattgcaccactgcattccagcctgggcaacaaagcaagactctgtctcaaaaaaaaaaaaaaaaaaaaaaaaaagagagattgagagaacacttccagctcagatgatctgtgatcccctccaaagcagggaataccctccattccagcctggtccccaaccctcattcccaaggaaggcccccgactcatcctgcaagtatctttcatctctgccctttgttgcaggggctggggagaacaccaaaacaaacctggagagcatcctctcttaccccaaggacttcacctgtgtccaccaggccctgaagggcttcacgaccaaaggtgtcacctcagtctctcagatcttccacagcccaggtgagtgcccaggaatgggcagtgtctgcagaggagggtcctgagaggactctgaagggggacccagcgctggggaaagaaaggacagagggaatgttggagctacagtatcagggatggactgcagagcaggtgaagaccttggcaggagcattaggtcactccaggaactagactgttcttctaatgagaccttagacaagtctctggcattcatcaactgctttagaataaaaataaccgggcaggtacagtaaaatagtgatgatgctatctacctcaaaagattaagaagcagaaagccaggctgggcgtggtggctcacacctgtaatcccagcactttgggaggccgaggcaggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggcatggtggcaggcgcctataatcccaactactcaggaggctgaggcaggagaatcgcttgaacccaagagagtgaaggttgcagtgagctgagatcatgccacttcactccagcctgagtgaaacagcaaaactctgtctcaaaaaaaaaaaaaggaagaaagaaaaaaggccaggcgcggtgactcacgcctgtaatcgcaacactttggcaggccgaggcaggcgattcacaaggtcaggagttcgagaccagtctggctaactaacatagtgaaactccgtctctactgaaaatacaagaaattaccctggcatggtggtgtgcacctgtaatcccagctactcaggaggctgaggcaggagaatcgcttgaacctgggaggcagaggctgcagtgagccgagatcgcgccactgcactccagcctggatgacagagcaagactctgtctcaaaaaaaaaaggccgggcgcggtggctcatgcctgtaatcccagcactttgggaggctgaggcgggcggaccacgaggtcagaagatcaagaccatcctggctaacaagatgaaaccctgtctctgccaaaaaaatacaaaacttagccgggcatggtggcaggcgcctgtggtcccaactacttgggaggctgaggcaggagaatggcatgaacccgggaggcggagcttgcagtgagccgagattgcgccactgcactccagcctgggcaacagagcgagacaccatctcaaaaaaaaaaaaaaaaaatggggcgggcgggccaggcgcggtgtctcacacctgtaatcccagcactttgggaggctgaggtgggcggatcacttgaggtcaggagttcaagaccagcctggccaacaccaggaaaccctgtctctgttaaaaatacaaaaattagccaggtgtggtggcacgcgcctgtagtcccagcaggagaataacttcaacctgggagacagaggttgcagtcagctgagatcgcaccactgcattccagcctgggtgacagaccgagactctgtctcaaaaaaaaaaaaaaaaagaagaatacccatatgcattcattaatatatagggctagagggctagagagctatagacataaaatagacaaaaaatttttttgctcatttttgggtcaaaggagtcttgggactctaattcttttaatttttgtgttatgtgaatttgttatcatttacatgtattatgttattaagtaggtaataatgataatactaataataaacttacaaaacgatccaatgtagttgttttcagactttgttcctcggagccctaggactttgcaaagctgtttctggagtcatggtgggagtggggtgtggggagcctgagcagtggggaagggttcaccacttcctgtgagagggaaacggaccagctgggctctgagctccccacccagcctcagccagggtccattttatattgtgggcttcagacatgcctttgtttgaaagcagttctgctgctttaaaatgtttgataaccattgaactaatctacccacctccctttttaaaaaaaaaaggaaaacttttttttaagctgttttttttgttttttgtttttttttaaactgtaaaaacaatacttaggtctggctcagtgtgcctgtaattccaacactgagaggctgaggtaggaggattgcttgaggctagaatttcgagactagcctctgggcaacatagacagacctcatctctacaaaaaattttaaaaattatccgggtgtggtacgtgtctgtagttccagctatgaaggactgagacgggaggattgcttgagccaaggaattcgaagttagagtgagctatgtttatgcctctgtactctaggttgggtaacagagtaggaccctgtctctaaaaaaaaaaaaatttaatttaaattttaaaaactcacctatcaccccatcatctgaaaaacaccctctttcagatgtgggaaaaacatggctcagaggtgttcaagaaatgttgcatttatttattacttacaaagctgtaagtcagctttatccgctgtcttgctaggttggtgaaaaatacgtaacagcattcaatattagggcttctatccccatctagctgcacactggagctgtgccaagcaaggttcttggtcttatgttgtacttaggcatcagcaaagcctgggaaaatatcttttttttttttttgagacagaatctcgctctgtcgcccaggctggaatgcagtggcaccatctcagctcactgcaacctccgtctcccagattcaagtgattctcctgcctcagcctcccgaatagctgggattacaggctggtcttgaactcctggcctccagtgatccacccaccttggcctcccaaagtgctgcgattacaggtgtgagccaccatgcccagctggggaaaatatctttaatctacttagtcctagaaaaattatctttcaagtgctttttttttttttttttcagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttggggctacttctcttgttcttggttctgggtttaccttctttgggccttatttgccacatctgtaagaggagtgggctggaccgcgctccaccatgccgtattcactaagtgagcagatagaaccatagaaagcatgctcactctcaaatcgtgctcatggaaagaacgacgtgttcaggactcatgcctccctttctcaacatacccccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtggtaagggtgcccttagccagttagtcttcccattctgggtccttcttcccctcctggcttcaaagcccacttaaccccaagttctacaatcggatctcaatgtccctgcactactctttgctaacaaggcttttagctcctcttcatccttttcctacctgcattagagcaaccctcccacctcttccctctagccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtaagttcttaacctttccttctcctgtttgaaacctacttgagtctcctgactttttttctgctgtagtcccatcattttggggtacatgcttacaaattcatcacttctactccttccatctgtatttccaccctatcttttctccttctcctttctctagccttggccaaggcagacattgtatattttaggctggaaacaggattctcaagtttcttcatgcatctctactatattgaatggcaaaatgtgagtcgtgttcctattctacacatctgtttctttttccagtcaactcatcagaagactctggtggcttagcaagtcctgtgtgtatgtgggtacctgtgtacagcatacatatacatgtgtagacgtgtataagtatatccttgtatatgcatatatgtggtaagtgcatgtgtgcacatgagttaaatggcttaagtgcattagcagaaattgaacaatttagtttgatgagtagggagggagagaagacagaatatggagcccagaggatcccaactggcaagctatctcatccccagttaccagatatttccacctttttaggatggcaaaacacagacctatgagacagaaaacagtaagagacaatgtctcaatacctggctgagaaacaaaggctctgttcttggaacatgctaggcttggttccacattgggagctttccttagcttttgtttctgcctgtatccctcttcactcagatcctcacatagcttgttccttcttgtcatttgggtgtcagctcagaggtcaccttggtggagaagtcttctccccattaaagcagcctcctcctcaccctgtaatatcactcctgttttattatattcattacactcatcaccatctgaaattatgtcatttatttgcttatttgcctaggacattgtctgtctccctaagatactgtctctctacttgaatacaggaacctgtcttgtttccttctgtatctgtagtgcctagaacaatgcctcctatcataggtgctcattcagtgtttgctgaataaatgaatgaatgaaatagagggtgccaaagagagctactcagtaaaagtggctggaagacttcatagaggagggtttttttcgagacagggtctcactctgtcactcaagctgcagtgcattgacatgatctcagctcactgcaatctctgcctcccgagttcaagcagttctcctgcctcagcctcccaagtagctgggactacaggagcccgccaccacacctggctaatttttgtatttttagtagagacggggtttcaccatgttagccaagctggtctcgaactcctgacctcaagtgatccacaccctcagcctcccaaagggctgggattacaggcatgagccacagcgcccagctgaggaggttatttttgaccattctttgctcagttatttatccactcatggacttatccacccatctatccatccctatctaatgtatttgaccattcatgactcatttagcagaaccaggacagcctgtataaggcacagaagagtgaatatatgtgacaggtccagagcattgttcaaattcaagatacgttgggggaggtataaatatgagatttttttcaaatcaattggaatggctatttaatcaaagccatagatgttaggtggaaagtaggaattaagaacttaacaagttaggtttaaatgtaactattcgaattataagaacaagtatttcctctctaaaaatgtttttaaagtttcacacaaaactctaaaccaaaaatcattgtaaaaatcccttgggagtagactgttgaaaccattgaggtgaggtgataggttaaggtgagcattctggacatataatatcaataataaatattcaaatacaaagcaggtataatatgaagagtaatttctatctccccaagccaatatgagttttgtttgtttgtttgtttttcttttgagataaagtctcattctgttgcccaggccggagtgcagtggcacaatcccagctctctgtaacctctgcctcccaggttcaagcgattctcctgccttagcctccctagtagctgggattataggtgcctgccaccactcccagctaatttttgtatttttagtagagatggggtttcaccatgttggccaggctggtcatgaactcctgacctcaagtgctcgtccgtcttcggcctcctaaagtgctggcattacaggcgtgagccactgcacccagcctgagttttttttttttttttaagccaaaggaggaggagtagttttgtgcacaaaagccactatttagagttccttaggttttaaacagataattaatttaatgtactaacaaatgcaaaattaaaattttacttatgccttttaattttaagctgaacttgctacattaagagtagggtgatttggctgggcgcagtggctcatgcctataatcccagcactttaggaggctgaggcaggtggatcacttgaagctaagagtttgagaccagcctggccaacatggtggaattctgtctctactaaaaatacaaaaattagccaggcatggtggcacatgtctgtaatcccagctactcaggatgctaaggcacagaatcacttgaacctgggaggcagaggttacagtgagccaaaatcgcgccactgcactccaacctgggcaacacagcaagactctgtctcaaaacacaaaaaaagaataggctgggtacagtggctcacgcctgtaatcccagcactttgggaggccgaggcaggtgaatcacctgaggtcaggagttcgagaccagcttggccaacattgtgaaaccccatctccattaaaaatacaaaaaataagccgggtgtgatggtgcacgcctgtaatcccagatacttgtgaggctgggacagaagaatcgcttgaacccgggaggcgaaggttgcagtgagccgagatcatgccactgcattccagcctgagcgacagagtgagaccttgtctcagaaaaaaaaaaatagggtgatttttatataaaaacactctcatttgttcttgaattaattgccatattgaacagattaaactcctttaaaccattttttctatctacaaacataattagtattcccataagcattttaagctccctttaaaaatttaatatgctcgattttcttttttcttttatttatttatgtagttttcccagacagggtcttactctatcacccagtctggagtacagtgacacaatcctcacttactgtaacctcaagctccttgggatgaagcagtcctcccaccctagcctcttaagtagctgagattccaggcatgagccacctcacccagctgattttctttttaaacacatctaatacctgacaggtcgtaattacgactgtgcttggccatatcatcctaacacctaaagctcacttgtaaactgaaaattaaatttgaagggtgaattaacttctagccaacattccaatatcattctcacatttaatgaaattatcctacaactttgcttaaaagcataaaactagcatgtcagagtctcttaaaaattacaatcactattttaaataacaaacatacaggttaccctgaacttaacacctggttttaacatgatgaagttggtttcttttgtcattcttatactaaattctaaatcttcctggcacttaaggatatttacccaaggaagggggtgagatttaccggctcaggtacaccgaggttactggcttgaaaattcaagaccacagcatggtaaatttttcttcagagattcaaggttcatacataggacttgaagggcacatgctactcaaatgagtatatccaacttgagtgctacatcaacagggaccccatgtccactcttttcagtcgaaattggcttactatctacttcttctgggctattcaggttccgacaattgattgctttcagttaatttctttattgcccagttgaattctgcattcttctagattctttttgttccttcagcctcaatcataataccatttaatgacagtctcatatcctattagactagggtttctcagccttggcactattgacatattgggtcagataattctttgtcctgtgcattgtagaatttagcatcttccttagcttctactcactagaagccagtagcactgtgtgcacatcctccttgccccctgccagctatgacaaccaaaatgtctccagacattaccaaatgtccactgagaggcaaattcactccgagttgacaacccctgtattaaacccaggggccctgcacttcttacatacttttgtctggtcaccagttgaaagtccttcttcttttttttttctctttttgagatggagtctcgctctgtcaccaggctggagtgcagtggcatgatctcggctcactgcagcctccacctcccgggttcaagcaattctcctgcctcagcctcctgagtagctgggattacaggcacgtgccaccacccagctaatttttgtatttttagtagaggtggggtttcatcatggtggccaggatggtctcaatctcttgacctcgtgatccgcccacctcggcctcccaaagtgctgggattacaggtgtgagccaccgtgcatgaccaaaagtccttctaatagcaaagtggaaaggtaggctgtgaacaatcttgaatgccatactaagatttgtacttattctcataggcagtgaagagccatcaatagtttttacagaggctgacctgataactctggcggttcaatgtgcatgctatatactatatgcacaacacattaggaaggaagggaacagcgctcagagaaatcaaatcacttgcccatattacatagctcgtcagtggtggagtcagggtataatcagaaactcatgctccttcctctacctctccccagcacagagttggatcagcactgttcacccagctggtatccccatttcatggtaaagcctggaagcttaggtctgactgatgcttgttgaaatacagactgtgggagcagactgcaggacagcattgtgacagagggtggggccaggagagagatgcggtaggaagactgttaagatgcatctcttattttctaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattgggtgagctctggcagcttagggttactcccaggccatcagaggagaaaggggggatccctaagatgtagttagcattctctagagtattttttacatccataatctcagtttgtcctgcaaccctgcaagttagaggggtaggtgctattatcccattggatcattgtggaaatggaggctcagaagctttatgtgacttacccagagattccatgatttacccttgagctagtcagaggcaaaccagaacaccgacccaggtctccagctctcctgagttttttctatggttccttgtgacataggcagtggaacagtgggacaggtaaccgaggtgaattatggatgctccttccccagacacatttcaaaacagtcagccaccccgtggaatatgcaagaagctatctggaagtgcagatctggaggcttctgagtttacgagaggcaacagagactccattttcttttttttttttttttttgagacggagtcttgctctgtcacccaggacaggctggagtgcagtggtgcgatctctgctcactgcaagatccgcctcccagattcacgccatgccattctctcgcctcagcctcccgagtagctgggactacaggtgcccgccaccacgcctggctaattttgtttttgtatttttagtagagacggggtttcactgtgttaaccaggatggtcacaatctccggaccttgtgatccacctgcctcggcctcccaaagtgctgggattacaggcatgagtcaccgcgcccagcccagagactccattttctaacctttgtttttttgtttgtttgtttttgagacggagcctcactctgtcacccaggctggagcgcagtggcatgatcttgggtcactgcaacctccgcctcctgggttcaagtgattctcctacctcagcctcccaagtagctgggattacaggcacctaccaccacgcccagctaatttttttgtatttttagtagagatggggtttcaccatgttggtgaagctggtcttgaactcctgggctcaagtgatccacccacctcggcttcccaaagtgctgggattacaggtgtgagccactgtgcccagcctcattttctaacctttgatctcatgtccagccctgtcacttcatttcttgttagagaatttgaccgcctaacacatgattccatttccttgtatatgtcatctgtataggaagaaaacctcttttttattttcattcaacacttctggccaccaaacaggtgtgggagtgttttctaagcaattctccagttatctggggacaccaactgggtgtcctacaattgaatccaattctaacactctacctggaaataacatcagatcccgtgcagtttaagtgctccgccccagcaaatttccccccgtttccaatgtcagttacaagactgggttgtcacctgtgcatcagaccaaccagctataatttggagattcccacaactccctgctagggtttcatcatttgctagaatagctgacaaaactcaggagacacttacatttactggtttattatgtaaaggattaagtaaaggatacagatgaacagccagttgaagagatacatagggcaaaatctggaagggtcctgggcccagcagcatctatcctgtggagttctgtttgctaccttcctgacacatgtatgtgttcaccaaccagaaactctcagaaccctgtactttaggagaagtcatcatgtaggcatgattgattattacccaatctccagctcctctcttctccccagaggatggagagaggggctgaaagttccaagcttctaatcacacttggtctttctggtgaccagccccaatccaggagccagcaggagtagcctcattagcacaaaaggcattcctatgacccaggaaattccaagggatctagtagctctgtgtcaggaactgggatcggagaccaaatattagatggtctaatatttggagctaaagatgctcctatagcatattttcccattatttcacagcatcatggcattgcatataacctcattttttcatatatgacctatctctgatctattacctcacttccaaggtcctgggagataaggaggcaatgacatcatttttcagggttgttttagggatgaggggcaaggcctctcaccttgagagagagtggcagtgttgggcccactaatagaggatcccacgaactgccagagggtacagtatgtaatctggcaaacaagggaagaggaagagagcactgggactcaggatgaacccagagaattcaggacaaaggtctccatcagctgagggtatcatgctggcttctgactctgtttttctctggttttgccctagaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccat

SEQ ID NO: 35735 - DNA, 10353 bp, Homo sapiens
ggcgtgagcggcgaaagccgggagggcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggtagcggcaccggtccggcctttttgcccctcgctttgatcccccagcagtctgaccggcttcctactccccatggcgtctttgtctccctggggataccagctctgagcttccgctcggctcagcccagcccccaactcccggggtcggcttcgcgggagaggaaaatataggatggctttctgtaccgcgtctgatgatggagagtcccggggacacctccgcggacacgtgttggactcagggctttaggcccgtgacagctggtaatcccccagcccaacaacgtccctggacactgcccctgcccttggcggctggcctgcctagtatcatagactaggtctgggtgggggttggcacgtttgtgagctcacatcttccctaactacctgtcttttgtctgcttatcaaattcagacagcttcagacacaggaggaagggagggaagggggaggacagaggagacaggcaggtgctgtcctcaaagccctgcgttcttctgagatggaaaaatggatcctcaaaaaaataaagtatttgcagtctgggggcctctcagcttcttattacagttacaaggtgagggaaagacagttggattgggattctccatcctgctcttacctctgtccccaggtactgaattgctctctttgttaattttaggttgattctttcagggagcggatcacaagtgaggtgagtgaaataaatagaaaaatggttgttggttgagaatttcccaaagaggagatacctggagagagagagagagagagagagagagagagaccttcccacagatattaattcagctgtattttccctcttccttaggcagaagacttggtggcaaattttttcccaaagaagttattagaacttgatagttttctgaaggtgagagaccctattctttcctcaaattccccaatttttttggccctggtattactgtcaactgggataaactgttgattcttcttctttttatttttttaaactgtaaaagcactttcatttcttgctcttcaaatcaaatacttctttgttcagcttgaaaagattaatgttttggggtgggtgtctttcaggaaccaatcttaaacatccatgacctaactcagatccactctgacatgaatctcccagtccctgaccccattcttctcaccaatagccatgatggactggatggtgtaagtgtcctatatttatctttgtgttcttgagcagtaggtcctctgtcctctgtttccttgtcagtttaagatgtacagagggaacagtgggatttggatctgggaactaggactctgttacagacatgatgactctagtatagttcttttatttcttatttatttatttatttttgagaaagggtgtcactttttttgcccaagctggagtgtagtggcgggaatgctgctcactgcagccttgacctcccgaactcaagcgatccttcctcctcagcctcgcaggtagctgggactacaggagtccaccaccatgcccactgatttttgtattttttgtagagatggggtttcaccatgttgcccaggccggtctcaaactcctgagctcaagtaatccacccgcctcagcgtcccaaagtgctgggattacaggcgtgagtcactgcacggggactccagtatattccttttagaccctcagtttcatttacgacgtgaagtgaatgtgctaatgctactgtcagtgttagagtgagtttcaaataaaagagaactagcttaggccaggcaccttggctcacgcctgtaatcccagcactttgggaggccgacgtggacggatcatgaggtcaggagatcaagaccatcctggctaacaccgtgaaaccctgtctctactgaaaatacaaaaaattaactgggtgtggttgtgggcccctgtagtcccagctacttcggaggctgaggcaggagaatggcatgaacccaggaggcggagcttgcagtgagctgagattgcgccactgtactccagcctgggcgacagagcgagactctgtctcaaaaaaaaaaaaagagaactagcttcatcaggttacctggtttttcccatggctctgaacaagactttgcttatatttgtttgcatgtcttgagtagtgttatgggatatgcagttctcgctatgtaactgcaattgctatctttgctttgcatctctaacacctagtccttatcagtcatgtgtccacatgctactataacactgatgataccgtattgttgtctgtagtactgcctcattgttgaacttgtacatctggaaggcaggaactatctttttttttttttttttttccttgagacagagtctcactctgttgcctaggctgggtgcagtggcgcgatctcagcttactgtaacctccgcctcccgggttcaagtgattctcccacctcagcctcccacgtagctgagattacaggtgcacaccaccacgcccagccaatttttttatttttagtggagacagggtttcaccatgttgtccagactggtctcgaactcctgacctcaggtgatccgcccgcctcagcctcccaaagtgctgggattacagccatgagccatcgtgctcggccggcaggagctatcttaatctttgtattcccagcacctagtgttgatcctggtccctagcaattgctgaatacatgtttgttaactgaataatgtgttcctttgtggaaccagcagatttgtacgtattcccttaattatcttccctgctttgattggttcttttttcctattctttataatacttaatgtattgtgtttctggaaagattggtcttcccaactagagcgtaatttgctttgtggtaagaaccttttctttctttctctgagggggaacccagtctcactctgtcacccaggttggagtgcagtggcttaatctcagctcactgcaacctcaaactcctgggttcaagtgatcctcctacctcagcctcccaggtagctgggactacaggtacatgtgccatcacattcagctagtttttgtattttttgtggagacagggtttccctatgttgcccaggctggtctcaagctcctgagctcaagcgatctgtgtgccttggcctcccaaagtgctgggattacaggtgtgagccatggcgcccagcccaagaaccttttctttatttccttttttttttttttgaggtggagtttcactcttgtcacataggctggagtgcagtggcacaatctcggctcactgcaacctctacctcccaggttcaagcaattctcctgcctcagccttccgagtagatgggattacaggtgcctgccaccacacccggctaattttttttatttttattttttggagatggagtcttgctctgttgcccaggctggagtgcagtggtgcaatctcggctcactacaacctctgcttcctgggttcaagcagttctctgcatcagcctcccaagtagctgggattataggtgcttgccaccacgcccagctaatttttgtatttttagtggagatgaggtttcactgtcttggccaggctggtcttgaactcctgaccttgtgatccacctaccttggcctcttaaagtgctgggattacaggcatgaaccaccgcgcctggctaactttttgtatttttagtagagatggggtttcactatgttggctaggctggtctcaaacttctgatctcaggtgatctgtccacctcggccccccaaattgctgggattacaggcatgagccaccgcgccttgcctccaataacctttcttaaagctttgtatgtacttaggaaattgtgcagaaattaataacataagctatgaggctgaggaagggattaaacttgcttgaagggtatcttgtgatggagatgtgggtgtcaaaactaggctcatccctgcctctttgtatccttagcccacttataagaagcgaaggttggatgagtgtgaagaagccttccaaggtaagaggcacccttacctcacctcccctcaccccatccctgacttgcaaccctgagaagcaggatggatctagtgttctcctgaccaggaggcaagatctaatcttacttcccagaggtagcattcccagctcctccaaacgtgcttgttattgagtgctctaaacctggttttccaataaacagaggatttaagacttttgttatgttttagacgctcatctgtagttctttttttccatacattctcgttgattctaatagtggtgtcatggtaggattgtgacaaaggcagaggtcatagcatctgataggtatagggaaaatgagagagaggcaggggatgctgtgtccttccctcttccctgatcatttgaccttcacatctctgccaggaaccaaggtgtttgtgatgcccaatgggatgctgaaaagcaaccagcagctggtggacattattgagaaagtgaaacctgagatccggctgttgattgagaaatgtaacacggtgaggcacaggctggtgacctatgggccggccccaagtaccccacctgaagtgcaaaaaacagtggatgtacgggtggtatgggaattggcagactaggtttttttgagttttttttttgagatggggtctcgctccatcacccaggttggagtgcagtggcgccatctcggctcactgcaacctctgcctcctgggttcaagtgattctcctgcctcagcctcccgagtagctgggattacaggtacctgccaacacacccagctactttttgtatttttagtagagacggggtttcaccattttggccatggttagccaggctggtctcgaactcctgacctcaggtgatccacccgcttcggggtcccaaattgctgggattaccggcatgagccaccatgcctggccagactaggtattttgacttctgtgttcctggcatctggctccagccgtctgaattgtgtacttcatggcttcagccttcaggcaaaggtcctcatatatgttttgacctccaggtcaaaatgtgggtacagctcctgattcccaggatagaagatggaaacaactttggggtgtccattcaggtaatgtacttgaattacatactgggaagagtggcttgggagatactctcatctcccctgcgttacctttttttcctttttctttggggctgctgtggatgacatggaagtggcttttgatgcacctgttgtttgtttgttttaggaggaaacagttgcagagctaagaactgttgagagtgaagctgcatcttatctggaccagatttctaggtagggctgcttgggcttggccgaggcgttgggggctgatgaggtggtgggcaccatcaagggtctcctgcatcttcctcctcttctctctctttccagatattatattacaagagccaaattggtttctaaaatagctaaatatccccatgtggtaagtaaggggtttgtggcctgagggtggaggtggcaggatagtgaagagtgactgttactgggaaggagctgtctggaaacaattgggctttggggactagctttttcctgtaccctccttgcaggaggactatcgccgcaccgtgacagagattgatgagaaagaatatatcagccttcggctcatcatatcagagctgaggaatcaatatgtgagtaatctcagtccttgtccatagttgctgtggcttctcttagttctgttgagagtattgttaaaattctctgaagggctgagatgagggtctgaggtaaaatgaatagaccaaattctattcatcacctgagtgttgagaaccatgaagtcatctagcagggtatctctcttttttctacctgagtggaggggtgtgcagtacaatatggttaagatataggtgtcagagtcagacagacttaggtttgcaaccaggctctacctgtgttgtgtgacctcgagcaaattgttcaagcttaaacttcaatttcttctttaaaatgggactgggctgggcgcagtggctaatgcctgtaatcccaccactttgggaggccaagccgggtggatcacctgaggtcaggagttcgagaccagcctgatcaacatggcgaaagctcgtctctactaaaaatacaaaattagccgggcctggtggcacatgtctgtaatcccagctacttgggaggctgaggcaggagaatcacttgaacccgggagttggaggttgcggtgagccaagattgctccattgcactccagcctgggcaacaagagcgaaactccatctcaaaaaaaaaataaaaataggctgtaatcccagcactttgggaggccaaggtgggtggatcacttgaggtcaggagttcgagaccagccttaccaacatggaaaaaccccatctttactaaaaaaaaaaaaaaaaaatttagccgggcgtggcggcacatgcctttaatcgtagctactgaggaggctgaggcgggagaattgcttgaacccgggaggcggaggttgcagtgagccgagattgcgccactggactccagcctgggcaacaagagcgaaactccgcctcaaataaaaataaataaaataaaataaaatgggactgaagaggccgggtgtggtggatcacacctgtaatgccagcactgtgggaggctgaggcaggtggatcacatgaggtcaggagtttttgaccagcctggccaacatggtgaaaccccatctctactgaaaatacaaaaaattagctgggcatggttggcggacccctgtaatcccacctaatcgggaggctgaggcaggagaatcgcttgaacccaagaggtgtaggttgcagtgagccgagatcgtgccactgtactccagcctgggcaacaagagcaaaactccgtctcaaaaaaagaaaacaaaactgaagagtacctactgcacaaaattcattcgcttttttaaaataagtgagataacacattgaaggacctggtacaattcttactatgttaagtgcacaatacatgttagttgttattagacacttggggccttggaaatacccatttatacccagttgaagtataagagaggtggtgctgccaccctgaatgcaggctcaagtgagattaaaattacagtaagttggccgggtgcagtggctcacgcctgtaaccccagcgctttgggaggccgaggcgggcggatcacgaggtcaggagatcgagaccatcctggctaacatggtgaaaccccatctgtactaaaaataaaaaaaattagccgggtgtggtggcaggcgcctgtagtcccagctactcaggtggctgaggcaggagaatggcatgaacctgggaggcggaggttgcagtcagccgagatcgcgccattgcactccagcctgagcgatagagcaagaccgtgtctcaaaaaaaaaaaaaaaaaaaaatacagtaagtcttcacttaatgttgtccataggttcttagaaactgcgactttaaaaatgatgtatatcaaaaccaagtttttttttcattaacattgtaacaaaatgacatcgaacaaaatgatgttatttgaaaccaggttatttgaggaccttctgtacttgatttgcttacctgctgtactttaatttccttcaagtcgcagttgctaagaacctattgatgacattaaggacttaccgtatgcagatgattgcttggggatttgtgaaggggtctctcattttcttgatgaggtaagggttgtacagatatgtgattcccctgatccctcttctctcaggtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtcttcagtttcttgaggagactcctagttttggttttcaaattacttggagggctgcctaggaatctatctccctctgaaataaagtttcctcatcttccaccttgc

SEQ ID NO: 35736 - DNA, 68631 bp, Homo sapiens
atcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagatggcgggacggctgccggcctgtgtggtggactgtggcacggggtaagggggcttacgggcgggggtggggaaactgaggcggaggaaggaagatggcgggggagggaggaggccgggaaatgaatggtgcggcgaggtgccgccgccggctgtcagtcctagacccgccggccagcgaggggtggggcccgcagccagggcctcgcgggtcccctcgtttctccctcctgggactggggcgggggcgcgggcccgagattcaacccccaaccctcccagcggctttctccgcgcgacccctcccggcccttcccccactacggtgggcagcgccgcccaaagggcgctggggacggtcgtcttgggggtggtccccgggcccgacccatccggctttcctttccctccgcgcccgtttttgccagtcggtttggggacccaggggccgagctcggggactggcctggcaggggagctagaaaagagaagcgctcctggtaggtttgacaagatcgctgtgacaacattctgcccagggtgtgggtggggaaagggaagaatcggactctgaaaatgggaacctacagtggggctttcatttgaccacccaccttctcctttcgactcctggtcatttccatctccctctgcgttttaaccggtgaaccaagtcacattttaattcgagggagaaagatgtcatgtgttacttctgtagcctcaaaaaagtcccccagtgagcaagcgcgctgcaacttccttagttttgtcaaagccgcttcctgctttcagtcttttatacccttataaggtagtttttagtttccaacctgagcacatcttactagaacttttaagcaggttttaaagagactgaattaccggtgcttggtgtccatttatatgacttaaaaaaatgtacttatgtttcatggagtgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctatgtatttttttgatgaacactttatttaaaagtttttccttaattcagtctcatttctctgaaccaataattttttttatttctcccttcttagtctaattggtgagtatttttatgtctaggttcagttttaaaattagatttggcctgagtcagtaggataggacttttcaaatgtgttttgttaaagtgacgaatattgctacataattaatgctttagaaattactgcgttttcaaaaaaatagtgtaaataattgtggccctgagaaataatatggtaacatctcaagtagtatgttacttttctaatctccattttcccccttttgaaatagtttcgaattagtatacaagatgtttcattgagataaactgtccttaagtgacctcctttcctaaagggcaaccttgaatttaaaacatgctgaatgaccagtaggatcgggaagaggggttcaatttaacctaggctatttctgttttaaaattacgattatcacaatagtgtatttttaagttattacattggtttctccaataaggagaggttattaactgcacattgatgatttgaatggaactgattaggagtccccttgccacctcactctcttttaccatttgtcacaatctgaaattccccctttagagtttcagttattttggttctcaaaagcctttttggtcttacaagtttccagtggtgcctcctgggaagttacaccttcagctttatttgcacatggaggataagtccttgaggttgaggaccctgagataaacatctctaagtatggccttaacagggagcttttacatttcaaaattctgtggtccccgaatgcaaattgtgcacctgtaatttgtctaattttttttatgctttagagaatgcattcagctctgaggtctctaaattacaattactcacttagtttaagtaaaaagttataacctgaatcaggttgctcatttcattcattatataaattaggggaaaggtggctgaaaaaaagtggccatctgtaaaacttgatcgtcttagataggaaagctgttaagagttaggaaacttgaaacttaagcccaaaacttttagggatcgtccagcaaaactcaacatatgaatcacctagattcaggtcataaaagagaatacttattttgaaaagaatttgaaaagaaatgcttcattcacattgatacccttatctacacacttttttggtctgtattggaaagcattgtaaaatacagttggggcacatagattcccattggtggcttgaaaactaaataacagaactcaaacctgctattagtggtgagaaaagcattttctttaaaaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcgctccttattaactccttgttatatcgtagcttggttacagagctgcattgtgaatttccttttcccttttatgtctttttttttcccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatatcttgtaggtgtcagtgaaagaggagtatgttcatcttgtggccacaattcagcaattagtgcagataagaatgatcttgtttgaagagcagtggggaaaagctgggtaaatgaaggaaggtatatgtgggaagttcatgtttcttccatgaattctgtgcgtattgtttaataataatgctgtttctttttttttttttgagatggagttttgctctcatcgcccaggctggagtgcagtggcatgatcttggctcactgcaacctccttctgcctcctgggttcaggtgattttctgcctcagcctcccaagtagctgggattataggcgcccactaccacgcccagctaaattttgtatttttagtagagacagagtttcaccatgttggccaggctgttgttgaactcctgacctcaggtgatccacccacctcatcctcccagagtgctgggattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaatctcagccttatgaatttgattcacctaattagagaaaaccctctgtgtaatctttacttggtttaggttccccccccccacccccctgccgatatgtgaatgcctagactatttccttgttactttgcttaaatttaatctctagaaaaaaattactctctaggttgtgtttctcaggaaataataatagctagcatttatcgagaattgtatgtcagcccctgtgctaaatgctttatattatctcattaactttcacaacaacctggaaagtattatctttgttttataggctagaaaatttagtcttaagagaggttaagctacttacccaagatactgtagcaagtaagtatggcagagccactacactagatcttccttccgtagaagatgaacgtttgacatggcttggtgcatagtaggaattcaaatctttgttgtatgaatgaatgaacaagaattaggagtatggtttttaaaaaaactgtgcatcagaaacaccccatacccagtgactcagaatctcaagggttggactatgaatattcatttacataggcttcctagatgattcttcagcagcccattcaagggctaactttgcagaaattctgaaacctggtattggcggtggagttggagcagaagagataagttaggaaaagattggttttttcctttctttttacgtttcttctggcagttatatttcgtgttattttatttacgggtagcaaaggctttgtagttatctgttgttgagttcaagctctatcacttaatagctatatgactttatacacttcaacctctgcaggtcttatttcttcccatctgtaatttggagatgatagtgtataccttataggttttttttgtttgtttttgagactgggtctctgttgcccaaactggagttcaatggcaagatcatggctcactgcatcctcaaactcctatgttcaagctgtcttcctgcctcagtcccccgagtagctgggactacaggcacatgccaccatgtgtggctacttttaaaaattttttgtagagatggggtctcactgtgttgcctcaggctggtctcaaacttctagcacaagtaatcctcttgccctgacctcttaaagtgttgagattacaggagtgagccaccatgcccagttttgttttgttttgttctgttttttgataatgtgtgaaaatggttcagcacagtgcctggcacacagtaagggcacaatatattttaaatataataattggttggctttcttttttttttgagtttcagttcttaaagaaaggaatacagtgtgttatgcttattttcttatctcctgcaggccttggcctgcctaccacacacagttctctgcacagtcaaaatgtttttgctgatttgagagattgaaggaggtatagctaggacttggcagttgattccagtggattgtaaataggcatcaatgaatagttcaagattgtaagcctgagtgattgggacaataagggagttagttttaagaaactgagtaaaattggaatttgttgttgaatttggaatgatgatttataattggaaacattctagaggaaattaaaaatacaggacctttgggaatgaaggtggatatttgggaatcataatttgttaactgaagctaataagatgagagcattcagagagaaaagaacggaaagattgaatatcagtttcccttctttaaaaaaattgtggatatgtgatctagcttcttgagcatcacagtgactgattggctcgtggtaattgatcgctatgctgacaatcttatctccacctatgtcattcaattttctaagaggcaaaatccttaatcaggaggagagtttagctctagctaaatttcccttgtccagcatgctcctgctcccccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaaaaaaaagaaaaaaaattctagtttttttaaaggacgattttgcagaattttaataataattttgtttcagaattttcaaaattctttccaaactgtcgatttaaactcaagccattcttacatactccttggaaccaggaaaggaatagcttgaatttgtgtggccagatgttattttttttttttttttttttttttttgaggcagagtgttgctctgtcacccaggctagagtgcagtggcgtgatcttggcttgctgaaacctccgtctccagggttcaagctattcttctgcctcagcctcccgagtagctggaattataggcacccgccacgatgcctggctaatttttgtgtttttagtagagaccgggtttcaccatattggccaggctgatattgaactcctgaactcaagtgatccacccgtctcggccagatgtattctttcagctttccttctgctccccaaccctaatacatacctgagaagaatattcatctgttcggatactcaacatgccatgttttcctcctgccgaaggacattacctaaacgttttatttttaaacattttgtccttgctttaagactttgtgtcatttgtgaaaatgcaatgctcttgggaagggtttctgtgcttttcagtatttagtgtaaaggagaggttacaatgaggaggataaaagtcctagagagagaattagggtgcagaagaccttgtagtttagggttggcttaatctactgtaaacatgtaaaccatgtttttagtattagtgtatgacaggacacaagtgtttgcctagttatagagattattttagttaaatctagtgtgcttctgctataagcatttttaaaattcagttactcaagggtacaaatatagcatttaatgtgtatttgtgaaacttgctttagtaaattaagggaaatgcctaatgactcacacagaattatagagctgaaaagggattttgagagataatttaatccagtcttcatttacaaatgaaacagaggctcagagttgagaaatgtcttttgggagtgttcctaattattaattgatagtattgttgagttctcttaaattttcttgtgagttcacatttatgagttaatagttgaaattaagtaattggaataacataatgtattttatttatagttaaagtagttttagttgaagcctacatcagaattcttcagtgtttcgttgtaatgcagaggcatactgtatggcacacatgagaaactaattttatgtttcccaataataatgttttaaaccaagtttagagatattttaaaagttgtgctctgtaggtgccaggacagatgactttcataaaatgaatgctctctttaaaaaaatttttctttatggtttcagagatttatatctttggattttaattattaaagatgtattaaatgggatgtgtaccaatcagccatttcaaggccctttgcacgttttgttttggatgttattaccttttcagaagccctgtgaggtagttactgttataaataatcccatttcaaagataagtagtagatttagaattttagtcctggggtagtctcattccagagctcactgctctactgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatatttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgggcagattaataagggctgtagtatttggaggatgatttatgaagaagctgaacttgatcagatccttggaaaagcataaataggatgtgatagatatatgggaagaaggacttcaaatctaggatgtgagctaaattgaaagctccatagtggcagggattatttcttttttgtgcattctctattcaagtgatagcgtcctgcatgatatttaataatgcccagcaaatattttactgataaagggaagtcatgaaggagtttcaaagtatttgggggatgggtcagttaggaaattgccctgcctggaattcagatatttctgttgggagctgtgggacagcaagtagtttatttactcatcttgccttatttcagaaggattttaaatggggcagaatggtttgcgatttatttgatagacagtagtggattgtgtagatcattaagcaaaagagtgataaaaggtaaatttatgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcgtccaggttcttcactcaacagtccatcagtatttttgtgtcaggttaaacattgacttgcatgtcatgagaaaaatgttggagggaattggaaaagttttttaaaccattgctgtttatctttatagctaatattgtcttactctacttgacaaatttccctgtgaatcagccactgcattcttgttttaaaagtttctggctgggcacggtggctcatgcctgtaatcccagcactttgggaggccgaggccgcagatcacctgaggtcgggagtttgagaccagcctgaccaacacggagaaaccccatctctactaaaaacacaaaattagctgggcgtggtggcgtgtgcctgtaatcccagctacttgggaggctgaggcaggagaattgcttgaatccagctactcgggaggctgagtcaggagaatcgcttgaacctgggaggcagaggttgtggtgggccaagatcgcgctgtcgcacttcagcctgggcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggaaagagttgtgctagatcattaaagtctcttctatccttaagctctggggtcttatatttattttgttatatcatttcatttgttgaactattgaaagttaaaacttgttccgtatgtagaggcacaggcagagtagatttagcatcattcttaagggccctataattttcagaattgtaatggaacattggcttcaaagtcaccactatattagcccctagcaagagagtgtaattgtacatgttttaatgtacaagcatttgcaatttgtaaaattaaaaataatatccaaggcaaaggatgttaatgcttttacaatgcaggcataagttgttttactactgaaaaagattctattaatggatttcttttaggtaggtacaatcaataatataacagatacctgcatttgttagaattatgacccgtgaacatttaattatacttactttatctttcttgttttaaggaacaaaagagcattattgatgactgtccccaaatccacttcccctttcctcagaggcagttactgttgtgacagactcgccttttttttggtataaaactcatctttcttttgctgttgatttctgccagtccagcctcctctctcacctagccttcttatatttctactattattcttctagtcaccaaggctttgatagcttcaaaagtgcttttgaattcttttctctatattcctttctctaagcaagttgtttttctttttttttttatgtaaaatgatgtattatatattttatacaagcaaattgagtacagctaaacctcagctacaggattttagagtacaatagcaagttgttttttaagtcccttaccatctccctttcgcagccaaaatcagcattgtagatttttttcattactgccatagtaagagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctcctgcctcagcctcctgagtagctgaaattacaggtgcccgtcaccacgcctggctagtttttgtatttttagtagagatggggtttcgccgtgttggccagggtggcctcaaactcctgacctcaggtgatcgcccgcctgggcctcccaaagtgctgggattacagggatgagccactgcttctggccacaacatggtgttttgatataagtaaaccttgtgtcatgagtcttacaatcaagctaattaatgtatttgttacctgacatagttaccttttttgtgtgatgacacttaagatcgcctttaggcaaatttcaactgtaaaatactgtatgttattaactgtggttactatgctatagcttagatcactagtacttattcatcttataactggaaacttgtatacattgatcaacagctctccaattcctccatttcccaatacctggcaactgccgtgctacttatttatcaggttctattttagatccccatatatgagtacattgttttccttatctttgattttcagtggtttgtgcctaagtgtggttttctttatatttattctgcttgggtgttcttgagcctcttaaatctctaaatttctgtctttcactaaattgggaaaatttttagctactattcctttttatttgtttgtttctgagactgagtcttgctctgttgcccaggctggagtgcagtggcgcagccttggcccactgcaacctctgtctcccaggttcagcaattcttgtgcctcagcttcctgagtagctgggattacaggcttacaccaccatgctctgctaattgtctttttttttttttttttgagacggagtctcgctccgttgctgggctagagtgcagtagcgcgatctcggctcactgaaacctctgcctcctgggttaaagcaattctcctgcctcagcctcccataatttatttttagtagagatggagtctcgccgtgtgggccatgctggtcttgaactcctggcctcaagtgatctacccacttcggcctccctaagtgctgggattacaggcgtgagccaccccgtctggcctgtcactatttctttttaaaaatatttttactacactctcttctccttctgggacctaagtgtgtcactttttttttttttgagacagagtcttactctgttgccaaggctggagtgcagtggtttgatctcagctcactgcaagttctgcctcctgggttcatgccattctcccgcctcagcctcctgagtagctgggaccacaggtgcctggcactgcgcccggctaattttattattgtgtttttagtagagacggggtttctccttgttagccaggatggtctcgatctcctgacctcgtgatccgcccacctcggcctcccagagtgctgggattacaggtgtgagccactgcacctggccacgtgtatcacctttttgatattgtccttgatgagtccctgaagctctttcctttttccttgttttctttccccccaatttcagaatgaataatttctactgcttggcctttattttcatttatctggtgatatttcctttattatcaattacaggtctatgttaatactcattgttgattggaagtctttatcttataattccagcatttgggtcatgttagaattgccttctgttgagtgtcttctcccaggagaatgggttatgttttcctggttcttcctatgtgaagtaattttggtttgtatgaatataacactcttgtttattcgttctcttgttaaacatttgtttttcttccagttttgggtctttatgaactattctgttgtgaacatacatgtacacaattgtgtggacaactgtttttatttttcttgtttctagtagattctaactagaggtagaattcctgggtcagatggtaagtgatagttaaattgttttcgtaagtggctgcatcattttgcattctaactagtaatgttttttattttgttgttgttgttatacaaccctccctccaactagtaatgtttgaaagcacctcagtgcacttttaatttgcattttaaaaatcccatggagttgagtctcttttcatttaataaccatttctgttgttctgggaatggttagtgtctttttgcctttccttcttttgtttcctcccttcctgtccttccctcccttgtcattaacatctaggtaccctttatatgttaaagagattatatctgtctagataatttgtgtagataatttttctctgttactcatttttcttttggctactttgggtgtgtttttgtaaagaagtttttaatttttacatagttgaaataaccttttatagtgtatgggttttaagttatagttagaaagtctcctgcactccagggttataaactatatcacattttcttttaaactttatatttgatacatttagatttatcctgctttaacatgtgcggtaggtatccagtattattttcttggtggtaactgctgaggctggcaggtcacgaggtcaggagttcaaggccagcctggccaacatggtgaaaccctgtctctactaaaaatacaaaaattagctgggcatggtggtggatgcctgtagtcttagctacttgggaggctgaggcaggagaatcgcttgaacccaggaggcagaggttgcagtgagccgagatggcgccacgggactccagcctaggcgacagaacaagactccgtctcaaaaaaaaaaaaaaattttttttttgtggtataatactcataaagtttactgtttaactatttctaagtgtgcagtttagtggcataaagtacattcacattattgtctaaccatcaccatcctccatgatccataacttttttatcttcccaaactgaaactctgcgcattaagcagtaacttcccgttctctcctcacatgcgaagtcccaggcaaataccattccactttctgtctttatgaatttgacttttctaggtaccttctataagtggaattgtacaatagttgtccttttgtgattggtttattttacttataatgtattcaaggttcatccatgttgtaagcatgtatcatgtgtttcctttttgaggctgaataatattccattggaagtatatatcatattttgtttatccattcacatgttgatggatgcttgggttgcttccaccttttagctattgcagatattgctgctatgaacatgcatgtataagtacctgttcaagttcctgctttcagttcttttgggtatatacccagaagtggaattgttgggtcgtgtaattactgtatttaatttttggaggaactattttatagttttccacagcattgcaccattttaaactctcaccagcattgcacaagggtttcagtttctttacatcttccccaacatttgttattttcttgataatagccatcctaatgggtgtaatggggtatttcattctggttttgatttgcattttctttattattagtaaggttgaacatcttttcttgtgtttattggccatttgtatattttctttggagaaatgtcattacaggttgattgctgatttttcagttgggctttttttgattgttgtgttgttctttattctggatattaatcccttacagatagtgatttgcaaatattttctcccattctgtggattgcctttccactgttgatagtgtcctttgatacacaagtttttaattttgatgaagtttttctctttttttcttttgttacttgtgcttttggtgtcatagccaagagatcatagccaaatttagtatcatgaagcttttcaccttatgttttttttctaagagttctatagttttagctcttgtgtttaggtctgtgatcaactttgagttaacttttgtgtatggtgtaaggtaaaggtacaacttcattcttttgcatgtggatatccagttttccagcaccatttgttcaaaagactgtcctttcttcatcttagtagttatggcatccttgttaaaaatcatttaattatatatgtgagagtttatttctgggctcctgattctgttagttcttatgccagtaccatactgttttggtcactatagctttgtagtaacttttaaaatgaggaagtgtgagatctccaactttgttctttttcaggattattttggctattcaggatcctttgagatccatatgaatgttaggatggatttttctatttctgcaaaaatgttattaggattttgatgggaaatgcttgaatctgtggatcgatttgggtaaatagctttcagatatgaaagtttgtcccaagtctgaattctgtactaaatgcaattatccagatggcaaatttaagaaaaaatgaagccatttaaacttatttttaaagcttattaggagggaatgagatcaggttgtttactagctgtccaaaagagagtttttgctaaatgtaacttagagcaggggagaaggtgcttttatgaattacttttttgtttattttttattgtaattttataataattttttaaagacggggtcttgctctgttgcccaactgaagtgcagtggggcagtcatagctcctccatggctcaagtcatcctccctgcctcccaagtagctaggactacaggtgtgagctgctatgtccagctgatttttaaattttttgtagagatttggatcttgatttgttgcccaggctggtgttcacctcttgtcctcaagtgaccttcctgctttggcctcccaaagtgctgggactacaggcgtgagccgtcacacccagctcatgaatgacctttttgaatatccaggaaatctttacagaaaattgcaagggctgtagaaaaataaattatactgataggatttataaattcaaagcaaaaatttattttggaaaagtaaggttaaaagtgggttgttggccacgcacggtggctcacagctgtaatcccagcactttgagaggctgaggctggctgatcacctgagatcaggagttggagaccagcctgaccaacatggagaaaccctgtctctactgaaaatacaaaattggccaggcatggtggcgcatgcctgtaatcccagctacttgggaggctaaggcaggaaaatcgcttcaacccaggaggtgcagaggttgtggtgagccgagatctcgccattgcactccagcctgggcaacaagagcaaaactctgtcccccaaaaaaaaaaaaaaaaaaaaaaaaaagtgggttgctgtgatacacttggtcaggatcctgaagaacatcattattctttagagagcaacaaacatgtatatatgcttagagaaatgcttaataggaaagtcatttgaaacctatttgtattattacaaaaatatttgaactttgtgtcactgaaaaacaagagccttgaatttaaagatagtgattacatccttaaattacaatttaaaaagttcatatgtcaaatgccaattagctgttagcagtttttttttttttttgtcaaagaaaaagcgagagaaacttctaccatctacttgtacaaaatttcttctttatggtgactatcgaatttttagagttcataaaaatatcttaaggataatatgtagttatttcatgtgtaaaactcaatagaattggtaggttaatggaggctagtttacatttgaaaagcttttattttggagttttaaataaatttaatatttaatatactttctaatttttttctttttctaataacaattttcaaacctcttcctctccttaaatgtttctcatctcacatataagcattaaagtatttttatatgagcattaaaaagtatttttttagtctgagatttctacggttctgttcttatttttaaaattattgcaatgtattttctgtacgcttattctctgaactttgacttgttttttttaattttcaaatcttaatttttaaagtttgctagtagtataaagcgagtggttttaaagagtgattttttttgtcattcagcactttactccctgcgggagaaaatgtgactttttgaaggttgagccttcaaaaccttttttaaagtttagtagataactttacttttttagattgtgtcctgtaccacattttttttgagacaggaaccaaattagcttttagagtctaagcaacttatgaagttaagtaaactgtgatatttcccctcatattttttaagaattggtgaaaatattgttgtctatgattattatcaaatgctgtaatttagcagtctgcctaactaatgtagacagactttacatgatttagttcttttgggatatttaaaatttaaatctaaggtagtagaacattagttactgctccccaaaatgtagtagattattttgctgtggcatttaaaatacattagaagtgattaaataaattatggtatatccatacaattggatactgtatgcatttattcttgtgttttgagaagagcatttttgttttgattacatattgactgttttgtattaggttcatttgatccttttggtgtttattttgaaagtaattcattgatgaatatactcagcctaggaaatttgattttggccaagaatggggtcttgatcagtctggtaagctggttaaatgaatgtttcttaagggaatttctactgtaatgtggtctgtacttcaaatattactgtaatatttaggagacgatatttacacacataaaaatatgtgtggcttatggttgaaatgaagattagtcaaaagaaaggatgcctgatagttaaaatgatcaggaaagacttcctggagaagttttaagttgtgataaaagtttttttgttgttgttgttgtttttttttttttgggagggtgcagtgtgagcgtagataatatgtgaggggggaatagggaatagacaagatataagggaaaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaatcttgtagccagtagagcatcatttgaagatttttgagttaggccgtttgaaattgggaaatatgtatttggtcttcaactccatattcggacatacaactcctataattcttagaaactccaaagtgacgtctgtttgagtgctaatgggatgactgttggctggcagcccctaggtaacttcaagatggggctggtcacttgaaagaccaaggcatgattagtgagttgggacttccagccccaccctccaaccactggggctgaaggttaagttgatcaccagtggccaatggtttaatcaatcctgtctatgcactgaagcctctataaaaacccaaaggacagagtttggagagctttcagatagctgaacacgtggaggttctgggagggtggtacgctcgagagggtgtggaacgtctacgtctcttcctacacacctcaccctgtgtgtgtctttatctgtatgctttgcagtattatttataataaaccagctaatgtgtttctctgagttttgtgagccactttagcaaattaattgaactcaaggagggagtatgggaaactcatcttcaagcaggtgagtcagaagttccagagtctggggcttgtgactggtgtctgaagaaggggggcagtcttggggactgagccttcaacctgtggattctgatgttatctccaggtagatagtattggaattgaattacagaacacccagctagtgtccactgcagaattgattgcttttttgttgttgggagaaaccctccacacatttggtcccagaagtcttctgtgttgattgctgtggtggtggtgtgtaagcagaggaaaaaacaattagagcattgtttttaggtatattattctcttgtcctttgtaggagttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttatttggcacacttttttttttttttttttgagacgaagtcttgctttatcacccaggctggaatacagtggcatgatattgcctcactgcaacctctgtctcacaggttcaggcaattctcctgcctcactctcctgagtagctgggattacaggcgcccaccaccacaccctgctaatttttgtattttaatagagatggggtttcaccatgttggtcaggctggtctcgaattcctcacctcaagtgatcctctctcctcggccttggcacactcagttcttgaacttaatttggaggctaaaacattccccaaagatattgtttatttatttgtttattttttgagacagagtctcactctgtctcccaggctggagtgcagtggtgtgatctcggctcactgcaacctccgcctcctaagttcaagcgattctcttgcctcagcctcccaagtagctggtattacaggtgcccaccaccatgcctggctaattttgtatttttagtagagttgggggtttcaccatgttggttaggctggtctcgaactcctgtcctggtcccgtaatccacctgcctcagcctcccaaagtgctgggattataggcatgagccactgctcccagcctaatttctatagttttagtagcgagggtgtttcaccgtgttggtcaggctggtcttgaactcctgacctcaggtgatccacccacctcagcttcccaaagtgctagtgttacaggtgtgagccaccacgtcaggcccccagcagatttttttttttcattttatcttagaaaaaagattcttcagatattagagtccaagaatgtcacagcaattacctgtctgctatttatcagtgagtttgaatatggaataatataaaatgttacattctctttaaagcctgcttatagttaatagcttttcccacatagctaaaaaatgccccactatctcctaagtagcccccacatactgcttgtcagagctcagcttttataatttctaatccttatttatgttgttattttgttagaagaatgtaggccaagtctactgtgacaaaacattaaatcttatatttatttttgaatagtaattaatttgaatggtatgaaacaatgtacaatgaaaacaaatctccttctcatttctgttcatcatgccccagttcccttttttggagacaaccaaaattattcttgtgtagtcttccagagatacgttgtgcctatacaaaatatttcatatgtttttactcctccccattagttttatacagatataccatacttgatacattgttctgtatctttgttcaataagtaatatattttgggaattgtttcctatcactatactaagagcttcctcattctattttttgtagctgcataatattccatagtataaacttagcatatttcaatagtttccagtttgattgatatttaggttatttccagtcttttgctgttagaagcaagattgtagctaatgaccttgattgtgtattatttcacatatattcctgaaggatcaatttcttgaagtggaatttcttttcagaagctctgtgcatttataattttgatagaattgtgaaagtaggggttaaatgaagtgaaactatggaatttggtatattatttacctacgatggaatctcacttcataacaaatgaaattctaagaaagaaatgtataattgctaaaatattagtgaaatctttataaattattttgttttgcaggtatacaaaactaggatatgctggaaatacagaaccacagtttatcatcccttcctgtaagtatttcttttaagccacaaatgagctgatttaaaagatccccttccctaataatttaagtaaaagaagtaatcagttctgaaatcctaaaagatttagtccttttaaaaacatgatttgccaggttctaagtgtggcctcatttttgtatgtctgactattcatttcagctttatgtttagctccccatttgccatgtctactaaatacctctttttaaagaaaaaaagaaattagctgataatgaaacagtaccccaatttttagggtgatattgcagttaacagtatgggggtataactaattatcaagtagtccattccccatcatatacctatgaagactgtcctttggtttgtggatatgactactgtttgtagggcccgtatctgttgacgtcctcactaagtgcccatgtttcaaaatatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctatttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcattatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacacaagaggtcaactgttttgtcatttgtgtagtaagaacaaaattaagtgtgtggcattaaagaaataacactgtctggccgggatcggtggctcacgcctgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctcgaacccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaaacttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttattaagaattcggtgatacatgttggctttattgctgactaatgtagaggtacttctttgggctagtacttgactttagtcgtatttcagtttagtgttagaccatcgtgtatgtacttactggtttctttaagctaccgtacgtaacacagtaccaaaaattgggtggctgaaaacaacaaacacttagaattctggagtccagaagtacaaaatcaatgcgtcagcagggtcatgctcttgctggtgtcttctggcttctgatgtttcctcaggatccttggctgatagatgcgtcactccagtcacatggctgtcttcttaatgtgcgtctttacatcatcatccttctgtatctgtgttcaaattttccctttctatgaggacactagtcatattgtattaggggccaccttgataacttcgttttaactgtgaagaccctatttccaaacacagttacattctgaggtactggcggttaggacttcatatctttttggtgatacacaattcaacctgtaacaatgctgatgacttttaatcttttgtgtataatcttttgttgtgattgtatatttcaggagactactaaagttatttctgccatcttagcaaaattggttttggttatattcgtaaatggctgtgttaactttttgttggaggcctatataatcttgattttttgaaccattggatctcatcactattgaatccattttttatcttatctctctgccaaaatatgaagtctttgccatgactagttgcagtatgttaaaaattcatttgcctgctgtaagaaggtttttgatttttgagtgttttttctcacccacccagttttaatgctgcaggtacagtgtttataattagcagatagagacattgccactgtcttttactaatgagtattgatatttgatctggaaagcctgtgcaagtggttcaaggttttttttatatacatgcatatttatttttaggaaatttatagtgagccacctggatgtctatgtacactgtaagtaaattgctggagagaatttctagcatttagaaggactagatggtggattaaaaatttttttcttccagttattttctgcccactttcttaaggatatagctgttactaaatgaaagtaacagttgaatgccagatcagtttaagtgcattcagacaattattttgaatgaagaactgaacttgatggattcgtacatttataacttaatctaaaaatacataacaagttttagctttcaaactgtatgctggatttctgcaattatttaaggatattgttgtgggtttcacctaaatgaattgagatttccttttatatatgtagtttaacagatctgtattacatttaaattactagaccacaatagtaattactgttactagacccaatcactattactagacccagtagtgatagggtagagatgtaaagaaagtttaaaaaattattcttgaagtttttttctcatttgtgtttttcagtttttttctttccagttgttcatcaagcatatgtggatttggtgggattacagttttactgagaatcaaaggaggatttatataatttaaaaaatatatatttgaaactttcccacagatgttgtttttctggctttttgcatttgaggtcttgtctctgagtggaagttgaggtttcgttgtgtgaaatgaattttgtcactggtttcttatgacttttgtgaattagtttgacaatttaaataggctaggtcatgttttactttgtagtactttgtaatgggagaagtgtaaggtaaaagtttttctcatttgaggaaaatgaattctttgacatgtctaacttattttaaaggtattgctattaaggagtcagcaaaagtgggtgatcaagctcaaaggagggtgatgaaaggtgttgatgacctagacttcttcattggtgatgaagcaatagaaaaacctacatatgcaacaaaggtatgtttttatgatttgtataaataacattttcaaaaaatagtttgttcgatgcttgtgccctctggaattcactctataatagaccttattaatatcctcaaacctcttctcagtagaaatttctttttccctatggcatccttccctgttgctttaacttttttttttcttttttttaataacccctaagaggaaagttttagccctttcaaatgagcagtatttatttttccacacccactggatctcagggccctcaataaaattacctttacttccacattgctacttctgcaaactttttttccccatctttattcaaacttacaccatttttctcttttttgaagtttatgccatctgtaagtgctgttctctttctccctctttttctttttccctttttcttttctacccttttccctccctcttttaattgaggtgtaagtatgtaagtgttaattatacagttcgaagaatttttatgactgtaatcataacaggtaaagaaacagaacaaatctagtaaccctgaagctttccttgtgcttgttcacacagtcactactccattcccaccaaaaaataaatgctattctgacctttatcatcttattttttgacactgactttgtctgatttgcaaatatcctcctttgtacttcttcccttctcataatttattcattaatgaacaactaccatgtgtaaaatactttgccatgtatcgtgagtaaaatggtgtataaaaaaatttccccgactgcaaggctattataatgtggtggaaaggaagacattgaagaaataattacaagtgtgttgggggttagaagaagggaaacacacacacagtgctctgtgcatgtatcacaggagtagctaacctagtgtggggaatcaggaatgtcctcgaggagtaaatctttaagctgaggcttgaagaataaaataggagttagctgctgaggtgggcaggctgagttgttttaggtagagaaaccaatatatgaaaaggctttacagtatgagagggactagaagtgcatgaccaatatgcctgaagcatggagaacgaggtggaaagaagtgaggaggctgtataggtaggcaggaaagagcactgaatatgttgttagaccatgttaaagaatttgaaccctatcctattggcaacattaatgagtatacctagaggaataatttttgcacttaaagtgcaaatattggaatctgcctgtttgaacttgaatcctgtctgtgctaatttctaactttgtgatatcattcagtgacttaacctttctgaattttgatttcttcgtctgtaaaatggagatattattagtacttgaagatttttttcttttctttctttttttttttttttaagacaaagcctcactttgttacccaggatggagttcagtggcatgaacatgactcactgcagccttgaatatcccaggctcaagtgatcctcctacctcagcctcccaagtagcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacatagacaatgaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattattttaaagtaaattgtacatactatttcacttaacaaatacttaactcttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccatttatttatggaaaaaaacttgagatgtcttgtaaaatttcctatattctagggattctgattattacatactcattgggtcatttaacatggtaccctacttcctatatttacttttttttgttgtaaatggtagttaaatgtaagtctgattagatttatgggaggtttttgtttgtttgttttgacaaggaaaaagtggataattaaagagtaacagggcgtgatgaatgggatattggtgataagctagatgtatcaattgagggtaattcccagctccgagatagtcttatttatcccttatctgctgaaattgagaatgttaaaggaaaaacatctaaaaattattttattttatttttaagacaaggtctcaactttgtcacctaggttgcagtgcagtggcacaatcacagctcactcactgcagcctcaaacttctggactcaagagattttcacacttcagtctcctgagtagctggaaccacaggcgtgtgccaccatgcttcgctaatttattttatttttatttttatttttgagatggaatcttgctctgtctcccaggctggagtgcagtggcgtgatctcacctcactgcatcctccacctcctgggttcaggcgattctcctgcttcagcctcctgagtagctgggattacaggcatgtgccaccacgccggactaatttttgtgtttttagtagagatggggtttcaccatttggccagcctggccttgaactcctgacttcaggtgatctgcccaccttggcctcccaaagtgctgggattacaggtgtgagccactgcgtccggccttttattttattttttatagagacagggtctccttctgttgcccatgctcgtctcaaactcctgggctcaagtgaccctcccatgttggcctctctcaaagtgtgggattacaggcatgagccactgtgccaggcttttaaaaaaattttacttgacatataataattgtacatatttatggagtatgtagtgatattttgatatgtacagtgtgtggtgatcaagtcaatgtaagtagcatattcacctcaaacacttatttttttgtgttgagaatattcagaattctctgttctaactatctgaaaatatataataaattaactgtagtcatcatatagtgctatagaacactagaacttattcttgctatccagctgtaattttgtatcctttattcaagctctccctattcccttctttcccctaccctttccagcctctagtaaccacttttctactctctacttacatgaagtcaatttttttagcttttgcacatgaatgagaacatgcaattttttatcttttagtccctggcttatttcacttaatgtcctttgggctcatctgtgttgccaggaatgacaggatttcactctttttttatggttgaatagtattgtgcatatatactacacatatccgtatggacacttaggttaatttcatattttggctattgtgaagagtactgcaataaacatgagggtgcaggtatctttgatatagtaatttattttcctttgggtatatacccaatagtaggatggctggatcatatggtagttctatttgtggttttttgaggagcctctgtactatgctttatagtggctttacctattaacattccctccacagtatatatgagttcccttttctgcacatccttgccagcatttgtgattttttttgtcttttgggtaatagccattctaactatggtgagacggtatttctttctggttttgatttgcattttcctgatgattagtcatgttggacgtttttttcatgtatttgttggccgttgatgtgacttcttttgagaaatgtctatttagattatttgcccttttaaaaaaatcagtgtttttttttttttttcttgctgttgaattgaattccttatatattctggatgttaatcctctgtcagatgtacagtttgcgggcattttgacccattccataacttgtattttccctctgttgatggttttcctcacagaagcattttaatttaatataatcccatttgtctatttttgcttttgttgcctgtgcttctgaggtcttatttgtaaaatcttttcccgtaccaatgttgtgagaggtttcccctaagttttcttctagtacttttatagttttgggtcttagatttaaatctttaattcattttgagttgatttttgtataaggtgagagctagaggtcttgtttcataaggagaaacacttttgactgggtagtgtagagaggagaaaataagtttaattttgaacacattgtgtttgaggtacttgtgagacgtctgagattttgttagagtcaaatatgtggattttggaggtaagaaacaaggcagagctggagacagagattcagaaagtgtcagttaccttagacgggttgacattacctaggggaacatatcacaggggaagagaactaagacagagcagtgtgccagttaggtttgagtagaggaggaaaagtctgcgaaagagactgagaatgcatgggtagatatgtagaggtaaacactgtagaatggtgctgagatgagctagagcccatagataatttgctgtctttcgctacaaggtggtgatttgtaacctgaatgagaatagttttagaagagtagttgggctagatgaaagtaggcttttgagtgataggccaggaaaaaagtaacagtaagagtactgttcattgagtttcaattgtgattgggagggagagagagatgaagagacacatttcaacgttaagatggaagacatgtctgaatgctaatatgaaagaactattagagattaaagtaacaggaaagataaggtataatcaaggtctctgaaaaagctggagggatgagatccagaacacagatgactgaattgacatgcggaatatcttacattataatggaagtaaatgagaaaaaaggctaagtatggaatccattttacagatttgaattcctgactgttggcttctgctgcttctgcgaaatatgtggtggcatcatctgctggtcatggatgtggggagaaggtgaaatcttagcggtaggggcggcattgacactcgtcattgtgaagagtaaagaggaacagagtagaagagtaaaggcttgccaggcaaggttaggtccatttgagaataatgactatgaattcttagtctttagcaccctagtgcaaatgcttctgcggtataatcagcattctggatataggcaagtttatgttagggatatatgctgggttggattttggtagacaggatgaaaaaagaacatgtgaaataaaggtgatgggtcaaaatctagactgtgtatattgatggctagggaataattaaagcaaccagtggaccaaaagtcttaattggtgttcagaagagatctcttgaggtggttgagtatgctagaataataagaggttgtgatcagagaagggtatacctgcatttcagcgattgagaggtgatagtgatgatgatataagatctatactgtggccaaaatggaaaagagataccactgaaagtgatgaagtcagtcagtcgagaggccagagttcctttccactgattctgtccactcattttaaacgcatttttaagtcttctaagtgctactaacaaaccagaacaaaacttctctcaatctttattcctaccttctgtcctcagcaatttagctatttttctctttccttttaaaacgacacttcttagtgagtctcaagatatttgatatgctctttgttaaatccaattatatgtaacagttttcatccttcttgatttgtctttcttttgcaggattactctaatggttatcttcctaacatggaatatttgtttgtttgtttgtttgtttgtttgtttgtttttgagacggagcctggctctgtcgcccaggctagagtgcagtggcgcgatctcagctcactgcagcctcgacttcgggttcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccggcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattatatatactccactcttgtttattccaagatcagacaaaacacaatttttatgttttgattaatggatctggtccatcctaacttcaaagctggaaacctgttggcatcttctgacttttttctctttttttttttttttttgagacaggtgtcttgccctgttgcccatgttggaatgcagtggtgagatcttggctcactgcaagaccctccacaatcactttgaccctctgggctcaagtgattcttccacctcagcctcctgagtagcggggactacaggtgtgtgccaccacacctggctaattaaaaattttttttttttttgtagagacagggtctcactacgttgcctaggctggtctcaaactcctgggctcaagccatcctctcaccttggcctcccaaagtgctgggattataggtatgagccaccatgcccagccctttcttattcttattgactgagaaatcttcaatgtggccccttgtcgtccataccactattggtactcttgttctcacttggttctgttaagcttcatttgagctttcccaatgctgctataatagtcttcctaaaaattaaagctgttcttattcccctgcttaaaaatttctctgctgttttatttcttatagaataaaacctaaataaaaggaaaatttttgagaatctagtccctttgatctagaactggtatatctctctacgcaccttcaaatcttttggcacataaatttctcattgataacttcagttttgtttttgtataccatgcagtgtttgtctttctatacatctttttctgttctccacaagttcctccatacctctcattcccctgccaaaaaaaaagccagaaagcagaactgagttaagacccggcttagatatgacctcctcagcgaaaccttttctctcacaaaacaaggtggtcatcttattcaaggaactatttatttatttatttatttatttatttgacagagtgttactctgttgcccaggctggagtggagtgatgtgatcttggcctactgcaacctctgactcctgggttcaagagattctcctgcctcagcctccccagtagctgggattataggtgcctgccaccatgcctgactgatttttgtattttcagtggagatggggcttcaccatattggccaggctggtcttgaactcctgacctcaaatgatccacccacctcaacctcccaaagtgctgggattacaggcgtgagccatcgtgccaccttttttttttttttttttggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtcggaactttattttttttaaaaacctgtagtgtaatatttgttcgtatatatttcttttgctagactgagttttttgtatgctggatgtctgtgtccttagcatttgtgccagtggcttacagtaggtacacagtaataattgatgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgtttaactttaggtattgaatgtgtattatgttcatggaattatattctgttgcagaggttcacaaactttctcagtgccgttagggtctcagtaacgtttttcactgtgccacctagatcgaaagaaatgtctgatagttctgtttattaaatacctaggtccaggcaacttagtagccacttgaaaaaaataagacacttaaattggaaacgttatttcactgctgagtaatcacatttctgttaggatgcttaggcatcgctcagcttctcaaacctggaatcagatgggacattgccaccctgatttcttgttttatatcgatgttattttatgtgataacttggtttttatgccagcaactgctgacaaaccaacttctgtaagaaataatgtcattgaaaggaatatataatagtttgatttattgttgaaactgaattactgtgacttgtagatcacgcagtgtccaactgatgttgagtaacactatatttccctggaaaatttaaaataactttgcggcgcccttgtgaatttatggtagtacactggggtgctgtctcagttcattttctgttgctataatgaatacttgagactgagtaatttataaagaaaagaggtttattttggcttgtggttctggaggtgaggaagtccaagatgagttggccacatctgatcaacctctggtaaggacctcatgctgcttcataacatgttggggaatggaagaggaaagggacaaaatacaagggacaacttcactttgtaacagcctgccttcaaccctctggagaattaactcagtcctgctgagaactgcattaattcctctaatgacctgatgacctcttaaaggccctaccacctctcgatactataacactgggaattaaattttaacatgagttttggtgggaacacaccacatccaaatcatagtaggtatcttagcacacagttttggaagcatgactcttaaacatttataaaacttttcttataacattttatgtgcttgattcttacaattattctaggtatgtacttacaggtgcactttttatattcggcatacaacaaatacttgttaatggcctaatgcattaaaaattaaggaaattgtgataaagtatagttttttaggcttaatttttgtaggctaacttatccttttattacaaaacttttaaaatctagaaagactagtacaatggtcttccatgtagatttaacagtttttaacattttgacatattcactttgtttttattgaaccatccatctgacaatgcgttattgaactaatttatctttaaatccttaagtacacatcttttaaggatgttctatagtatcacacctatgaatatatcctcatctaatatccactaatgatctgatatttccttttttgtatttttatttgttttttatattaataagatttaatttgtatttccctttttgttttaatagtggccaatccgccatggtatagttgaagattgggacttaatggaaaggtttatggagcaagtgatctttaaatatttaagggcagaacctgaagaccattattttcttttggtaagttacaagttataatttcactgaggaaatttttgaatacacttaatgagaacattttcatcatacttctttggtatactttggttattaaattgtcatatgtctaaatgactttgtaataaagctgtatcatctttaagaccatctagttatggctacaggagaatagtagtatgtcaaagcaccacatgttaaacacttaagaagtgcttttggtagttaatgtctaatctttatgatagaaacagtaagtaatgttcagaaaaatgttggaaacctgtggcacttttttgcttaaaaaacaatagtctgattattatatcattggtatttcttcataacaaaaatacaatataatctaactttttattaaacatctttttattaaagcagtgcatgttcataacttaaaaaatcaaatgactttataagatttaaaacaacaaaataacactttcctttcttacctctcccaacctttggttcatattccccggaggcaaacattttcaattttaacaaagtttgccctgctagtaatcttttaacatgtttcttttatttaacattttttttttatttcttctgtctttaagaatattatacattatttaccaacttcctaataggaaaaatgagaatttccctttttaccttttctctccctcaacacaaaatacctatcctttcccactcctcgcattgtagttacatcacaatttttggttaaatcaatattctgtgtctttcggtgattgtgatggactataaagttgaaagaaccatactatggacactcatacacccacaatctagattcgatgattaaccttaacatttggctataattgcttcatgacgtctatccatctttcacttcattttagtttttaaatcacttcaaagtgagttgcaaatgggagtcatttgacccctaaatactttagcacgtatttcatcaactagagctatcatttgtgtatggttattcttttcatataaaatttacatatcataaaatcaccggtctgcaccattcagtggattttgaccagggtttggcaaactttctaagggagcagatagcaaatatttttggctttgcaggggttatagtccctgaggaaacttaatgagaactttttatacaatggtccctgtcacagctactcagctgtgctgttgtagcatgttagcagccatagacaatacttaaattcataggtatgtctgtgttccaataaattttttttttttaccaaaacaggtggtgggctgtatttgacctgcaggatgcatgatgtgatttgtccaatctttgtcagttacatacatctgtgtaacctaaactcttaccaagatatagagaaattactatcagcgtggaaagttttctcatgcccttttgtaattaatctctgcccccgtgccctagtgacaaccactgtttctttttcatctgagattagctttgcccatgtttgagtgtcaaataatggaatcatgcaatatgtgcattttggtgaaacacttttacttagcataatctggagattgaattatgttgcatatactggtgatttgttgctttttgttgctgggtagtattccattgtataaatttgcctcactttatccattttcctgttgatgaatacctgggctatttttgttttttttttgtttttgtttttgtttttttaagacagggttttgctctgttgctcaggctggaatgcagtggatcaatcatggctcattgcagtgttgacctcccagctcaaacagttctcccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattgcagcgtcatagggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctggctaacttttgtaattttagtagagacaggattttgccatgttggccaggctggtcttgaacttctagtctcaagtaatctgcccacctcggcctcccaaagtgctgggattatagatgtgagccactgcgctgctagcttgtcagtctttaaaattttagccgttctggtgggtgtgtacgatttttcatttgcttttaattttaattttcattttctgataattatgttgagcagtctttcatgtacgattgttattattagctatttgtatattttcctttgtggggtcctctgattatcttttatgtagattttttttcttggagtttataatttcactgccttggtttttagtttacttaattttgtatgtattcatcagtaaattatctccagacttttaaacatagctccagaactcttctaaagaagtttaaacaccacagggagtttagcttataaaggttttatgtaaggtaacagtatacttagttgttttgctttatatttcttttgaaataataattttaaaaatatttaatttttaatggattcaagttttatcactttttccctttgtgatttgtacttcagaaatttaaggagttattcctaccttaaggtcaaaaagagaattctgtgtcttttttaaatttaaaaatttttcttttacatttaagtatttgagatacctattagattgccagtcagactcacaagaatcagaggtcttacccagtgttaatctttaaaaattgaaacagtttaagtgatcatgaggcataggtgaaatatgaagtccaagactgccagatctctgagtccttccttgcctctttagagtgtgttctgtcccagacttaacctgtgaggtttctaagtgatgtatacagtcacataaacagaagagtgctctgcaaacatcttgattctatgctcttaacaggtaaattaatataacatttttcagaaagctgtaccattagatctgtagaatctcggcttgtttactgtaatcctatatacttcggggacattcatctaaaagcattacttagatgagggctctcccactggcaaataccattgatgttttttctggaggtttgtcattaccatatttaaaggatgatttgactggaccaccttttccctacctccaaccctctctctccctgcttcatttctttttaatgtttaatctgtataagtggtatgatataggcattcagggtattttttttttaaaatgtgaattaccatactgttttcatatatgtatggatgtttgaattctctatagttttcctttgatctctgtgtctgtctttctacttgtaaatttaatgcattttaaataaaatgtttgaaataaattacttctcatttaaaaattgtcaagaaagttatcaaaataatctgatattatctatttaaaatgttatttatttcaatagactgaacctccattgaatactccagaaaacagggaatatactgctgaaataatgtttgagtccttcaatgttccaggcttgtacattgctgtgcaggtaagcaagttcatactttctaagtttgattcttacattttaacctagtttaatttgctgcctaaaatacgtactttttttttttttctgcaaaggtttaaacataatgtcaaagcatgttatacttctctcctgaattgttaatttagaagtaatattatgggaagtggagatatttagtcaggaaaagagaagtgttaaaaaagtaagttagtggtgtttgggtatttcaagggctttcataggacagaaatgaaggaactaatatttatggaatgctttctctgtgacaagaacattgtatatatatttatccttgtaaataatcctttatcatttatccttataaatctttttgtcctttattgtagtcttttttgattgacttatctttaggtatatttgacaccctaatatttcacttctcttaatttgtacgtttatctgtatggaacagcttctctcccacccctcaggatcagagctgacctcattttttttttttttcccttgtagcagaggtaatccctgacataacacaaatgctttatatgtgtattaattcattatttctattaaatgtagatatttttgtttctgttttttgtggaggaagaaaactaaagctggaaggcactttattcataattaaatggttagctgtgataccaggcagctgaggtctgtctgactttgctctttcttgggatcacactggtttttgtaactccacggtacacagaatcaataagtgataattatggatgaatattttaacttggatagcaaagaactttttaatgtttaatgcaatccataaatttaatgaactgccttttaaattctctgctgctaaaaatatttaaggagtcacttaaacctgtcatgaactttatagaagaattcagtcttgagtgggaggcccttttttagttcttagaatatgaataaaatgaggagttgggaaaattcatctttcacttgggagtttttgcttctcatcctatgttaaatataataaacttatgtttaaccatattgtcaggtaaagcttactttaaaacactggcatcatgagctttgtttcattcctctggagtcgtaatttggtttttcagtgatttccttagtggcctctgagtgctcttaatttcattatttaatctctgttctgttttgttgatgttcagtagtcaataacatttctgtaacatgatgtgctgatacatatctattctagtttgggaccgtaactgtttacaaaagacttgtaaaagtgatcagagataattcttggttgtagatgatagttttgaacttacttatagaggaaggatatctcataatgaagtctaaacagtatatatatatataactagtattaggatggaatttttcattttaagattgtcaaaaaataatgtatagttctgttagcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcatagaaaaattttatcaacgttgctccataattaaatcatagtagtatttggaggtgtgcgatggcgttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgggcacctgtaatcccagctactccggaggctgaggcagagaattgcttgaacccaagaggcggagattgcggtgagccgagatcgtgccactgcattccagcctgggtgacagaaagaaactctgtctcaaagaaaaaaagaaaaagaaggtaatcttttagtaatagttgtttatagccatatatgtattgaataactggaggtagggtggttgtgtactttctgccttacattgcagtttgtaacaggccagcccacgtggacatagtttaagttctggcaagttagttctatacaattttttttttttttttttttgagatggagtcttgctctgtcgctcagtctggagtacagtggcatgatctcggctcattgcaagctccgcctcccgggttcacgccattctcctgcctcagcctcctgagtagctgggactacaggcgcccgccaccgcacctggctaagtttttgtattttttagtagagacggggtttccccgtgttagccaggaaggtctcgatctcctgacctcgtgatctgcccgcctcggcctcccaaagtgctgggattacagacagttagttctgtactgtttaatgcaatcttccacatttttagctttaggacagaaatagcctttataaaatatgtaaatcttacaaatcatgctcctaaaagcaaatgtaaacctctaagtttgtcttaataaaatgtagggagtgagctattttattgcataatacaaaattaattttatgtattttctttccacagatactacatttaaaattgaataaagtactccagggaactagttttttttttttcgattaactctttgtttttttgttttttttttttgtttttttgcctttcttctttctttgtgctcaaggctgttcttgccttagctgcatcttggacctcaagacaagtaggagaacggacgttgaccggtacggtaatagacagtggagatggtgtcactcatgtcattcctgtggtaaggctattttacagttactgaacagaacatgaaataacacatctggcaaagttaaattatacgaattaatgttacttttaaaaaactttaaatgctgcactataatttggccatttgtccagttatagctatgttttgctcaccgtttaaaacttttataaacaattcaaaatgtttcttttactgtaggtttgtactgcaattaagaaaattacaaattgcaatatctggaatggaagtatattaatggctttcattctgttttccagttggatgtgtgttagccatttgatgacctcttttattcataattaacagatttcagactggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcaaaatgactactagaattcatactgtttattattaaatgggtatatagagaaaggtttatcttttaaagtaatttttatattataatgaatatcacttaaggatttacattattttgaacttttttttttttttattctcactccagtgtttaatgcatcaggcaatgtctgttaaagattacatcctcagggtgactacctttggattagactcctggtcctccaccactttcaccctcatgatatgtcataatggttttagtaataactgccattgtttaacgatagcttaagataaaattcatataccatacaattcacttctttagagtgtacagttcattgatttttagtatattcacaaagtccatccgtccccacaattttagaacattttcatcaccctacaaaggaaccctgtaactattaacagtcaccacccatttccccttgattccttcagcccctggcaaccacgaatctactttttgtctgtgttagatttgcctgtcctggccattttatgtaaatggagttaaacactgtggtcttttgtaactgggtgctttcacttagccgaacattttcaagattcatccatgttttagcacgtatagtatttcatttctttttattgccaaataatatttcattatgtggatatatgagattttatgtagcctttgggaggattttagtaagcttggaaattaggacgtgtccagcatttgatagctttttttagtttacttggcagtttatttttctttcttagtggtacataaaataatttttcatcttaaaattattgtttaaatctgaaaatcagtctgtgataaatattatatttttctttgagtacctcagtttactcattaataaaatgcaaataattgacttgcctaaggtcaccaaataataggtagtgaggctaggatttgacctggttctgcctttcttcagtcttttcttaacagctgcacatctgagcagtactatcagcatgttgataattagaataggtaatttgcagaatagaagttatcaatatgtaaaagaatgagttttagtaaggacattaagagtgggtattctggctggtatggtggctcatgcctgtaatcccagcactttgggaggccaaggtgggcagactgcttgagcctaggagttcaagaccaacagggcaacatgctgaaaccctgtctctacaaaaaatgcaaaaattaattgaacgtggtggttcatgactgtagtcccagctactccagaggctgaggagggaagataacctgaccctggagaggttgaggctgcagtgagccatgatctcaccactgcactctagcttctctagcttgagcaacagagtgagaccctgtctccaaaaaaaaaaaaaaaaaaaaaaggttggtgggggggtgctattcctttttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgtttcattttgagtggtgtattagtttgctagaactaccgtaataaagtactacagactgggtacctaaagaataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacaccacttatattggattagagaaagcaaccctaatgaattcattttaactagataccactttgaataccctatctccaaaaaacagtcacgttctgagatagagcttaggacttcagcatgggaatttggtggggaggaaaaacacaatttacccagtagcaaaaagttatctttaaaagataacttttttggagacagagtcttgctctgtcgccgaggctggagtgcagtggtgcgatctcagctcgcttcaacctctgcctcctgggtttaagcgattcttgtgtctcagcctcccgagtagctgggattacagatgtgcaccaccacacccagctaatttttttgtatttttagtagagacggggtttcaccatgttgctcaggctggtcttgaactcctgccctcaagtgatccacctgccttggcctcccaaagtcctgggattacaggcatgagccactgtgcccagccttgaaattgagttcttttattcacgtaccatatctagtgctctctattcctttgtgaaggtccagatttccacctagtatcattttccttctgtcaaaatgacatccttcaacatttcttatagtgctgatctgctggctttgaattctttcaacttttgtacatcctttgaaaaagtctttattctcctttagttttgaaagatgatttttgcttggtatagaaggttgacagttttcccctgtagatgtcactccactgtcttctggcttaccttgtttctgaaaataagtcagctgttattcttgtgtgtgtttctttgaatgtaatgtttatttgggtggctgtcttcaagattttctttttattcctgattcattggtttttagcaatttgattgtgatgtacctaagtaaagttttctttatgtctcttctccttggggttcattgagcttcttgtatatatagtttgtaattttcatcatatttggaaagtttttgtctgttactgattacatattttttctcttcctcttttctctcctttaggtactctaatcacatgtatattaggctgcttcacagtgtctcaaagatcatgatgctctgtacatttatttttttataatctttttcttttttttggatagtttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtcattcctctgtattgtttggtttttctcctcgttaagtgttgtgtttttccgcttccttgcatgcttataatttttgatttggcactctatacattgttgtgtattgtatttttggagttctttataagtatttaggattttttcctgggacatagttaagataccaggaactagtttgatcctctcaggggctccttttaaatgttattaagcaggtccgtaacaggtttttgtccagggctggtttgtccccattcttgaggcaatattcttctgaggactctacttcatgtcttgtgtttgaaaacatctttcaactttggctagtgggatcaggaactatttctggctatgtgtgagctctggtggtggttctgtctacttttttctagaggtcctttctctcaccttgatggtttcctcacaggagtgtgctgatcagtattcagttaaggaggtactctcttcacatcttcccagctccctgttggttcaactcctccccctccaataatttggcctacaaacttcagccactttggcctttctgacctttaaattctatatccctaacttaatgagaccagtttgagttctctttcctattgttgtggcctagtaactctccctaggcagtaggatagagtgtaacattcacgttatttgtttcccttttcttagaaagtatctctgccctactctgccgattgtcaaatgtctgaaaacctttctttctttcttttttttttttgagacggagtttcgctctgtcgcccaggctggagtgcagtggtgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgaaaacctttatttcttataaattgtcctgttttctctttaaattgagagggtaagttcaatccctaatattctgtcatgccagatgaaggcatccttaatattctttcctaatgaaatttaattttgccacactatttgttatacttctgacacatcagtaaatttgtgaatcagttctacagaatttagttatttggcattatgatggtgtgtggaaagcttcaggtttgtgaaatggatacatacttgattaggaaaatgataagcactttgtcacatttcttatgaagcaatctaaattttttactgaaattataaatgatttaaaaatagtaccatctgatataaagtctgctatctaaaccatttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtatcttttttcccctctctaggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatatatttacattttctttgtgtttcttaaaagaaaattattacagcagtttgtcttctgttttcttcatattttatatttgagaggagtaatataagaacattttaccaaatgacattaacataaatttttgtgattattctctttattaaaaataaataattatttcactataaagtccttgcatctcagtttcttcactgaattctttattttaattctaaaagcttttgtcataaaaattattttgatacaattgattcattgtgctatagtatagaagcagtgcttggctcaagtgatagggcacatagaagaaaaacatgaaggctatctaaagtattttattaatttttttctgccatgtaagtattatatcagtgcttcatgcaaactatcaaaatactttagcatcgtctttcaaacttattatttgccacataaccaaaaaatttcagtgggtttcacgtgttttgaaaagcagaactgccatggcaaaagtaacttacttgtctctgtttccatggtttttttttttttaattacctgtaaatttttaaaatttttaatttcttatttttattgatttttttttttttttgtagagatgggatcttgttctgctacccaagctggagcgcagtggcacactcgtggctcactgcagcctcaaactcctgggctcacgtgatcctcccgcgtcagcctcctgagtagctaggactgcagatgcatatcaccatgtctggctaagtttttgtagagatggaggtcttgctatgttgcccaggctggtcttgaactcctggccttaagcaatcctcctgcttcggaatctcaaagtgctggatgtgagtcaccatgcctgggcctctttgcttgtttatgggattttccttgctcgtcagagcttaagaatgaaaatttatcaactacttcctaggtagtaaattagtaaatgactaccaaaagttaccccaagttggtggcataagaattaaatatataaaaagttaatgtgaatactactgattcaacatctttgggaaatctgtgaaattaaagcaaaacgagaaaacaccagagatttaaatctattccagagaagattgatggtcattctgaatgtctttaaaggaatatcatttctttgtcattctcacttccaaggtttggagaagacctcaaatagtgtaatcaaatgtcttcggattccagtattttttctctttgtgtattttgattattactggtaatatttgcatctatcttggatggtgcctgtgatgtgtaaaaatactggaaaaggaagtttttttaaaaaaataaaacaaatattggttggcagttgggagtttataaattacaaatatgatgttataatctataatatatttttcagtgtttttgatgaaaacttttacttaggtcatataaccaaatatgcaacaaaatagagtaatttatatttttagccttttttctttgctcttttatttactcagaccgtaatcagttttgtttcagatagatattaaggatctatattaatttgtgtggttatcacaattattacttattcttcagttctgtattttatttattctccttacctacagcacaagattcattattactgagacagaaaatgttgaatgacattagtgaacattttcaggaaataacattgaaatagtagaagtcagctctccagtctctcaaatactgtttatatttaaagtcagaaaatatgtgtaggagatgagtatgtttatttgtactacacatatgataatatcctaacaaatttttcttccagcttaatttcctaattttattttctgaagagttttttttttttattggattatagtttactgaaaacatgccattcttctttactgttcctataataagcaaaaaaagttacttttgtttctttgtttttcaggagcgctatagttatgtctgcccagatttagtaaaagaatttaacaagtatgatacagatgggtcaaaatggattaaacagtatactggaatcaatgctatctcaaagaaagagttttctatcgatgttggttatgagagatttttgggacctgaaatcttttttcatccagaggtaattttttttaacggaattgtttaaaagtattcagcagcaaatatgaattaatagatattcagagagaattaatctcagaaacttttattagtacactaaaagtttgagtttttatgaaaagtttataaaacattttatgaactttttaaagaaaaaatttgcttttgttaaaataagcaaaattgttgctattttttgcagatttagaaaaaactttttaaaaaatatgtgtggcttatgggggggtcatgaaaagaggagagcccttaaattttttttttcttccctccatcatggactcaggtaaagttttgtaattgaaataaaatattttgggaaaggttctagaaagctccccccctccctatttgtgtaaaatgaccattatacaaagaaccttcaattaaccattaaaatatataactagtagcaaaatagtcttctgtctatgaagttttagcaacataaaggctttattaaattaagaaatacatacttttaataatggaaaattcttctggtaacttagtatcagaattgtaactttattaatagaattactaatattacgtacttactctgcttatttaatgttaagaatagttatttttaaaattttgtttattcactcagcaaatgttaaatggtttgaattttcatgatctcagcttaagcactgggtattcaaagatgaaaaattattttatcttgctcttactgagctcaaagaataaaagagatgagtatttaaacacgtaaggttatagttgctttaatgagtgtatgtatctgctgagggcacaggaacaaagagcatgtaagtctgcttgggagaacatctcaggggagataatggttgaactgagacttaaaggatgaatgggtgtttgtcagtcatgtgtggtaggggagtatatgtatttttgtcagaaggttagctaggcagaggtcttagacatgagagtgctggaaagaaaagtatagaggacagattggtaggagagggatccagataggtattcatggacccagtcttgaagggcagatatgttatgcaagggagttagctagattctgtagtcatgcaaaaattttaagcatagaagataattgtgtaccatattagaaaggttactctcgcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatatgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggaggaaaaggttttgataaagcagagattaaagtattacagcatagaggagagagcaagtcctgaaagctgaattacctagggatagtgagggtacaggtattggagatcatgatgaaatgacacataataattgtgaattggtagcagaggagtgagcatgagaaggataaggaattgtggtcagactagtatactggagtgtgaaggtttttggtggtacattttctttgcactttatcaaaacataaagattaagaggatgtatacacacaattttaaaggtcaaataacactgacagacttaaaattagcagctcttcaccctcctgctgccattgtgttctatagagcatccactagcttttagttattgctcttggtagtaacccccagatttctaaatactgtgatggtattgcaggaacatggatggagctgtttcttgatatgtcactgttagtggtttaaatgctagcctcctttcagattagttctttctagactctcttttcttccagcctgccaacatgttaggttattgttattaggtaaatcaatagtattgtaatatttatagtattatacctgagactgttgttcacttttgaggcaagtagtgtaatgtgattcttttcccttaaaattcagcttttcctacactttcaccttgtttattcatttgcttcattttctttttttttaactttaagttcaggggtacatgtacaggtttttatataggtaaacttttgtcatggaggttgtacagattgttttgtccccaggtattattaagtctagtatccgttagctatgtttcctgatcctctccctcttcccactctccaccctccgataggccccagtgtctgttgtttccctccgtatgtacatgtttacttatcatttagcttccacttaaaagtgagaacatgcagtaattggttttctgttcttgcactggtttgctgaggataatggcccccagctccatgcatgttcctgcaaagaacatgacctcattcttttttatagctgcatagtattccatggtgtatatgtaccacattttctttatccagtctaccattgatgggcatttaggttgattccatgtctttatttttgtgaagtgctgcagtgaacatacatatgcatgtgcctttatgatagaacaatttatactcctttgggtatgtgggattgctgggttgaatatttatgttttaggttcttgaggaattgccacactgttttccacaatggttgaactaatttacacctaatatacaccaagagagtataagcgtttctttttctttccagctttgccagcacctttttttttctttttaaattgtatttattttttaaaaatattttctctttccttcattttttaggagggatggtgtgagaatattttttgagtttttaataatagccattctgactggtatgagatggtatctcattgtgggtttgatttacatttctctaatgatcagtgacgttgagctttttttcttaagatttttggccacatatatgtcttcttttgaaaattgttcatgtcctttgcccactttttaatggagttgttttttccttgtatatttatttaagttccttatagatgctggatattagacctttgtcagatgtgtaatttgcaaagattttctcccattctgtaggttgtctgtttactctgctgatagtttcttttgctgtgcagaagctctttaattagatcccatttgtcattttttgcttttgccatcttcatcatggaatctttgcccatacccgtgtccagaatggtataatttgcttcattttgtttgtacagtcatttattcattcatttatttattggggtttgaattaactttcttgttatacacggtctggaagggaaccgaggagggtgggtctcattctatatagaggattttaacagtttcttttccaaacaggattgaaatattgtattcattgtttttttgccccctgattcatccttggtcatttacctttccttttaattctcttgctgtcattttagcggagagtcaagagacgggagagataaccacatgtagctggaagttaggacagatttttgtatgggccatttatatgtgagtagattaatagaagtgtgtcagacctcatttcatttaaggcacatcaattaacttgaaattgaaatcttagagaagaatattaaagctccaagttggggacaggaattagaaaattgcagaagatcctgagcaaatgtcctgcatgaataggatcatgaccacacgatggataatagcatgggatataggagatgagcatttgaatggaatatgcttgacaaatgagcttagctgatgccttggctttcttaaaaaccttgaagtaggctggttgtggtggctcacacctgtaatcccagcactttgggaagccaaggtgggcgaatcactcaagcccaggagtttaagaccagcttgggcaacatgggaagagcccgtctctaccaaaaaaatacaaaaaattagccaggcatgtggcgtgtgcctgtagttccagctacttgggaggctgaggtgagagtattgcttgagcccaggaggtccaggctgcaacgagctggcattgcaccattgtactccagtgtgagcaacagagcaagaccctgtctcataaataaataacccaaagctttagatatgtaaataaaatgtgtttcatattgcttaggaaaggtatagttggctggatgaaaatgtgtcttgctgctaatgtttcatatatcattttttctattaatttgaataacctttattgtttcatacaccaatttttctttattttttaactttaaaacattttctgttgtctatagctttatgttccttataagtaatttcttctatgagaaacctgtttctctttttaaaaaacctgttttgttttcttttttttaaaggctgtttttaaaaatcagttatatatatgcacatggtttaaaagtcttggtctgcgtatcctaacaaaaactaggggtgccctgcatgtttctttctcttgttttgtatttctagaggtaaccacttcaaactcttcttagttgcttcttttgctgattacctccttagctatgaattgcttggttatattgcaacttcaaattttttttcagtgttaggcttttcttgttttcttttggaaacagggtcttgctctgtcacccagtgcagtggctgagtcatggctcgctgcagtctccccaggctcaggtgatcctctcacctcagactcccaagtagctgggactacaggtatgtgccaccacttccagctaatttttgtatttttcgtagaaacagggttttgccatgttgcccaggctggtcttgaactcctgggctcgagcaattcacccatcttgccctcccaaagcgctgggattataggaatgagccactgtgcccagccctgtgttaggcgttgtctgtcgaattccaactatggaagaggaagattgtcttttttatccttcttctgtcatcacagacaggacctttctattcccttttcatctcatttgttacattataatttcaagtaggttgaaattcagtgcttatgtttttgtgaccacaaattttgttcatatctgagccatgtagttaaccatgaaatcttttcccttcctataagtaactttgttttccaagaagtcattaataaactgtttgcttagtgctaaaataattaccattcattcacctccaaactctcttcagtagttatataaatctcttctcaggatattcagatgtatagggtttattcatcagtttaattttctgaagtgtcttttacatcccaatctgaacttgcttctgtcggttcccagtatagagttgccatattcctttactatcattctagggattccctttccctctctcttgtgttggatctctttttcgtatatcctatgtctttttcactccatttacatgatctaaatgaaaagattttgtattagtatgtgtcactttgataacattaaatctcttttcattgtatgcgcagcctgtaaataatttagaactaatcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctcaaaaaaaaaaaaaaaagaaaaaaaaaaagaaaaaattgacacatgcctaataattatcaatacagttatagactcagtttaataaataaaggaataatgtctctcaactaggacaacctaatgataaaaatgaatggctgaggagatatacaatacttgtttgtttttcactaattagagctagattttgattatttatttagagacagagtctctctctgtcacccaggctggagtgcagtggtgtgatcataactcagtgtaacctcgaattcctagggtcaagcaatcctttttcctcagccctctcaagtagctggaactacaggtgtgtgccaccatgcctagctagtttttaaattttttgtagagacagggtctcgctatgttgcccaggctggtgtcaaactctgggtctcaagcaatggtcctgccttggcctcccaaagcactgggattataggtgtgagtcaccatgcccagcttcaagttgttttttgtttttgtttaagttagttttttaaaaagtatgtttttcttgagtgccagctgtttggaaatagtaagtttattttgactatggtatatcatcgtttgaatatatagctgatgtttgttattcaaagtagatgtgccaaaaagttcttgagagcgctgaattagtgaacactgagctagctattgctcctaggggaaatacagtattaggtttctttgagcctctggtaacatttttgttatcccattaacatatacccttgtttcatgtgtgtttctttttaaaggcactgcatttagtatatcattttagtatattcatttatattcaatagcactagaacacatgtctgaacaaagctatctaacttgctttttctctgtaagacacatcacagcctccttgtgtttactagccagcacttgagcagtatgcttgggggccattttaaataatgaaatcactaacaaaaatatgaaaaccgtgccactaaatagaactgtgaaaaggacacttgtttatagtatgagagctgaaactagatagcagagtatcatcttgttcaacctcaatggggaatgtgcacatcagtggactcaaatttttgttgctctacacgtgcatgtccatgaataaccatattttgatttggggagtaacaaatatgttttagcgattaggtaaattcacaaatatggaatcatgaataatgagattagactacatttatttatttcatcccctattgatggacttaacgggtttttcctcttagaaacaaggctatagtaaatatgcatatgtaatagcatacatgtttggggagtttcttcagagtttgttgtaagaagtggagttactggtatgtgcatttaaaattttattagctatttgtattagtccgttttcatactgctaataaagacatacctgagactgggcaatttataaaagaaagaggtttaattggacttatggttccacgtggctggggaagcctcacaatcatggcagaaggcaaggaggagcaagtcctgtcttacatgatggcagcaggcaaagagagaatgaggaagacgcaaaagcagaaatccctgataaaaccatcagaccttgtgcaacttattcactccatgagaacagtatgggggaaaccaccctcatgattcaattctctctcaccaggtccctcccacaacacgtggaaattatgggagtacaattcaagatgagatttgggtggggacacagagccagaccatgtcactatgttactattgccaaattattctccatagtggttacatcagtgtatactctcacagcgttatatgaaagtttccatttacccagatttttgccagctcatagtatatgtatgactttacatgtttgctattctgatagttataaaatggtatatatcatcataattttgagttttctctgatttcagtgtcttcaatctgaatctgttagagaccagtattagtggtttctaaaaggccttttgtttttgaactgaaaactttgtttaaccttttattgtgatatttgtcagtagtgatatgatctctattatatatccaacttatttttcagtttgctaatccagactttacacaacctatctcagaagttgtagatgaagtaattcagaattgtcctattgatgtcagacgtcctctctacaaggtatttatagcaaaattgttattcaaggtcttactttaaaaaaacttaaacacctctcataaaaaggatataatagcatttcagtactatatattatatctttaaacttttctctttttaaatattatatttattttctctccactagaatattgtcctctctggaggttcaaccatgttcagggactttggacgtcgcttgcaaagagatttgaaaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttaaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtggtttaataaagtaacctttgtattacatgtcctggacctttaggcttgaggttaaaaaaaatcaaaattaatttaaaattcttagatgtctactttctatatttagagatagattcttcatttttttcatccttgttaaatattgaagcagaacgttgatttagaggaatgatatggcttttttcaaagctgtttgaaaaaaggtatttcatgtgaataaaataccttctgcttggaagattaccaagaatgaggactttatctgagacttccataatcattcagaattacttaaaagtaaagcacagcactctagggtttgctgattgttgagaaattgcatgatggctgactgttgtcagtgcctatattttgattatcttgagtaaacctatccctaggaatgcagtaaaaagtatatgttttgggtggaaggcaaaatattgaactctgtccctataatgtcatgacttcacacttcaggaagtctactcaatagacttttaaaatgttgtgtttgcttttgcatccccttcccaaccaaccaaaccaccagcccacccccattcatccattcatttgcccatccgtctactccccttacccacatatctatctaccctacctcctacctaaaaaagaagtcattgggttttgcaagtataaattctctgtactgagaatcctactaaccacattgattatgtgaatgaacatagtgcatgttctggtttttttgttagaatacttaaaagattgaagttgattgtcctaatggtatggttatggatgtattaaagtagctgtttagtttttaataactcattacagatatataagtacaaaacaatgctgtatgtttctgagtatagtattttaaaaaagtgagattgtttaacatttttaagctctttttacacttgtaaataagaaataaatttacccagtgatcagtaccgtatcgacatattgaaagaaacagattgggtgtcccttttttgaattgcttcataccagaagtgttgcaggttttgagtttttctggattttggagtatttgcattatatactggttcaacatccttaatccaaaaatctgaaattctgagcatttcctttgaacatcatgttggtgctcaaaaagtttttggatcttggagcattttggattttcagacttgggatgctcatcatgtataggaaaaaccttgtgttttggaggactctgccttcttcaccttagttttacttgctagtaacttttatagatcttaatagcatgcctttatctatctatctctggctttattttccttcagtctgtaatttttaatggcaaccaaacagttttgaaaaaagccatatcattctgtttctataaataggtgtgtgtacacacacacacacactaaattgtagatatgatggttcattatccccaaacattttagtatatttctaaaatcaagaacatattacaattatcaaaatcatgaaattaaccttgatccagtgttatctagttatagaactgattctaattttaccggttgtttcactaatgtcccttataacaaaaggaaaacaaaataccttcttcccccttatccaggatccaatcaaggattgcatgtttcatttacttattgtgttgcttcagtctgttacatactcaatgttttttgtctttcatgaatgaatgtgacatttttgaagagtacagccatttattttgtagcatatccttcagcttgggtttgtttaatatttctgcttgagtaggttcagattatgtacttttggcagtgatgccacagaattgatattgtatcatttttagtgcattgtatcagtagacacatgatagaatttgtcctgtgtgtgaattttgagcttttggttgaagttgtgtctgccaggttttttcactataaagttattatgttttcctttatatttaataagaatctaatgaggagacactttcagactatcctgtttctcttttaagtttcagtcactagtttttagcatccattgtgattcttccctaaaacagttattactgtggtagttgctaaatggagttttgcaatttctgtcattccttctatgtttttaagacttgttttactataagcaagagttttcccttctcccacattcatttattcttttagtaatatctatatgaactcctgatttctcattttgtggtctatatctttaatatcactgtaatatcataatatcagtaataccactcatcattaattttaatcccacatttttttttttttcagatttgaccagtgggagttattcaaatggctcttaggtttttttttttgatgcagccacatctttttttttgcctacttctgtacttcccggcacagcaaggtgtttcaggctgatcttgtactttctcttttctggccctggaatcagccctttttttctccttttctttcttcaagacacccttgtcttattcctgttagtggagaacgttactaagaaaccaagctttgtgctcattgctgttggggtatcactgagtctaggccttctcagtgattagagctaggggtgtgtgtgtgtttatacatctatatctaattctctacataaattaaaaccatgaatttttacagacgtctccagttatagaaggttcactctagttttctgcccttccatattgtaatgcccttctctgacagtgagaaacctggctcctattatctataatatgtttatgtttttgcttaatcctggaatatgtatatgatagtttcagaattgttaatccacaccactgtgaaaaatagacccaaaactagaattcaatatttgcttatattttatcttcagcctgaaggcttataagattcaaaatactatgctcacaagttgcttgtgttagtccctttcctcaccttagtgtgcttatgtttgaaaaaagtacaattagtttaatttgtttttgttgtactttgttttgccccaacctccccttcttttaaggtgttattttttagtatgtaaaacactaacatttagattcttaaagtcagaactgtataaaacatgtgctcattgttatttcccttccatttattctgctctgttccctccctgtctcttccacagtgttcccaacccctttcctctgagacagccaatctcaattgtttctggtttgtaagataccacctgaatttagtacagatattatttttgtatatgtacatttaaggttaaatgacacagaagttgttatttgaatttactatgaagatgatcatactatgtctttctttagccaaaacctattgatgtacaagtcattacacaccacatgcagcgatatgcagtttggtttggaggatcaatgctggcttccacggtgagtgtgatgaagcttacttttattttattttatcattattattttatttatttttgaggtggactttcgctcttgtcacccaggctggagtgcaatggcatgatcttggctcactgcaacctccacctcctgggttaaagtgattctcctgcctcagcctcccaagtagctgggactacaggcatgcgtcaccacacctggctaattttgcatttttagcagagactgggtttcatcatgttggctaggttactcttgaactcctgaccttgggatctgcccaccttggcctcccaaagcaaagtgttgggtttacaggtgtgagccactgctcctggcctttattattattattattttttattgagatgaggtcttactatgttgggccaggctggtctcaaactcttgggctcaagtgatccttccacctcagcctcccaaagagcgctgagtttacaggtgtgagctgctgcgcctggctgaagcttatgtttaaatttatatatatatatttaagatagaagagtccatcaatacttggagaagaacaaagcaaattcctttaaattgtatctcaaaataataggaaactttgtatatatgtgtttgtagtattttaaaaattggaagtaatttaaatttaattggaagtcatttgaatttaattttttttttttttttagcttgctagacattattttagagtgaccattttatactatgttttaaagtttatctgtagggaaagttctgttaaaactggtaatttagtcatcagaaggtccttgtttgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttatttttttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttcagaatcctcgcagcaggtgtgtgagacaaggattggggacaggagttaattgctcttttggagttccgataaagatttatagctgattttaagtcatggctgctagaatttctaagctttcatgccatgaatggactaataataaacattttagacttaacatctattttaaagcatcactcttaaagtttatttcaatataccttcaagatggtagatttttgacccttataaaaatacatattttttgttttcagcctgagttctaccaagtatgccacaccaaaaaggattatgaagaaattggacctagcatttgtcgtcacaatccagtgtttggagtcatgtcgtaaaattggcttcatagttattggggttagggaggtggggaagagataatctttctgattacctgttttgtctggatggctggttttgaggttttaaacctgacttgaaatagtaacaccaaacatgattatacaggaatattttaataagtgtatcaccatgcagatgtagaagagagcgaaagtgattgtgtttttctttagattgaatatttgaatcttatgtgtaacaaaaagaagtgggttttagttctttctgtgccctgatattttgtatattaatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattac

SEQ ID NO: 35737 - DNA, 7763 bp, Homo sapiens
cagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggtaagccgggagcagcccttcccccaccgccccctgagaataccttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttcatatgctgtctttcatgcccatttctgttggaaggtatcggttcttaccaaaccctttgtctactaaggacctccctattgcagacgtcttcttattcttacaggttcatggcggctactatagcaggccttagttcactcccacttccatttgattattgtgtggaggtgtgtgtgcaggcgtgtgagagagaaaactggaaatatacattagagtgaaagtcgttgtcttttgtgaacggatgtgggcctgaggtcttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaattatggagtatttccgtgactccttgctatatttcaaacctgtgttctgacagtgtagtttgccgattctttttctgggtactacctttgttaagagtcattgctgcctttggcgtccatttcccttaaattgggcttttttagagctgagagtctgatcattatttcccctagtaatgggtgccctgtgtcatgggcattgctgtgcgttagtaaagaaaagtgacacaggtctctcaggtctagtttgctttcttttttttaattggcaagttgagaattattttgtcaacaacttaattgagagcaaaggttgctcttgtggagggtttatggtgtgatacctaatttttggactgtttcccacacttcagcccagtcagaagaggtggtgtctgcttgtagcagttaggtttaaggagaggacagtgtggtcttgattcaggacaaattatccttatataaaactctgggtgtctgaaccctaggtcccctgacactaacctatgcttagttatttttaccttattttatgtaatattggcgtttctcatttcttaatactgttctggtagaattatagatgtatattgatgagcagtagttattagggtggtcttttttcctttccgtttctcagtgttgggtatcttctctattgcttgcccacttaaaatctcttttagatattttttaaaatttaacttctttttctggcgttagaaccaacagatccttagattaaggcgtttattaatgatctttatgtctggaatgtgcatagttgcttgcttagttgcacttgttttctctggttttgttaggtgccaaagtggccccctgggcaaatgccagagacaagctagcactttaaggcacttaagtgcataattgcatatctactctcttttaataacctgcaacctaaacttccagctgtgtagacctccttgatattttgttccttccacccccgtttccctattgtgttttctggtctcccagaatctaacattaattttgcaaggaaaattgtgtgtttaccactttctctaatgttagaggatccatttgttgactctcccttgcttttgaccatttactcctttgacaggtgtatgtttaggtgcatcataaccaattgcattgggaagtttttgcaggatttggatctcttctgaattttgcttaccagtaagctggtagatcatgttaggtagaaattgcttctgtagagacttactaaaacttagttttaacttttctagaaaagtttctgcttttattacattttcagaagtaatacttttcatttccagaatgcaaattttaattttcaggaaaaatattaggtgtatgttcttagttacgctctcagatatgtagttgcaggagaagtactttaattctgcttaaactgagcagtttggtccactgactagtataactagttattctccactttcctcaggcacgttttcttccatgttttttacagtattctaaaatttcaggcatttgagaacaatctgtcctgtttttgccctgtttgcctttgaccctagtagagggtcactaaaattaactgtcagattgtaaagaatcctcgttaaagcaatgatcagaaccagcagtttaaagggcccagttaagggagaagtctgtccttcaacttgttgtgcccctctgtctccccagttcatgagggtttttccagagatgtaccttgagatttgcttgccacattcagctgtggattgagtctagatcattctttaatagtggtaatcattggagtcttttattcggttcttttaaattttttgaggagggtggagaactggcctttacttatattcctttgcttaatgaaaatccatcttgctagtaaggattggaggtgtcagaaaagacttgggcactgtttcttactttgacttcttttgactttgagccgctgtttggagatgatttttacctgtttggagatgattggagcaagagtagtttatttcttaagcatttaaactgttgttatagctgaaatatttcttcatctaagtggtcttttcctgaaatcaggtcattatactgaatctatatgttgagtcttttttttttttcctttttatcttttcctaaagatgagtcctgcattagaattgtctagataaagccattgctatgaccagtgtctggggtaggggctggggctatgactaagagtgatagcaacccttcttgcgtctgtttcttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgagaggggtggggtgttccctcttctggttttgccatccctcctgcagcctaaagggctccaattaggctgccctgcttgcttgcttgcttttgcagggttaggggaaggttactaggatggctcacaggctagagagaagtcctaactgcttaactttaaaatacatagagttccttggccctcatggctatttttcagggcttctggtagtgggagtcaatttgattctatttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgacccctgatgataaagtccataactgtagttaactggtcatcactgctcaggtcccagttactaagaagactaccaaaatggcatcatcttaatcttgaagcgtatttctgacattcctgaaccgttcaacccttatgagttttatagaacttatttgatggtaagttggggtagagagaaatacaaaacttatcttttataaagttccacaaggaagtctgggcatagatgctaacactcaccttctctgcccagctcagatttattccctgaatagagtgcccactccattgctatatctttcagtctgtcctataacagcccagcctgtcacttacttagggttttttttttttttaagtaactattcccacagttctagttttgacatcatctactttctcagggtatatgttttaagaatgcaggcacacctgttaattttactcctttggtaatgttgaaatccagggttgggagctttgccataagcaaatcactcccttcttcatcttctcactagctgttttgggcatttaatactcttgagccagcagctctaccctgagtccgctggctttttccactgtcatacattttgagccccatgatccatttggctctccttgaatatattctcttctgatacttgccagctttgggctctaggtgtttgagattattgttgtacttaagggtaaatctcaatgcccttagttttgaatagctcccagtatgtcccacacattaccattgatccttaattatagtaactgtgtgagtgatagataactgtcatctttgcagttagggcagaaggtatgtggctttcccagggtcattgggtaggcagtcactgattgggctggaaaagagacttgatgtgtagcttatacatgcccttctgcaccttctttccaaagttagtttcttccctagttggaattggatgtcctcaggtcttaaaacttgtgcagttgatgctacttctatctagactttgaatgatttttaactcggaccttggcagtaactcctagatagaaaatactgttaattttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaagatttgctattaatttaagaccttagtctgaggttgtttagcctccccagttactctctggccttcaagctcttttcattgttagagattactgtgatactgggggagaagggtacaagtaaacttaaaaggagtgtcaagttatcagactttgtaaagatgttgaagttttaaatgggaaagcccttttgagctttgctgtaaagccgctgtattgtgctctctttcaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 35738 - DNA, 72598 bp, Homo sapiens
attgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccaggtaagacctctgggcccccctccaggcctgcggtcaccagccccggctgcggacagcgaccccagactggagtcccaacctcgggcccagatgcggaactccagcccgggtgtctaacttgcaaatagcaagttcggggaccccaccccagtgtcccttccgaacccaagccagaaccttggccccggggtttcctggctgcagagacactccccagatcaagaaattaccatgagctccctgggcgacaaacggagctcccatcggacccgcagatacggaatcctagccccggggcattctcggttgtgaagagtgctcctagacttagaaccccaccccctcatccccccaggacccggtccaagcccaaagctgcccttcagctgtaagcactgccctcaggcccctaaaagtcacacctcatcctgggttccccagatctggaatctacatcctagtacctcctctgtgccctagcccaggccctgggctgcaaacaatgacctcacctccctaacctgggaatgtcagcccctctgcccagggaaccctaactcaggggcttccagctgcacggtaccccccacacccttcccccaaaaccccatcctagtgatagcttcagtggctacagaccgatatcctctccccaaccctccagtggtgagcatcagtccttgccccatattcctggatcccaggcagtgaggggactgaatgtaccccactgtaagctcccctgtacataagccccaactctagctcttgcccctccctcacatccatgtattggccccttccttaggacttgggactggaacccccatattccccagaccagatcataagttggagttcacctctccctctctgtccctttccctcaggccacggtttctccctagcttcttcctgctttgctcactgtatatgctccagcaagcaccccccctacacccacttttgtgactcctacgtgagccctaggaattttactgtttggcctcaggagggccctatatccccaggagttaaggaagtgcctttgagaactcctggttcaggtgactgggaggcacctctacctgggtgtcaccatggaatgaagctttgtttgtcaaatatcctgacatccttcctttttctgtggggcagccaccaagcaccacatgcagcccttgcctggagtgggcctggggtcactagcaccttagctttctgccctcactggcctgggttccatgccgtctcttccttaaaaggcggcatggccacggaccatttgcatttcctcactgggtcctagaccactccattctctgtatgtgatttttcacacctgacttgggcacctggtccatgccgctatggtttcttcaggcctatacccaagacacccagcctatggacttaaaacctcctgctctcctgggggtaggccagggttaacatcctgactctgttattcagctgtatgacctggtccaagccactttccgtctctgtttccccttggtttccttgcaagttaaagtttatctgccccttcgtgttaggaagtggaaatgagatcgtccactggcattcagtaggcactccctgttgttgtgtgggtttttttgttgttttttgttttgttttgttttatttgttttgagatggagtctcactctgttgcccaggctggagtgcagtggcgtgatctcggctcactgcaagctcctcctcccgggttcacgccattctcctgcctcagcctcctgagtagctgggactacaggcgcccgccaccatgcccggctaattttctgtattttcagtagagatggggtttcactgtgttagccagggtggtctcgatctcttgaccttgtgatccgcccacctcggcctcccacagtgctgggattacaggcgtgagccactgtgcctggcgcctccctgttgttaacagtagtctgacctttgctgtgggggatccgcctcacctctctggtcctcaaactccccacctgggaattggggataaggattcaagggcctccctctttagtgtccagctctgcctgctcctgtgaaccctacctactttcagacagcccaaatcattcccaggcattctgagcctccccagggattgctgtttccccactccaccacgatcaattgcatatttgtccatttctggtttccccaagtgcccttcactctctgaagaacagccatgcctgaatcagagtctgcagacagcctggtgccccaaatctgcaatcaaggccctttatctcctccagacctggaggtaggggaggagacttgccaaactggtttctccaacttcctttccactggcctctctgcttctatctgctcactgtgtgatcttggggaagtatttgacctctctgggcctgaaaaagtgagagaccaggctcagtgcatattgaacacctatgttctagtccatgttctaggctctgggggcagaatggtgaacaagacagaaaaaaatggagctggccgggcgcggtggctcacacccgtaatcctagcactttgggaggccgaggtgggtggatcacttgaggtcaggagttcgagaccagcctggccaacatggcgaaaccccgactctactaaaaatacagaaattagctgggcatggtggcaggcccctgtaatcccacctactcaggaggctgaggcaggataatctcttgaacccaggaggcggaggttgttgcagtgagccaataccacaccactgcattccagcctggatgacagagcgagactctgtctcaaaaaaaaagaaaaagaaaaaaacggagctggcattttagtaaatagccgggccataaacttgacaaataactgtctcacgtgcccagtggtggcaagcgctgtggagcaaatacatagcaggagagggggatctgaaatgttggggacaggaatgacattttagggagggggcagtgaaggcttccctgagcaggtgacattcgaagtgaggcctgaagggaggaaggactggagggagggagccttgaggatatttgaagaagggttggtccagaccagggaaacaacaaatgcagagaccctgaggtgggagcttgccaggcatgtttagggaatatggaggacacatgtaggctggagggaagagtagaagaagttcctgggttctaggagcagaatgtttgagattactggggctggaggtggtttggcactgtgacagttgacagccataatcatggcaatcaacatagccgagtgattgagcctcactgtgctggcattttcctcacctgctctccgtgcatccccactacaaccgtgtgagctgtaccttgatattaactgcattcacagaggaggaggctgcaacccctcccaacccccaccccaggcatgctcttcctaaagctcaccctgatcggggttaggcccgcatctgccctcacctgatgggaaggccagcaggacagggactgaacctatttggtttgattaaagtgcttggcccctcatgagcacccagtccacttttgttggaacatttcctgaggcttagaaaatgggagaggctgcctgaggtcatacggcggggcaccgggcagcagtagggctaggcctggaacccgggactgggccgggtgggggtgcgctaggttctgtgttcttactcttcactatggaagtcagccagccaggggtgagtgtgtgggaggtgggggcgagtattccggatcatcagaacagcatgtgtgcagggcaggtggcagagaatgggcctctgtgtgtagggagctgtgagtagttggaccagagcagcatggggctgagggaatggtgacaggtgcagcagggaggcggccacagcctgatttcgcaggccccaagtgtctggcccagaggttgagccctggtcctgcaggacccaggagccgttctgtcctgttctgggctgagtttcccagcagcagcccacctcatgccagatgtcagggtttgtgaagggcctggccagcttggcaggccagagggtgaggcgggtgtccagcttcccaggaggtcccagctgaaatctggccatgtgtgtgctacttctcaggtgccccaggcttcatgggtgcagcctcacggtccttgatccacctgtaccccacccaggccaactgtgggtgccccctgccctggggattacagaggctcttggcacagggggaagggaaaggtggagggtgtcaggagtactgggtgagagtcctggcctgtactcccaaagctgaacccaggggttcagtcccccagatgggctttctgttttttgctccttttgtctctgtttctcatctttgtttctttcggtttttttgtttgtttgtttttgagacaaggttttgctctgttacctaggctggagtgtgatggagcgattgcagctcactgcaacccaaaacttctgagctcaaatgatcctcccgcctcagcctccaaagtgccgagattgcaggtgtgagccaccacgcccagctaatttttatttttatttttgtagaggcaggatctagttatgttgcccaggctggtctccaactcctgacctcaagtgatcctcctacctttgcctcctaaagtgctgggattacaggcatgagccgcggcactcagcctgtttctcatcttcccatggctctgattccttatttgtctctcatctcttatttgtccctctgtccatctctcatccccaccttctctctacctcttgtcccccatctccctgaggctgagggtctgctggaggccaggggtcctcagaagtccagcttatttggggcttgtctctgcctggaaccagaagagttgggcccaccaagcctttgactgcagcctgtcccctggaaagcaggatgacaaaggcatgaccccaggcctcccctgctcttcctagctccccatacctaccacacgaggccagccccttcctcaggccaataagtggctactgcttttggctcagatcttcaaaccctgccaagccaggggctggctctgatagcaggacctcagcactacagccagaagacagcccgggcctcctgtgtcctgagcagccaccctccctgtccccacctcagtctgctcatctgttaagtgatacagtttaggccagttgaccccacaggccctgccaggctgatgatccatgctgtgactttggtgaccctcaagtgactttggacaagtgccttgacctctccaggcccagcttctctctctgaaggatgggacagagggtccctagctccaggaggtggtgaggggtgctgagatcatcttagccctgtatctggcatgttccagttgctcagtgaaagctacttaagttgtgtatgttttctccccctggagacggagtcttgctctgtcgcccaggctggagtacagtggcacgatctcggctcactgcaacctctgcctcctgggttcacgtgattctcctgcctcagcctcccgagtagctaggagattacaggtgcaccctcccgagtagctaggagattacaggtgcacaccaccacacctggctaatttttgtattcttagagacggggtttcaccatgttcatgttagccaggctgatctcgaactcttgacctcgtgatctgcccacctcggcctcccaaaatgctgggattacaggcatgagccaccacacccggccattgtgtatgcattctttatggatgagaattaaggtatttggtctgcagaaggatccagcttccagaggccaaagagagatggagtttagatggaaaaatattcagatttggaggacgttctccatggcgtggggagagagctggatcatctttggtttcaggactgccccgaacgtccaggctaacatgtctcattgatgtgtctgggatccaaacccagctctgaacctcagtttccttgtctaggaaatgagatcactcagttccttccttgacgggctgatacttgaatgagagactgtgcctcagactcaaaaactcagatgactgcaggggcccagccagggctgccaccaaatctggccacccagtgtgagaccccagggaagggagaggaccagggtgaacctggagctcatatcccattggatgggggcagctattacttattgtttaggcctagggtggccagagccctgtgttgttgagggaagcaggaaactaggaattttacgtgattttcaaatttagctcactttttaaaactgagggcaaaacatgtcagagggagtcagtttgcaacctctccgatatgggccacaccccagcgcatgacaggcttcagtgtgtgtcagccattgttagggtaactgttatttgatcatgttgcagttggctctgcccacttcctgtccctgcatgctgtggggcaggcaggcaggtcgatcgggaaggttcacttgttctttccttctcaccgcctctccgtgtcctcccaccccacccactcggggttttctgcttctgagccctgggccttggctacaaacaagaatcagaaaggggaaggccttgctgggcctgatcatggtgatccccaggctggggcggctgctggggcagtgggggtgctgcgtggctcaagagaaacagccctcgcctgagaattggggaaccaggagatctaggcccctgtgacctctgctatgtgacctctgttgaggtccttctccttcctgggcttcacggtcttcttctgcacaaaaggagccaagggcatgtaaccctggtgtgttccgttccccttctgagccttggtcttttcaaggggcaggggagggcagctgtcctggttctgggtcagggtaggtcaggagcagcttgctgttgtgtgacctggagaaggccttctctctccctgagcctcagtttccctatcatgacaaatggggaacccagtacttccttcccaaggtatgtcggtgagcggcacccagagacaaagccatggagttgtccgttaggattgtggttgggaatttgctcattctgcaagcatttactgagtgtcagggccctggtgagtgagccagacatggttctgggcctcccgacttcacatttaggtagggaaagacaaacgtagacaaggccacaggcatgagcaatgggcctcgtgtggggggagtgtggggtcagaggaggcatcatggatggcttcctggagatggaggtttccagggtgagatctgcaggaacagtgtcaggtgcacagggagtgaagagaacagcatgcacagagtcctaaaaagaagagagggtggacacaggaggagcccttctcacctgctctggccctgaccccttcacagggacctgcctggccccgctgcttaagtgggggcctgggctcctgacccagaatgtcgtcaaggtgatagggtgatggggaatagagggagggaccaggggcagcaggaacaggatagagcggggcgagagcgggatcttaggagccagacctctggccatggaattctggtctctgctgactagttgggtggctttgggctacttccttgaccactctgatggtcagttttctcatctgcaaaaggacatcacttcagcaggcgcctgatatgtagtaactgctcagtatattttaaacacccatgataaaattgttgtcattaaaggtcttctgtgccttatggagcagctgcctggggcataccctagtcacatgttctatgtcacccacatggtgtttttatttcctttaatttttttttttcttgagatggagttttactcttgtcacccaggctggagtgcaatggcgtgatctcagctcactgtaacctccgccttctgggttcaagcgattctcctgcctctcccgagtagctgggactacaggcgcctgccaccacacctggctagtttttgtatttttagtagagatggggtttcgccacgttggcctggctggtctcaaactcctgacctcaggtgatctgcctgcctcggcctcccaaggtgctgggattacaggtgtgaaacactgcacccggccttatttcctttaatgtttaaaattttttgttttgttttgtttattaatagagacagggttttgctatgttgcccaagctggtcttgaactcctgggctcaagcaatcctctcgcctcagcttcccagggtgcttggattacaggagtaagccactgggcctaaccccttttatttattttatttttatttttattttagtttttattttttgagatggagtctcactctgccgcccaggctggagtgcagtggtgccatctcagctccctgcaatctccacctcccagattcaagtgattctcttgcctcagcctcccgaatagctgggattacaggtacccgccacatgcctggctaatttttgtatttttagtagagatggggtttcaccatgttggccaggctggtctcgaactcctagtctcaaatgatcctcctgcctcggcctcccaaagtgctgggattacaggtgtgagccaccatgcatggcccccttttatttttttattttaatttacaattaaaagaaaacaatgtaatatgctagtactttaaaaggaaataagggaaaagccggtcttaactatatagatttttttttaacataaatggctgctatttggcactttgctttttgcacttacctagatgtcctggacatctctccacgtccacttatagacaactgcccaggtgttttcctggctgcagagatgatgtggactgaattcatttggccaatccccaggcaatggccacttaggttatttcccaagttttgacaccacaaacaaagctgcagcgagtgaatcagcttgtctgggctcgtgtgtctgtgaaaactatgtggcaacactgaaacagattgcacacccaaagcctgacttctggctcctcttgggaatcagaagctctgcctccctggcccacacgccatacttttagaagccccactgccccagagccctatttgtccatgaattcctgactcattgtctggagcctgcttgagggaggctgggcagggtgtgagccaccaggattaaaggttgtttgtagcctctgcctccaaatagttacctgcaaaaggggacaagtgaagccacaaagattctactttaaaaaaagaaaaagaagctcattaaagttcccttaggtgtctccagagagagcccagaggggcccaggagaccagagttctggtcctgtctgtcaaagaattggtctgtcagagaattgggccactctctgaagggccccatccttggtttaatgcatccagccctgactgtttgaccttggtgagggcctcagtgacgtcatctgtgaaatgggtacagactcctttgcgggagtctgtaagctcagcttgtggttggcaatatagatgcattaaacaaagttgaaaagctcctggccaggtgcggtggctcacacctgtaatcccagcactttgggaggccaaggtgggcggatcacaaggtcaggagttcaagaccagcctggccaatatggtgaaaccccatctctactaaaaaatataaaaattagccgggcatggtggcgggtgcctataatcccagctactcgggaggctgaggcaggagaatcgattgaacctgggaggtggaggttgcagtgagccgagatggcaccactgcactccagcctgggtgatagagtgagactctgtctcagaaaaaaaaaaaagaaaagaaaagttcccatggggccacactctgcctggccttgaccttccagcctttacctctcgcctctgctccctgcaggcaagcgcctccaggagtggtgctctgtgatcctgtgcttcagcctcatcgcccacaacctggtccatctcctgctgctggcccgctgggaggacacacccctcgtcatactcggtgttggtgagtgcccgaggcactgctgcctgcctcaacttccctaggggccagggacccaccgggtaactggcgcgtgtgtgtgtccacatgcatggatgtgtgtgcttgagtccagtatgtgccttgagtaccccacctccctattgcagtcagcagcacctccctgcagcctgtcacttgggcccaaaacctaaacatgatcctcagttcctctcttcctcttgcattgcacatccaaaccatcagcaaatgctgttaactctactttcaaactgcatgaggagtacagccatggctctgtaccttcatggtccccacgcttgtccagccaccatcctctcccgcctgggctgtttcaggagccttcttcctggtctccctgccttcacctttgccctgcaccgtccagtctccacatggctagctggatcctgctagagccccaggcagatcatgccactcccccactctcatctgcatacatctgcagctgaatagaacaccggctcctcagtgtacctgccccagcttcctctagccaccctcatgctaggtcaccctgcacctgccacgctggccccctgactgtgcgtctgtcacctgctctcagatacattcctacttcagggcttttgcatgtgccattctctgtgcctagaactctcacctacatggctcactccaggtgtctgctgagaggtcacctcctctcagcagaggaggtgtgattgccccacaaaacatagcagccccagccaggtgtggtggctcatgcctgtagtcccagcactgtgggaggccgttggggcgggggggggggggcggatgacttgaggtcaggagttcgagaccagcctggccaacgtggtgaaaccccatctctactaaaaatacaaaaattagccggccgtggtggcaggcgcctgtaggtcccagctacttgggaggctggggcaggagaatcatttgaacccaggaggcggaggttgcagtgagccaagatcacgccacagcacttcagcccaggcagcagagcgagactccgtctcaaaatagcaggcctgtcacacactatcccccttttctgttgttaacactgtgtccacagtgtctttatttgtttatcatctatctctcccaacatctctcccaactcaaatgccagctctctgagagcagagatttttgtctgtttcattcactgctgtgtccctagctcaagcctcaggcctggcacacagccggtgctcagtattttttgaattgatgaatgaataaatgagagagctgttgtttattagtacctcctggtgttttccatcggtcacttcttacgctaaggttgtcatcattttccagatgagggaactgaggctcagagaagggactagtccagagtcacacttcaaggcagagtacaacatagttgttaatacactatctccactcccaggccctggatgactcagtttccttcctctccatgcaccacccttcccctccccatccccggctccaagactgaagggggcggctgtgcccttggtcctgcctggcccttcctaagggttcaactcccacaatctcattaaaagcgttctagccacctaagccaatagtgctcaggccagctaattgagccatctgggtctggggtggggttggtatatgctggggacgggggccggaccagctggaggggagagagatgaacccatccattgctgggaagcccaggcaggagccaggcatgtcccctgcccccagggatgggagagacctgcacccccagcctctctgcctcaagccccatattcaagggcaggaatacagtctgagctttgcagcctcatctggggatggttacgagcaggcctctacaaacctgggtttaagtcccagctctaccacctcctggctctgtggccttgggccacattgcatctctcagcctcatttaccacagtgtaaatgaggctgctggcagtacctgcctcctagggctgttgtgaaggcaaaatgcaggtgtgcctaagtgctgagaaaaccagtgactaagcaggggcggggaggggacagcacctgccagaccactgatcaaggctttcacttcagcctcgctggtcagtttaatcacggatgttttgtgagcacctactatgtgccaagccccatgctgggcacttttcactctttgtgctaccctagtgaggaggttcccatcaccatctgagaggctaagtaagtcacatattggtcctcacccaggcagcagcagagtctgagattgcaaatccagacctgcctggctctcagttgaggacttccccaccagggcgtgtatagcctccagttaacattgggaggccaggctgtttcaggcctctacgggggtaaaggatgggctggatcagagcccaggtgtgtgctgtgcaggctgggagggtggatgtcccaggtaggtcactatctcccttccctggttgggatctgatcttccagccacagcccaggaaatctctggctttcgaggctgcacagcaccagcttccccatcccacacatttctctctgggctgatgagagcagacaatcccctgataatggtgtttgcacagtccctaatcgatttaaatagccaccccgatttgtgtgttaacatgcaggcagtaagggcactgtgccagcctgcagagcctgccccctacccctatctccccagagcttccactgtcccaggcaggtcccagaaatcaaggaaggcagaagcacgaaaagatgtcgagttaataaacacagacacacgtgatgcagcattgggaagcaaaatcaagctaagcgggtaggcgggaaaggcctctctgaaaagatgacgtttgcacagagacctgaaggaggtgagggaggggccgtgcagagatcttggggaggggcatccaaggcacagggaagagcaaatgcaaaggccccgaggttggcacgtgcctcgtgtgtttggggaacagagcgaagccattgtggctggaggaaattgatcaaaggaaaattgtggcagcccagcaaggcactggaagcagatgttgtggggccatgagggcctggtctggatatggggtcatgagaagccattggtgagtttcccacagggagttgacatcatctgatgctgcagggaagatggctgggggtggggacagccagggaggaggcgcctgccatggtccagccacgtgaagatggcagcccagacctaagggtggcccagacctgggtggagcggtggaggtggtgatgcgttgtcaaattctggaggagctgtgaaaggtgagctgccagaatgtgcttccaggttggctgtggaggtgagagagaattagcttgactccaaggtttctctcttgagagatggaagggatgaagctgtcattcacagagatggagagaggtcatcggcagagcaggcctgagggagatgcttgagatggccgctgttgagctaaggagaggtgttgagcaggaaactggaaatctaggtctggaggcagggagaggcagctggaaatagcaatctgggggtccggccgggcatggtggttcacacctgtaatcccagcactttgggacggtgaaaccctgtctccactaaaaatacaaaaatcagctgggcatggtggtaggcgcctataatcccagctactggggaggctgagacaggagaaattgattgaacacgggaggcagaggttgcagtgagccaagatcgccccattgcactctagcctgggcgacagagtgagacttcctctggaaaaaaaaaaaaaaaaagaaagaaatccgggggtcatctgtgtcaagatgaagctccttatctcctaggctggctgagcacccccaggggctgagtctcccgtgtttccaggctggggaggaggaagagccagcaagggaggctgggatggcgctgccagggagatggggggagaaccagggaggtcgggggagaaccagggagggcttgcaggggccaagaggagaatgtgtttccaggagtcttgggggtcgactgggaacagccaccgagtggaccagcaaggtggccagtaaagggacctttggatttagccacgtggaggtcatcagccactgtgacacgcacatcgttgtcgtgagtgagtgggtgaacaagtgaaggccgtaggagccctgagcttttgttccacgtggagaagggggaggaagtgtttgggttgtgagttggcccttaaaggagcagagtccttcgtggaccttgggagaagccttccgggcagagggcacagtgagtccagaggtcagggatgaggtcagagaagtcccaggctcgggtcgtggcccgtcctgtggctggaagtggagtctggatctgactgagctggaaggcggtagagacaggactgggacccaggaccgaaacccatggatttgccctcagtgcattcacttggctcctcagccacgccttccatctccacgccaggcctttgaggtgggcagggaggggtgaggaagtcccagctgggtgacctctggggaaatggaagcccgcacgggcccagcgactacctcaagttcccccgtgagtcagggtagcctggggtgagccgtctcccatccctctccttgtcccagtgttctgcggggaagggtggtaaccaagccgaagctgcccccagggggagccggctgccagctgccaccaccccaaagctgggacaaagaggcttctgtgtgcctgtctgccacccctgcccccattaaagcagcctcagacagcagcctggagtcactgccaccggcagaggccgcaagatcacggagccagggggagggctcctggtctcctaagatgattcctgacttctgtccaaagcagacatccctccctgctgggcagcgtgcaggcgccaggccttgaccattggacagatggcaagactgaggctcagcagagagctcacaggagctgcgttggggggatgcttgctgtgtcgtgggacccaccgggccctttacccagcagcccattttattaacttctcatagttaagggaggtaaatgtccccattctccatacctgggtgcgaagtctccctaaccctaaccctaaggttgcatcatcctgaatgactctagcgagtctctggctactcaccagcagccctgccttgcccctgccaccgtgtgaccttggggagttcttaccctcctctggaaggtcaggatggggtggggcctgttactgtggacatgaagtgagattgtccactttttgaaaaacagactttattttttagaacaagttttcaacttacagaaggatggggcagatagtacagagagtccccatatgcctggggcacgcagtttcctccattattcacatcctaaatcttacattagcggggcacatttgttacagtgtgtgccagtgttgatacattatcatgagctggagtccatggcttattcagattgccttagttcttccctaatgtccttcttctgttcctggatcccatccagggtatcacatggcctttagttgtcatgtccctttaggctcctcttgtccagttttttttgtttgtttgttttttgagacggagtctcactcttgccaggctggagtgcagtggcgcaatctcggcccactgcaacctccgcctcccaggttcaagcgattcttctgcctcagcctcccgagtagctgggactacaagcgcgcgccagcacgcccggctaatttttgcgtttttagtagagatggaatttcaccatgttggccaggatggtctcaatctccggaccttgtgatccaccctcctcggccttctaaagtgctgggattataggagtgagccaccgcgcctggctgaccttgacggttttgaggagtgctagtcaggtgtgttgtaggctgcccctctgttggtatctatctgatgtttttctcatgattagactggggttacgggttatgaggaggaagagttcagaggtgaagtgccattttcatcacatcatagcaaaagtacagactgtcaacatgacttatcactgtgatgactctgatcccatgactaaggtagcagatgtcagagttctccacagttaagttaccctcggctgggtgcggtggctcacgcctgtcatcccagcactttgggaggcactttaggatttgtgagtgggtcgcttgagctcaggagttcactggtcagcctggacaacatggtgagacccttgtctctacagctgtagtcccagctcctcacgagtctgaggtgggagggtcgcttgagcatgggagctcaaggctgtagtgagctgtgaatggcaccgccacactccagtctgggccacagtgggagagtctgtctcaaaaaaacaacaaacaaaagttactctgctccccccaccccgcctttttttttgagatgaagtcttcctctgtcacccaggctggagtgcagtgactcgatcacgactcactggagcctcaacctcccaggctcaagcagtcctcccacttcagcctccagtaggaccacaggcacatgccaccacacctggcgaattttgttattttatatacagacagggtttcgctgtgttgcccaggctggtactgaactccaggactcaagcaatcctcccaccgtggcctcccaaagtgctgggattataggcgtgagccaatgcgcccagccttcctcccctctttttttttttttttttttttgaggcagagtctcactctgtcacccaggctggagtgtagtggcacgatcttggctcactgctacctcttcctcccaggttcaagtgattctcctgcctcagcctcccaagtagttgagattacaggcctacaccaccatggtcggctaatttttgaatttttagtagagatggggtttcaccatgttggccatgctggtctcgaactcctgaactcaagtgatccatctgccttggcctctcaaagtgctgggattccaggtgtgagccctgcgcccagcctccgtcctcattcatactgtgctctttttggaaggaggtctctgtacacagcccacacttaaggaatgggaagttatgctcccagtgatgcacttcttaacacttcacaaagccccagtacacagtgttaacccaactactgttttctcatctgtataatttttattatgctcatctttctcattatctgtgaggattaagtgtttagaatgattaaggagataagattcggcctaagcgaggccttgatgccattcagggattaaaggagataaaacatttaaggcgttggcacggggcctggtagttataagtgctcaataaatatcaggtttttttttttaaaaaaagtagttgacatcttaacccaaagtaaatgagggtggatgtctacacatagacttgtacaccaatattcactgcagcagattcaaaacagccccagactggaaacagcccaaatggccaaccatggccaggtggataaatgcatcattgtacatccagatggtgggatactcagccctaaaaatggtgaaccactgctgatccgcacgactgcatggcccacgctagaaacattacactagtaaaagaagccaggctccaaagagcacctaccatctgaatccgtttaaataaagttctagaataggcaaaatcagtctctgctgataggaggcagctctatggttgcatggaacagggtcagaagggagcttagtgggacaggggagccagctgtggggctggaaatgcttttttttttttttttttttttttgagatggagttttgctcttgttgcccaggctggagtgcaatggcgtgatctcagctcaccgcaacctctaccttctgggttcaagtgattctcctgcctcagcctcccgagtaactgggattacaggcatgcgccaccacacctggctaattttgtatttttagtagagacagggtttctccatgttggtcaggctggtctcaaactcctgacctcaggcgatccgcttgcctcggcctcccagagtgctagaattacagatgtgagccaccgtgcccggcctggaaatgctttctatcaggggtcagcacactatggcctgaggaccaaaaacacttgtaaacaggtattctgggaatgctgttgatgtctgccttcacactacagctgcagagttgaggagctgcagtggagactgccttggcctgcaaagcccaaaatatttactgtccatttatgtatttatttatttctgagatggagtctccatctgttgcccaggctggagtgcagtggcacgagctctgctcactgtagcctctgcctcccaggttcaagcgattctcctgcctcagcctcctgagtagctgggactacaggtccgcaccaccacacccagctgatttttttgtgtttttagtaaagacggggtttcaccatgttggccagactggtatcaaactcctgacctccagtggtccgcctgcctcagcctcccaaagtgctgggattacaggtgtgagccaccgtgcccggcctgcctgaccctttaaagaaagtttgccaacctcttatattctgtgtaggtatagaatctctatcttaacctgggggttggtcagacaggtgtgtctacgcataaaaaggctgtgagctgtgtaaggcctatggcctttactgtttgtaggttatattcaattataacataaaatgagccaaggtttagagaggggaaggggcttgtccccatctcatcaggagcccagaactcggggaacaaggaacctggactctgaatcccttgcgaggccccacccttatgacatccagccacttctcctctgtagctatttctttcatgaaggcagcattcattcattcatttatttttgagacagagttttgctcttgttgcctagcctggagtgcaatggcgaaatctcggctcaccgcaacctccgcctcccaggttcaagccattctcctgcctcagcctcctgagtagctgggattacaggtgcccaccaccatccctggctaattttttgtgttttttgtagagacaaggtttcaccatgttggccaggctagtcttaaactcctgacctcaggtgatctgcccaccttggcatcccaaagtgctgggaggagtgcaatggtgccagctctgcagctctgcactgtgctccagcccagcctgaaggcagcatttagagatgtcattagtccgagctatggggacaggacctcgagatacctcagttgacctcattaagcaagtaaagatgctgaggcctagagtaggcacagtgtcacacagcaatatggtagcaagagctgaggcccccaacacttgatctagttctgtcatagctcttggccacatggccttttgtccctgctggtagacagaggcagtgcatacacagcatcccaaagtatgcagtaggagctctaataatgccatggacctgctgcagtgcagtttaaggacacaaaagggtgctggttttggaggcaggtcgacaggcctcttcccatcccacagctgccatttccaggccacttgactgggaggcagtggttcaacttctccaggcctctttcttcatccaagaagggatgacaaatgaggccatctcaggggatgacaagtgccatgaaagaaatgaagcagggagatgtgagcgagagcaactgcccggaaggatggctttagccagaagggttggctgaccttcgctctgagcaagaaggccgaggaggagccagcacaggggatctggagtgggggtggggtgctgtgtagaggaacagaaaatccagaagcccttctggggcttccacctccctcgccttctacatccccgcccctgcccctggcctgggtccaccctccccatcacaaatgggcaagactgcccagaccagagcagggccactgggtgcacaggctctggggccttgctgagtcccaacccctttacctcagcccagccactgtgcagtgacacccttcagcctgtccttaggcgtctgtgtgccaggaggtgtagctgccacctgtccccacctgcccttccgcccttatccccaggaacttgcaggtgcctgcatgaagctgtgctgcccccacccccaccacccctcccgtgcttggcacctgtgatggataccacagggcctctggaaagtcggcatccagtggctgcccctcaccccaggcctggacgtcaggattgcacattcacagtgacttgcgtgcttacttttgtcccttcaaccacaagtctcactcacccaggaggcatccaggggcttttctgcagtctccacagtacccccaagaccctggtcccctgtcaccaaggggttgagggcaccagcagaactcagaatcttggacaaccagttgacacagacaaaccgagtctgggaaggggtttgtctgaagccccatgagccagggggccacacgtgtcatcactcacagctgcctttgtcctctgctggactttacagcgtttccccatagacatgtgttcagtgtctgacatgtttctgtccctagagcttatcacacaggaggcctttgtggagtgtggcttagttgattgactcaatgacagcaacagtaatatggcctgagggcttactatgtgccaaacactgcacttagtagtgctctactgagttctgaataggtgccaagagctgggatgcagccacaagccagactaaagccctggccatggtggagccaacctccttgttgggggagaaaataaaccagcacaagagcagtcagaggtgccgagtgcttggagaacaatatacataggagatcggaaatgctggaagatgaggtggttgcaattttccatcaggtgtccagggaggacatttgagtaaacatctgaagaggtgagggagtgagctgtgttgcatcttaggaaagaatgttccaggcagagggaacagcaaatgcaaagacccagaggcatgcaagggaaaggagataaagtaggcctgggctgcagcgaaagaggagagtgatgggaggcagcaggggtggaagcctcagtttccacctctataaagtgggaataaaaaagctaccaacttaaaacaaatggtgagaattcatcaagatctagcctgtaaagcatttgtgcttggcattgagaaagtgctcgtaaatgttagcatcattcccttttatttatttattttttcaagacagagtctcactctgttggccaggcaggagtgcagtgcatgatctcgactcactgcaaccaccatctcccgggctcaagccattctcctgcttcagcctcctgagtagctgggattataggtgtgtgccaccacacccggctaatttttgtatttttagtacagatggggtttcaccatgttggccaggctagtctcgaactcctgacctcaggtgatccgcccacctcggcctcccaaagtgctgggattacaggtgtgagccacggcgcccagtcgcatcattcccattttacaagaggaaactgggcacagagaggctaaataacatgtgcagcgtcacagctagtgagtgccagcactggaatttgagtccaaatctactgaaccctcaagtgagtgaatggtgttggagtctgagggaaccctgctcaagttccgaacagattgagaacagaaacaaggaaaaggctgctggagaccaaatgatcatgtttattgctgataaaagctggaggggtgggggtggagcagcgaggcttctatctgcaggtaaggtactttctttttttttttttgagacggagtctcactctgtcacccacgctggagtgcagtggtgtgatctcagctcactgcaacctccgcctcccgagttcaagtgattctcctgcctcagcttcccgagtagttgagactacaggcgcatgccaccacacctggctaatttttgtgattttagtagagacggggtttcaccatattggtcaggctattctcgaactcctgacctcaagtgatccgcctgcctcagcctcccaaagtgctgggattacaaagcatgagccaccgcacctggccgaggtactttctttctaacaccaaacccagaaggacattgctgcagttccaggcagcactggtgcagagcaggctttccttatatggggcagagagaagggcacagcctgctcctaatagggaaaggttgagctgatctgagcatgcccagtttatgctctccagactctccaagcacatgagtcttggcatctccccgagcacagcaagtaacaggcaggaggagtgttaagcctgaggctccatcttcagggaagaaaacatcccaactagagaagaagggacaccttcccctcctaacaaatgaatgagcgggcaagtgagtaaatgaatgagtgattctgattgggggggtgcagggatgtcccttcactcaccctcttgtccacagttgcaggggctctcattgctgacttcttgtctggcctggtacactggggtgctgacacatggggctctgtggagctgcccattgtggggaaggtgagtatgttgacctaaccatgtcctcaagaaggaggttgggctgtatggccttgagtgagtcccctttcttctctaagactgtttccctatctgaaagatgggaaccatcattgcagcctgtccctcacccctgtgctgcaagactagaacaggagtcccttgggattttggaagcaaaagcatcaggcttgggatggtccaagagtttagatatgtgcctgcctcatcagaacccctgaatttgggggtgtcttgcttttccattgtctcccctgctgcttcttgctgttttaactgcattttatcctgtattagtcacttttttggttttgacagaaaatctaaactggcttaggcaaacaagggtactgattcatgtaactgaagatttcagggttagagccaaattaaggaatggctgcatccagtaggaccgacagaccacattcttcaggcccagtcttcttccatctctatctctactttcccctcataaggtggccagtgtgctttctcaccgcccagagatccatccttccagctcccaagaaaagagaactgtccttctccttccaggagaacagcatttctccttccctgtagtttccgccaactgaagtcccacggctcactcccattggcccagattgggtcacgtgctgggccctcaggcagtcactggctagagggaggagatgctatgattggccaggcctggtcacgtgttctttctcagcccggggcgaggtcagccttgtcagaagagcctggactaaggaggggaggctgttaccccagcaggtgcagggggtccagagggtcccaccttttacttagagggacctcctcaactgccttggggtggggaggaagggcggaggttgtctccaagcccccttacagcacaggtagggagactgaggcccagaggcagacagtgccaacccaaagcccttccagggtcatttcggctcatctccccaaaggctggatggggtctgtgtctggcagtgggccaggtgggaatgttcaagcatcccgggtggaggaaacttaggatcaaaggcgggaggtgagcccagggtgaatgtgtttagggggctgtggagagcagctgaccaccttaggctgactgctggggctgtgtccccctcaactccaggctttcatccgacccttccgggagcaccacattgacccgacagctatcacacggcacgacttcatcgagaccaacggggacaactgcctggtgacactgctgccgctgctaaacatggcctacaagttccgcacccacagccctggtgagacacccagctagtggtgggctgggagggggccttgggggcagaggccgacccccaggagccttctggggcttatgtgtttggctccttatggtattttaaaagagttttcattcattgtcttcatgtaaaatcaggaaacctgacatgaagatggaggtttccagcttctcttgcacaatctgctctggcccccctgggtccatgttcccacctggcctcactgggtgggagctgagctgcagccactgcctttgacaggacgcgtctttccagtttaccaccgtccccactattccttgcttccctgcacccaacccaccttgttcatttgtgttacctgcctggcagggcttctggggttttgctaccgtggcctagtggaaaatgtctaggctgtgaaaacagggcctgcctatttttagagggactggtcccaaagtaagtgatttcaccactctgagcctcagttgccttatctgtcaggtggaggtaggttggggcccggtcctgttccagcaccttaacacccatttgttcttcaggcagcctccggtgggtagaggtggtgaggacgtgtagtgtagtgggtgctatggcaccctgcccatccccttccctgggggtgcacccagcccctgcttctgtgagtggtggctgctgacagctcccagcttctccagggatggaggggaggtcccacctgtctccttgggataaggctggagccagtgactgaaacgcctccgacgctagtccctttgcctctgagtgggtctaattctaaagagccgttaacacctcagagctccttgcaggaacagactgagacaggacgccacccaccccatctttgctctgctcttcccctgccgtgtcttgcttccctccctcccttcgaggttttttcctgaagaggctcccttgataaatcacatgcacaagaacctgtttcaggctccgcttctagggaacctgggtgaaggcatcattcccattttcctgatggggaaattaagcttcttagaggcagagtcaccgatccagcccatactgccaagaaatgtcggcagagatcggaacccagctccagctgactccggtctacattcccagccattgccatgcttatgccattatcctattacaccattacgcctgcttcctgagcaggaggaaagcctgaagcccagggcagcacctgagcttgcctgcggccctgcagggggtggaagagaatcctgggtgcttgcccagctcaggagccgcccaggagcaggtggtgagggccatttggggtgggttccccgtcccgagtgacagctgtgccggccccccctctccccaacctgcagaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggtgcggccaccagtggcgtggaatgggctttccccaccccagccactgcaccatcttcgaggtcaggagggcagagatcacagcaggaggtcacacagtccttgccctctgggaacagtctctcaggtcatgcatttattgagcacctactgtgtgccaggcactattctaggtgctgaggacacagtaaatgagactgacaaagccctctccctcgacttcatggcgttgtgattccagccacccatcatcccgtatttattgagcacctaccacatgccatggtgctttgggcgtaggctcctgcagcaaacaaaatagcatgaatcagctgggcgcagtggctcatgcctggaatcccagcactttgggaggccaaggcgggtggatcacttgaggtcaggagttggagaccagcctggccaacatggtgaaaccccatctctactaaaaatacgaaaaaaaattaattgggcttggtggcaggcacctgtaatcccagctactcgggaggctgaggcaagagaattgcttgaacctgggaggtggaggttgcagtaagctgaaatcgcaccactgcactccagcctaggtgacagagactgtctcaaaaaaaaaaaaaaaaaaaaaaaaaccagaaaacacggatccttgcccttgtggcactcaccatctagtgagggagctggaacgaatgaataaaatgtgtagcgtggctaatggtgctaactgctatggaggaaaataaagcaggggtgggagaaggaagtgggggctttgcctcttaaatcgggtggtcagggaaggtgacacttgaacaaagaccccgaggagctgagggacaaagccgtgcagacctctgtgggaggcactctaggcagcaggaacagtaggtgcgaaggccctgaggctggcctttgcttgcttggtgtgtttccggaatggcaaagaggctcctgactggagttgaggcagagcaatggaagagggagaagcgggcagagcagtggaagagggaggagagaagggggcagagcaactgaagagggaggagagaagtgtgggagggccctgaagatagatgagcacagattagagcaaaggtaacaggaagcagcaggccagaggcaggaacatgcccagtgcagtggaggaagggaaaggaggcccacgtgccatgctcagttagcagccagtgcgaaagaggtgaggtgaactgggagtttctctggagccagctgggctgctttcaaggttaagtgtatcaggtgctgtcaagtctaactcaggcctaactctcagcttctccacatgtgcctttaggcaactcacaaacctccctggggaccgcttttctccttacaaaatagggctgcagccgcctccttcatatatcaccttcttagggccatagtgggaatggcaaatgcggtgtttggcatatagtaggtacttgataaattacagctactatttttttttaggtctttctggaaacagaactgagaaccacaaaaaaacattctttttcatgtcctcaatttgtgctccttggaaggcaggtggagggattagaattcaggctatttaggagatgggttaactacttaggcagggctgagttccaatcctggtttggccacctgctaattgggaaactcttctctaagcctcagtgtgctcatgtggaaaatgggactgatattagtatctacctcatggtgagctggaaggctgtaagattgtgagcaatatttattcagcacctactctgcgcctggctgtattctaagcactgaggatcagcagtgaaagaacatggtgttttgcattttggggataacgttccagttggggattggggggtgaacaaacacagaacaggaaaatagagaattaacgaagatggttacaggttatcataaaggctataaagaaatgaaagagggtggcctgtcatggtggttcacgcgtgtaatcccagcactttaggaagccaaggcgagaggattgcttgagcccaggagttcaagaccagcctatataagacaagaccccatctgcattaaaaaaattgtaaatagagccaggctcagtggttcatgcctgtaatcccagcagtttgggaggccgaggcgggtggatcacgaggtcaagagatcgagaccatcctggccaacatggtgaaacctagtctctactaaaaatacaaaacttagctgggcatggtggtgtgcacctgtagtctcagctactcggaggctgaggcaggagagtcacttgaacccgggaggtggaggttgcagtgagccgagatcgccccactgcactccagcctggccacagagtgagactctgtctcaaataaatagatagataaatgatagatagatagatagatagatagatagatagatagatagatagataaagggtaatgtgagaaacctggggtgctgcttaagtggatgatcagggaaggcttcctggcagaggtagcatttgagctgagtgataaggccaccacagtgcctggtatatagtaagtgctcaaatataagtaagtgcctggtatatagtaagaaagtagaggaatatgggggttggaggcctgagtggccccaggcccattggtgggaggcccccacttccagttccttggccggtccctgtgtcctatcctgtactgactcactcctcattgggcccctccagcccagtgaaggtcagctctcttccaatgtccccttgactactctctcccattcaaactcccgctgccatttctactgcaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacaggacagaaccacagcggaaaagcagggtcggtgctgctttggcagggtggtcatgaagggcctctgagctgagacctgggggaggagaggaggtcagacacgaaagaagtgagggaagaggcctcttgatgggacagcaagtacacaggccctgaggcaagaacaagcttggggccacgcacagtggctcacgccagtaatcccagcactttgggaggctgaggcggacagatcacctgaggtcaggagttctagaccagcctggccaacatggtgaaaccctgtctctactaaaatttacaaaaattagccaggcgtggtggcagacgactttatcccagctacttgggaggcagaggcaggagaatcatttgaacccgggaggtgaaggttgcagtgagccgagatcgagccattgcactcaaacctgggggataagagcgagacttcgcttagaaaaaaaaaaaaagaacaagcttgggattttaagagatggtgaggcagccactgtggctggactagagtgagctaaggaaaaatggaagacaaggttgggaaaacatggatttggtatacagagactcataggctgaggtgagtggggacctgctggtcattttatttatttgtatttattactatgtttttagagacagggtcatgctctgtcacccaggctaaagtgcagaggtgaggtgtaatagctcacagcaaccttgaactcctggacacaaacgatcctcatgagtggctgggactagcacatgccgccacacctggcttggctatttttttttttttttaaagaaatggggtctcactatgttgtccaggttggtcttgaactcctggcctcaagtgatccgccttggccttccaaagtgctggaattttaggtatgagccactgcaccgggtcaggacattatagaccaattagtaacttgtttatttgttgaataagtaattataaggcatctcctatgaactaggtactgcgattctgtagtgaacgctacagacatagtcaatagctagtctaggctagatagtttctgcaatattagccagaaaaaagaaagcctgttggggacagggaaatgcctaaaggactccagagcagtcacagataatgacatttctgagtagctgggattacaggcgcccaccaccatgcccggctaattttcgtatttttagtagagatggggtttcagcatgttggccaggctggtctccaactcttgacttcaggtgatccacccaccttggcctcccaaagtgttgggattacaggcatgagccactgcgtccagccatgacatttattttttaaaacgtgacccataatgccattttcctttgccaactagacttttgatttgtgactatgcctgaggggaccacacaaggaagggtgttagaattcgacaactcataaatgacagaaatttaaagtaaacagctaaaataatcgtattagctcataaaacggaaaagtctacaggtgttctgaattaaggtttggcaggacccaggggctcacatgattcatcaaaacgtggtctctctaagctctgtttttctctttgagttgagacttactagaccagctcagcaatctcagtggaaagtgcattcccagtagttgcagtggaagtcccagggcaggctctcattggtctggactgggtcacgtgcccatccctgaaccaatcacattggccagtggggtgaaatgctctggttgcccagggctgaaaaatgtccatctggatttgcagggttgtgatcacctcttcctaaggcattactacaaaaagaagtcaatggtggatgggacaggcagctaaattctttagaggccataggagtagcctcaccactgtggtgttggtttccaggccccaccaatctgtgtcagttcccctggagccgacagaaaaaaaaccctcagcctgagtccagagaggtaaagtgactcccccaaggtcccacaggtagtaagggtagagcagccctcagactcagaccatttcacttctgaattctgggggctggaaaaaaatccttctcaaaaccagaaggtgcgctgcattgggtctgagagtgttggggccacttgtgagatcagggacttgcaaacaagtgcctatgagggccagacaggggaaaatgctacttaatattactgagcacttaactttgcaccagactgtgcagagagctctggcatgggtcctgtcaagcagtccctgcagctctgagaagtgagtactctttgcaccatttgcagatggggaaactgaggcacagaggtcatgtaatatgcccaaggtcacacagctggtaggtggcagaatcaggatttgagccagcgtctgacccaaagcccctgtgctttaacgctcccattgtggagagggaggtgagacaggtggcacgtgagaaatgtgtccactatgaggcaactgcagcatgcctgagaaagggccgctgacgctggggactgggatgacctggagacatcaggcctaaagggcagctgctactcacagcagctggttaaacaggagccagaaatctaaactttaaaaatgctggctccgtgtttaaaacgtactgtgggcaaaacaaaatgagtgcataggccaactgcctgcagcctccctcccagctgctgtgggatggcttggtttcaggtaggcatgtgctgctgtctggtggtggcacagggtagtggcatgcagggcaaacatggatttccagctcaaccgggggagctgtagtgaacttgcatacccctgtgtgctcactgttctttagaaggggcctgggcacatacctttgggcgcctgcccccaactgaaactccatcaccccgccttttttttttcctggagacggggtcttgctctgtcacccaggctggaacacagtggcatgatctgcgctcactgcagactcaacctcccaggctcaagcaatcctcccatttcagcctcttgaatagcgggaacgacagacatgtgccaccacccccagctagtttctttttgtattttttgtagagatggggtttcaccatgttgcccaggctggtctcgaacgcctgagctcaagcgatcggcccacctcagccttcctaagtgttgggattacaggcatgaaccaccgcgcccagccaaccctcctttgataaaccaaaaatatttttcaagctacccacatatatatatgggtatatatatatatatagcaatatatatattgctatataagcaataggtaatgcttgcataggtaaagaataagaatcacgccgggtacagtggctcatatcaaataatataaacagggctagagtatggataagctgaccctggacagtgggccaaatccagccacttgcttttctatagctcagaagcttttgtgggttgtttgtttgtttgtttgtttgtttgttttttagagacagggtcttgctctgttgtccaggctggagtgcagtggcacaatcacagctcactgtaacctcagactcctgggctcaagtgatcctcccacctcagcctcctgagtagctaggactacagatggacaccaccacatccagctaatttttttttttttttagagatggggtctcgctatgttgcccagggtagtctcaaactcctggcctcaagtgatcctcccacctcaacctcctgaagcactgggattacaggtgtgagccaccatgtcagccacgagcattttttaaatggctgggggagggggaacaatatttcctaacacagaaaattcaaattccagtttgtaaagctgaattggcacacagccatgcccctcatttacatattgtccgaggctgcttttgcactgcagtggcagaattgagtcgttgcatcggagaccacgtggtccacacagcctaaaatatttacgatctggccctttacagagaaaagttaccaacctctccctagtctagaatgaagggtaaattgctccccattcatgttccctcaggtactcagttcccctccttagaggccatcattttgacaagacacttgcaatgccttatgtaggcagaggggtatgtctgccccactccttttcacacaatatgtaggatattatgcacacagttctgcaccttgccttttttcacttaatatattttggagatagtgttatcattaatgttcacaaaccattattattttttacagctgcatagtgttccaccttcaggatggaatggacttgacttttttttttttttttttttgagacaaagtcttgctctattacctgggctagagtgcagtggtgcaatcccagctcactacagcctctgcctcctgggctcaagctatcctctctcagcctcccatcccaagtagttgggactacaggtgcatgccaccatgctgagctaatttttttttattatttttagagacgggggtcttgctttgttgcccagactcgtctcaaactcctgtgctcaagcaatcctcctgcctcagactcccaaactgctgggattacaggcttgaaccacgagtgtgttttaaattttgatagtgcataccaaattgtcttccagaggccatgccggtttaagttcacaagttttcagagtccctgtttcctcacacccttgccaacacagcgtgttatcaaatgttttgttctttgccaatctgataggtggttttaatttgcattcctcttactgtatttcattgattctaagatgtcactgattctaagatgcatcctgatttcagaagttcacatgtaaaaatgtggctgggtgtggtagctcacgcctgtaatcccagcactttgggcggatcacgaggtcaggaattcaagaccagcctggccaacatagtgaaaccccgtctctaccaaaaatacaaaagaaataattagctgggtgtggtggcgggtgcctgtaatcccagctacttgggaggctgaggcaggagaattgcttgaacccaggaggcggaggttgcagtgaactgagatcgcgccactgaactccagcctgggcgacacagcgagactctgtctcaaaaaaaaaacaaaaaaaaagtaaaaacgtatagcttcaaatcactgaaatacaatatgttttgtgagattgggtatcttactgtgagtttaaaatgcatttgcatttcctcatctgttcatgtccttttcctatttttcttggaagggagggtagcattggttaagagtgtagggttcaaatcccagttctgccacttacaagcttgtgactttgggcaagttacttaaccgttctgtgtctcagtttcctcacctgcaaaatgggaataataatggtacctacctcataggataggtgtgaagattaaatacattattatatgcaaaataccatgttcctggaatatggcaaatgctcaataaatatttgctgtaactgtcatctttgagttattttttcttaatgagtttcaagggctctttatacgttaaggaaacatcctttttgtccccccacctccctgccccaaaccccagttttcattcctttttccttgaccacagaagtaacatataatacaaaattaagacattacaaaaattgtatcagaagaagccaatggaaacaacttagatgtccattgatagagtgagttaatgaagtacaccaagaccccctgcccacccatccccaccgctttttgactgtatatttcggaaactacatcagacattaaataagatgtctcagcgccatggctagacacacctcagggagccatgactccacataaatgccatagaatttcactagcaaatgcatcacacatcctgtttgtttgtttgtttgtttgtttgtttgtttttagatggagtttcgctttgttgcccaacctggagtgcaatgctgcagcaacctctgcctcccaggttcaagtgattctcctgcctcagcctcccgggtagctgggattacaggcatgagccaccatgctcggctaatttttctattttcagtagagatggggtttcaccatgttggccaggctggtctcgaattcctgacctcaggtgatccaccggccttggcctccctaagtgctgggattacaggtgtgagccaccatgcccggcctcatcacacactctgttaaccacacatcccttctcctctctgtcttctgcaagtccacagtccttcctgtcgacagtttgtcagctttactttctgcagcttatgctacaaaaactgtagcacgaggttgggggggttccttaactataaataggaaattgaaggttgtggataacattatataatttttgttttttcaccttttgaatatactttttcaaactactcatgccttttacatcccagagattccaaaccagccctagtgttttcccacttgaaaagagagttcacgaatggacattgtggatctgtcaggtctacatgcctctcaaccgaaccactgcgtcagcttcctgtatctattaggtatgctttttggtggtaggtaacaaaaacctacctttaagaacaacttaagcaacaggcacattatctcatgtcttcagatgtctgcagttgggcagccctgcaattccttcagcagctcagccacatcacccaggattctaattctaaccattacaacctcatattgtaggaaggaggaaaggggacaaaaataggctttttcttcagcttttttgtttgagacagtctcgctctgtcgctcagactggagtgcaatggcacgatcttggctcactgcaacctctgcctcccaggttcaagcgattctcgtgcctcagcctcccgggtagctggtattacaggcctgagccaccaagctcggctaatttttgtattttcagtagagacggggttttgccattgtggccagggtggtctcgaaatcttgacctcaggtgatccgcccgcctcggcctcccaaagtgttgggattacaggtgtgaaccagggcgcccaaccttctcttcagcttttatgaggggagggaaagtttccaaacacccaccttgccatgtggggccatggcgactggaatggcggtaaacatgcccaatacaccttctctctgggttccctgctaccaatattgctgctgcccaattgggtgtcctcgccctgtctcctcatggcagcacgatgcactttgtaaaaaggcaaacctgcccacatttagctcaaaacctcccaggctccacctccctcatcacgggagagccagcgggtgacacagggtaaagagaactggattccaaaactgattttactccttccttgttgtgtgaccttggaaaagccatctaactcctctaagtctcagttttctcatctcacaaatggaaatggtaacagctactttgcaaggttcattgaggattaggtaataatagcagctaatacttatattgcacttagtgccaagccctcttctaaattctctagttctattaaccattttaatcttccccaaaatccgataaaacaagactcttatcccatcagctgagtttatcagctcaagcgcagagcggtgatcaggcgcaggcgccggaaggaatcctgctctggggaccggctgtgacgtccaggaatggggcagaaactcttcgagggagcgtgtgcgcgggacgtactacaactcccatcaggcactgcgccaacgctagactacaacaaccagcatgcctcgggctgtcccgcctaacctcttcctgcgatgagctcggcacgggaattattattgtcaattttacttgcaagaagtttcctacaagagccaaggaatccatgcgagtaaacatttacgggcaccatagataaaaggcttgtgttttaatcctcatcctctccacctgttagctctgagtctcagttttctcatctctaaaaatggggatattcacaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgatgaaggaagacttgaacctagaaaatttcactgcaaaggtgagtccaccttaggaacccaaatgcttccacttgctactgatgctttacagtgaccccaagtccagggcaagtattttctgtgctccccaaagcaaacttgtatcacgtgatacacgaaaagtcaagttgcttcacctgtagccagtgctggcactttgagagctaattatagctgaatttgatgtggttggaggaatcgaggaaggcttccctgaggggatggtgctggatctgagaactgaagagtgggaacagcacaggcaaagcccctgaagtgggagagggcatgtgttccagggggcttgcaaagggccagtgtcgccgcagaggtacagaaagtctcagaggcgcaggctgtgccaaggctatggtgaggcaagtggggtacctagggtgcagattttttttttttttttgagactgaatctctctctgttgcccaggctggaatgcaatggtgcaatctcagctcactgcaacctctgcctcccgggttcgctcgattttcctgcctcagcctcccgagtagctgggattacaggtgtgtgctaccacgccccgctaatttttgtatttttagtagagacgaggtttcaccatgttgaccaggctggtctggaactcctgacctcaggtgatctgcccacctcggcctcccaaagtgctgggattacaggtgtgagccaccatgccctgccctagggtgcagattttaaggagtcactcacctgcagcgctgtgcaagtgcggagtcaggacctgagtgaaagccccgttaaatctgaccaccccatcctcgtccctgccctgggtgcagagcctggtgcacagggtgtccaggcatcctgctttgccctggagagccctggtttccacttgtcctggtgagattataataagtccccttttaatctgatgtgtgtcctcattaggtgataattctatggtcgctcaacttgtaaagtttgtattttatccagagggaatggggagccactgaaggctttagctggagggtgttttgagcagatgttggtctatatggagaatgggccataggggagagaatggaagctgctggggtcttccaagtgggagataaaggcagcttgccctgagtggagaagtgaacggagtggagagatgcagagtaggcactgctatcagacaaaggtgatgaattggatgtgctgggtgagggcttccagcttccttgtccctctatgtttagagtcctggtccttctgccagtattttgctctgtgaccttaagccagtcccttcacctctctcagcctcagtgtctacatccatataagggcttctcagacaatttataataaaggaggagtaccttcttgggtttatttatttgcaaaaatatttcccaagggcctttgcacaagctgttccctctacctcctcattgttacggtctctgctgaaatatgaccaccttaggaggcccttcctgaccatcctctgctgctcttgtcttggtttatctctaccctatcagaattatagtttcctgtttatttacttgctgtctacgactagaatgtaagtccctgaaagcagggatttgcttcttcagagatgtctatccatccccagcgcctagcacagtgtctggtacatagtaggtgcttaatgtttgtttgtttggttgaatgaatgaatgaacgaatgaatgaatgaatgaatgaatgaattgggtagatggttagcaaatgctttccctgccaccttaatgcccctaaatcatttagctgcacccactccaagccttctctggccggggagcatcaatcctaggagccagatcatctgacctggagggtgatgattcaaaaaatttgaacctggaggttaaaattctgcctgtctctgccacttaacagctgagtttagataaatcgcttgatctctctcggctgcatttttcacattaattctgaccttgcggagatgtggtgaggatctagataggaactagacaggaaaaagccccaagcgaattcggcgcttttgtttgaagctatattttctttttctttcacaatcgcgccttcccaagcctagtcacccctgcccttctcactaagcacatcacaacctccctcgcacccgatgtgtggggacttgcaggttgctgggccctcgagcacgcagatatttcctttctctaaaagggaaggaaaagagccttccaggccacgggtcgtgcaggtctccggggcgggcgtcagcggcggcgtatgtgcgtgcgcgcgcgcctgcgcatcagggccgggggacgggtaaggggggggtgaagaaggggccggccttcaagcaagagcgacgcaagatggcagccaccacgggctcgggtgagcgggggcgccgggcccggccggccgagggggcatgggcttgggccgggggccggggaccctcaaagcctcctgcagcggagccagggtccccgcgccgcctctgtctgctgggctccgcggcagccaccggcgcggcctgaccgggggaggaggagcaggcggtggccggaagcacgggcggggggctgaggggcctgtgggcggcgcggcgaggccctgaggctcccccgggaggcgtgagggccctctgtgctgtctgggggagccggagtgggcgaggagcgagctccgaggcactcctgaggataccggggctggcgactcttaaggggcgatctagaggtcccctagaggaggcgccccacagcggatggaagtcccatactgggtgccaggggtgcggctgagaggggccttgggatgtctggaggggacatcagagaagcccttcaggctggatggaagaaacgggatcctgagggggtgacttgagaggatcccctatcggttgagggaacggctccggcgttagttttagagatggggttagctgaggaaatagctatgttgactagaaaggaggagccttggagcagctgcttttggggagaatgaagggggtctccgcatgataagtgagaggagggaaaaggattcagatgccagagggacctaatagcggtgatagtgaaatgaccccatcattaccagtctcctgttcgaggatacagatggattgcttcaagttaggtttcaggggacaaggtccgagtggggcagttggtggaagcctctgatattggatgagggagaacagatgaattgggagccccgaggatgtctctttgggagtggggattcaactgagggaagcccctgaaatgagggagtggaaaaggtcgggttccggagatgtttcctgtaaaggagaaaagtctcctctttttgaattgagtgagggaagcatatcctagaagtgtctcttctgtggagacgctcactctcatcgactcctttaataattgggacagatatgtgggttcagctcagaagttccccactggctgatgggagtagggaggtgaatagatgaaatgggaactcttgggtgaggctgcaccctcaggtgcctggcagtgaagttggccaaggaggttctctcagatggggtgaaaatgggttacctctctgatggaggaagcaaacagggccacagtgttccccactgtggggctgcagggacaccagcctgagtacagcaatcattggcatatttaaggccacagcagcggcagtgttgggaaggaattggtgatccatgggaaatagggtgaggggaattctttataaatgttgctactctgcggtctcaaggagccatacttgcctgatggttggggtgggaataaaagaaattgaatgtgggggatctgactgaagtgacccaccacaagctgctgccttttgagtttaaaacagtggggtcttcttgcagaatagcggagaccatgaatccttttactcgattttggtttcagctggaacagtgctgagtcaattcatttaccatgacgctgccccaggcactcccagaagagagattctgagtcaggccagactgctgggtaaaacttctcaccagaataacactcctaccgggtcgtaataaacgaaggggcccagtgtgctggtggtagccagcaataaggtgctgttgcagctcagccctgcttgcagtcactcggttggctacctacaatctgggttaacagctgcccggttctaacttctccagaccctgacagttaaaaagtgagtgcttcataaatggctatggtgatcagataaaatgtcagctgctgtctagtggaatacaagagcacttggcatggtttagataacataggacaggctttgaggtgccctaaaatggacttcccaaaattcttttgtctgtttattcaacagatatttactgagggcctattatgtcccatcgtggatagcaaacaaaatggacatagtctgtatccttcgggagcttccattcaagtcagggagagaaggctgttaaggagtaaataagacaatttcagatagcagtaagtgctatggaggaaattgtgtgatgtgatagtgtctggagaggtggtcaggaaagtgacatttcagctgagtcaaataatggaaagagctaaccctacagtgtcacaggcaggagagagagtgggctgttagtgcaaaggccctgtggtgggactctgcttggcatgttgaaataacaggataaaaggccttcatgtgcaagcaaggcttgttaaggagatgagttggagagacatggctttggatttgagatggtatgaggggaagccatcaaacaagtgtctggtatgaagtaggcattcagtaaatatttgttgaatgaatgaataagagtcttaaaaagaggagtatgataagatctgaccttcgtccctaggcagtgaaaagagtgcagggtgctaagagtaaagcagaccttacttggggtaaactaaaatgagtgtacaggcctctctgctttctaaccctgagaagtcttccaggtgtggtcagggcccagaggccttccttagtcaggtttagagtgaggctcttgattaatctgtgcctccggttgccaggaaacagctgtgaagcctttgagttcctgtaagggctgaacttagttttttatggtcactgctttcagcatttggctacaccaccttcccacttcctttggttctgcaatgtgtgatatctacatatgtcttagagggtggaactgtgaaaagcccaccacagatcctcagaatccccatgttatgacgggtgacttcctcctgccttggccaggattgcagcacatcaaatagtggcccttggttgccaggcccttcctctcactcagcagcccacgagcttccctgacatttaatcagaaaatgagtgccagaggggtaagccctggtggggcatgattttaaatttgcatacatcggagtggcctcatatgcacattcagcttataaaaacttaaccatgtgggcagcagagattagtcttcccttccattcaagagtcttccccagagagagctggaaatggatgaaaactcacagtcccttagttcttctcagttcctgtatgtctcactgtgtgagcatcttatgccaattgtaattaagtgccttttgtacaacatgggccctacattcaaagaacagcttcatattgtgctcagccaaagaaatagcagcctgctccagtgatggaggggaaactggctttgttgggctagtgcaagctttttttttttttttttttttgagacggagtttcgccctgtcacctggctggagtgcagtggcgtgatcttggctcactgtaacctctgcttcccaggttcaagcgattctcctgcctcagcctcctgagtagctgggatcacaggcacgcgccaccacgcctggctaatttttgtatttttagtagagacagggtttcaccatgttggtcagtctggtctcaaactcctgacctcatgatccgcccgtctcagcctcccaaagtcctgggattacaggcgtaagtcaccgtgccgggctgcaagctattattttcttaagggattaccaaggttaattttgatgatcatgattttcccccttcatgttaactgaaaaccactctatttcccccaccacattctcttttctcttcatatctctatccctcccacctccccacaaattgtagctctgcagtaatttggtaaaagtagaatacaaaatatgaagtcaggaatcctctgcttaattttgaaggggcacagtgaagttcagagcagcacatttggcaaagtaaatgtttgaatactattactgttgtattgtggatagtgctttagagtgtcccatagacttcgacttacctgtgatgttgtctcatctaactctccacagcctggtcaccagccaggggcagtatccacccacattactgagggaggagccaaaagccaagggagactggtgatgctcggactagagcccaggcatttttaactcctgttccctcaccagcctgcaggaaatggaaaaggcatggatttagggatatgttcttcctaagtcttggagtgtttaatcttggagagagaaagggctttagtaagaagtgtctactgctacccgtttcaggaaccctttttatagcatctctggccactgtttgtcctcttctgggttatgtgctgtccaaggagagtgaggtccttttttcaggaagctcttgcttatattttatactgaatgactcacacctcttgggcttggagccccatcatggcaggtacaaagtagtacctcatccttatttacatgcaagccatcagacttctttttaagttgcactcttgggtttactaagtgctagacactgtattaactacattatctcacttgtcacaacagcccattgaggcaggtatcgattgtgaaggtgaggaaacaggccaggagaggagtgactagcctgaggtgcagagcctgggtgctctgggatggtgttgcttcaggacacgtgctcttggccggatgatcgttcttccagcccccatttcttattctctgaggtaggcctcgcaagcatcttcagccattggcatgtctgttatttctgccttggctgattagcttattcatgggtagatggcagtgacctctcaagtagtagtctttcctcatcttcacatccaccctgtcacaagtccagtaggtgtaaccccaaactaaatgccaaatcctcctttctgtctccactcttgtcatcctaatctaaccagaaccgtctttctcttgcctggaagatggaaaaagcctcttgctttcagtcttgccctttccattttctatacaggagacagaatgatctttcacagacgtaaaatagaaactgccactccccttcagcaagcccttcccactgctcttattacagaataacccatcccttttccatggcccacaaggccctgccgccttgacttcatgtggtgtcacacacctctgatcttgctctgtccccagatcttcatgggcctgactgctgttcttcaggtcgcagctacccagaaaggccgtccctgagcactccattcaatagttttttagtcattgtcacagcttcttgttttgttctgtttctctaaagcacttaaccttacctgaagtgttgtttcgttgcatattttctatgccttttcactagggcaagattctatctcaacttctgttgtgtccctagcaccagcacagttctggacaaaatagtaggtactcagtaaatatttgtgaatgttgcagtgagttaattcagaatctctttgatgtagccaaatggatacatttgacaatttgtggagaaacaatgtatccgatagggcagaagcaaaagtggctattcagcctttcaaaaaactgaaactcttatccttatttggtggtatttatagaggtacttgatcgtagaattaaccatcctccccttctccagttgtcctgactcatttcccacatcttgtttccccctttgtcaaagaaaatctgatgcttggtcttggtcactgaccctagcagcagaacacagggtcttgcattctgtcactagctgttgtcacgtggctggactgtaaagaatgacagcttgctactaattctttccctagaattcccctagagcaatggatctcaaactagtatacctcagagtcctggagggcttgtcagattcttaggcccaaccttggagtttcagattcaggaattctgggctgaagacctgagaatgtacatttctagcgagtttgcgatgaggtctggggactaacttggagaaccattgctctagagaaggagaagaacagatctcctgggcaggctaactagacagccagactacacttgggcggttgctcagaaataaaagttacttgcttatggctctatgtccagttttcagggacgttgaatcccagtgcatcaccttccatacctcctcattttctgaagtgggagcagcatcagattcctagctcagttcactgtcttccctgaatgggcaaccaaaccatttttaactagcagctttcttttcaggagaaacctctgaggttctaccttttttttgtttttttttttttgttgttgttgttgttgttgttgttgttgtttttggttttgaaacagagtttcactcttgttgcccaggctggagtgcaatggtgctatcttggctcaccgcaacctctgcctcccaggttcaggttcaagtgattctcctgcctcagccccctgagtagctcgattacaggcatgcgccaccacgcccagctaattttgtatttttagtggagacggggtttctccatcttggtcaggctgttctcgaactcccgacctcaggtgatccacccatctctgcctcccaaagtgttgggattacaggtgtgagccaccacgcccagccagctctaccattttaattcaagacctaggccagggttttccaagattgacatgctgtggtagctgctgcttggtggccatgattttcccaaaagatgttttaaacgacttcagaatcctttttgtaccacaaatatattaatatgttgctgtgtttcagattactgcattaaatgttttactgtggcatggtgtaaagctctatcaaatattcatgctttttcaacctggttgccatattttctttgtaatatcctgcaactgctgtcttttcagtttatatttagctaagagaataaccggctgacttttgatactgacacaggtccaggaaaaagccttctggaaagaataattctgaaataataggaacaaatattttcttcaaaaagtcttggattactgtgatattttagcaccttgatgaagtttttttttttagcattttcataattcactttttaatagtcatagtctatttgattatacttatcattagctatagattttcctagtgtacttcctagctattatagagcctgtagttctcttggttttgcaagattataagagtccttttgtttgtttgttttttgtttttttgtttttttgttttttgttttttttgacgagtctctgttgcccaggctgggctgcagtggcatgatcgcagctcactgaaacctccacctcccgggttcaagtgattgtcatgcctcagcctcccaattagctgggattgcaggcatgtgccaccacaactggctaatttttgtatttttaatagagatggggtttcaccatgttggccaggctggtctcaaactcccacctcggcctctcaaagtactgagattacaggtgtgagccactgcgcctggcctgtaagagtccatttttatgtcttccatattgtcacttgatgctgtttctccagctgcctttttggtgtcagattcacacagaaatattgggaatcctaaaattttatgttgattcaattgattaaagtgctagaggaccaaaacatatgttagagtattcttgggttttctcatctgttgtgcttctgttctttggcatatgtacgtttaattttttaatatattcactaaaatgttttgtttaatgtaccgtgattttgaatttaaactctatttaggataggatgagcttttcgcttgtcactgatacatcctgaagtctgcaggatctctgaattccaaccatatttggacttatgtccctggagtagaccctgaattctataactagggtgtgattaggccatttggaattaaatgctcttttgttttgtagaaaatattgatgtaactttgtatgcagtttttaaatggtttgaaatattagtaacttgctttcatacatactttatgaaacaaagttcattttatagtgaagaattctttgacttatgtgatttgggtgagaaaccagttttcccttattttaaaaaaaatggtaagttttcctaaaattctcatttattaaaaataaaactaggctgggtgtggtggctcatgcctgtaatcccagcactttgggaggctgaggcaggtggatcacttgaggtcaggagtctgagaccagcctggccaacatggtgaaaccccgtctctactaaacatatgagaattaactgggtgtcgtggcgcgtgcctgtaatcccagccactcgggaggctgaggcgggagaatcgcttgaacccagaaggtgaaggttgaagtgagccgagattgcgccattgcactccagcctgggtgacagagtgagactccatctctaaaaataaattagaaatggttaccaaattttacttatctcaaaataaaaaaccttaggtatgttaattttttttttttttttttttttgtgccagagtctcactgtcgccctggctggagtgcagtggcgcaatctcggctcactgcaggctccgccccctggggttcacgccattctcttgcctcagcctcccgagtagctgggactacaggcagccgccaccttgcccggctaattttttgtatttttagtagagacggggtttcaccgtgttagccaggatggtctcgatctcctgacctcgtgatccgcccgcctcggcctcccaaagtgctgggattataggcgtgagccaccgcgcccagccaggtatgttaattatatggcaacagtgtccaatattttggacccagtagattagagtttacaataggaaatactgccttttttttttttttttttgagacggagtctggccctattgccaggctggagtgccgtggcgcgatctcggctcactgtaacctccgcctcccaggttcaagcaattctcctgcctcagcctctcgagtagctgggattacaggcgcgcaccaccacgcccagctaatttttgtatttttagtagagacagggtttcaccacgttggccaggatgatctcgatctcctgacctcgtgatccgcctgtctcagccttccaaagtgctgggattacaggcatgagccaccacgcctggcctgatactgccatttcttcaaccagcaaacatttattgatattgagtatcattatatgccagacagcataccagattctggggaggcgggattgaatgagtcacagctctgacttgagaaacttagagagtgagtcagacaataaaaaaggaagaaaatcaaatgtaaagaaaacataccacacatgcctgtgtggaagtaaaggtgtttgggaccgggaccggggtctctgagagggcctctcctgactgcctggcttctaattaagctttatagcttttaaaattattatagtcaggccgggtgcaatggctgatgcctgtaatcccagcaccttgggaggccaaggcgggcagatcacttgaggccaggagtttgagaccagcctagccaacatggtaaaaccccgtctctactgaaaatgcaaaaattagctgggcgtggtggcaggcgcctgtaatcccagctacttgggaggctgaggtgcaagaaacacttcaacacaggagaccgaggttgcagcgagccaaaatcacaccactgcactccagcctgggtaacagagtgggactctgcctcttaatatataactgttcttaggctttaaaattcatactaagcccctttaataatccttataatgttagactcccagataatggtgctgtgaatgtttctctcttgtattttcaaaaataaaccagattagaattttgtgacattgagcgttgttcattctgaaatactgttcctagctaatacctagtcattcattaattctttcaataagtatttgggtgcttactctagagggcaaaacaccctgacacattggagattcagcagtgaacaaaacagatgaagttttactctcatggagcttatgttcagatgggagacagacaagaaacaaccaataaagtgaaaatgaatatatttacaatgtcgagtggcaatgagtactatgaagaaaaataaggcaagataagggaatggacagttagacccttggttgaggacaagggaaccagtcagccattcacagctctgggacagagaattccagggtgagggactcacaaatacaaaggcgggatgtaaggatgcctcttcagaaacttagagaaggactggtgtagctggaggaggatgggggagcaaggcagagtggcacaaaatgatgttggcgaagcaggtggggctctctcggccaggtgacaagtttgggtggattgcgggtgcaacgggaggccaagagtaggcttctggtaggagagcgagggcacctagtttacctttaagaggatcgtcggccgagcacggtggctcacacctgtaatcccagcactttgggaagctgaggccagcggatcacctgaggtcgggagttcgagaccagcctgaccaacatggaaaaaccccgtctctactaaaaatacaaaattagtcaggcatggtagcgcatgtgggaggtaatatatccattactctgacctgtcttttaaaaacagagtggtagaccaggtatccttacgttagtgattctgggtcatgacaccccaagatcattggtgagagtacaatgaacatgcaaggatgcatacaaggttgcttttgtgtttgttttttagaaaatgaggtttgcagaccttttgtccttttttactcgatttaaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgcaggcctataagaagtttgatgccacatgttcggtcacagtgtttgctctaggcaaatgcttctggctctatatcctgagacgttagcagtagcacaccccaaagctgatcattacctaggagacttggatatgccttatctcttgccctactctgagccttttgcagctccccccgattacccttaaggtaaagtccagtagtaacatggctccaacctcttcatcttttgtcagatttcagagaaggctgtgagccctcaaaggctaagtaacagtgtcctctggtaggttctgtttctcgtgctttgatatggttttatttcattgccctttgtgtatatcttgtttccacactgacaccttagactgtgttagggagaccccagtttttattttgttcatagcccctagattgtctagcaaagtgctggataggtattggataactatcacactgagagaaggtgtgtgtgcctatatgttactgataatttatgtatagggaaattttgacaagcaggtaaaaagccaagcaaactttttttcactgtggtcctgaaatgtgtaaaatttttttttttttttttttttttttgcttataaatgtgaagtccagttctatacacattaaacatcatgagaattgcttgaacctaggaggcagaggttgcagtgagctgagattgcgtcattgcactccagcctagggaacaagagcgagactttgtctcaaaaaaaaaaaaaaaaaaagttctttgaggtcttcaatgattttgagagtataaagcattcttgagagcaaaaggtttgagaactgctgttcaaatgaaataaatgtttattgtaattgttcagtagatagcagttatagatatttatatgtatatcacaactcctagttgcaatacagatagatattggccagtccaaagtttttcatttattaaactgtttctggtgctggctttacaacttgagtcagaatcaaattgtcctataatgcaggaacaaaagaaagctgacctttccctctgtgggtctcaattcctgttccaaatcctagcctaaaataaattgacctgacttatttctttggttcagttgtatgtgtgggctttgcacacttgtttttaagtaatcgaatatctaatccagtagaaatgtatgttggaagtataggattaattactaatatattttgccctacttcacaagtaaaaattaaatatcagaaaattataacttgaattcactgttttgaaactaatagcaacaagcttgtgatatttgaatgttaggatttcctaatcagatctgattgttaggtgaaaaggtaacctttcagccatagagaagttctttgcttaagtttgcaagaggaatagtcctactataaatagtccagctgacatttaaatacctgacataagaaactaacacatttttttgtcttgccaaaaagagcaactcaaaatagaggtcacttgtgtaatacagcttccattcagtaatgaagggcttaactgtagaagctgttatactttgccatttatttgacagtcttaacacttttttttttttggagatggagtcttgctctgtcactcaggctggagtgcagtggtgcaacctcagctcactgcaacctctgcctccagggttcaagcaatttttctgcctcagcctcccgagtagctgggactacaggtgcacaccaccacgcccggctaattttgtatttttagtagagacggagtttcatcatactagccaggctgatcttgaactcttgacctcatgatccacccacctcggcctcccaaagtgctggaattacaggtgtgagccaccgcgccccgtcttttttttttttttttttttaaatagagacaggttcttgctctgttgcccaggctggaatgcagtggcgtgatcatagctcactacagacttgaccttccaggctcaagcagtcctcctgtctcagcctcctaagcagctgggactacaggtgtgcaccaccacacccagctaatttatttattattttttgtttatttttggtttttgagacagggtctcactctgtcgcccaggctggagtgcagtggtgcagtctcgcctcactgcaacctccgccttcctggctcaagtgaccctcccctctcagcctcctgagtaactaggactacaggtgggcaccaccatgcccagctaattcttgtatttttttgtagacatgagatttctccatgttgcccaggctgatctcgaactcctggcctcagacgattgtcttggcctctcaaagtgctgggattacaggtgtgagctgccatacccagctgaccaagttttagtaacattaaaatcattgtccattaaaagttagtcacttaaggaatgccgttaagtgagattcctactcagagaagaacccttgatccttattgagatgaagtgctggacaaccaaagccctaaagaagctgagggagcttggcttatggattcctaggggaaggagccttctggacagcaggaatgacagtcgcacaggccctgggtaggtccttgcgtgggggtgcagttgaaatggttcctaattggttttttgttatgcaaataacatgggattgttgtaaaaaaatcaggaaatagagaaagtagggggaatcatccataattcttttacccagagataacagctgttaacatcttgttctgtatccttaccaactctataaagctccttaagatgtcacttatcatctatatgagtttgctagtgctgtcataacaaaataccatagactgggtggggcttaaacaacaaatttctcacagctctagagaccagaagcccaagatcaaggtgtcagcaggttttgtcacattctgaggtactgggagttaggacttaagtatataaatttgaggggaacacagttcagcccagcccatagcacgatctgtgaacaagtacctcagtcatcagccttcctatcaatatgattcttttgatgttcatttttattagtgcaggcttgtaaattaaccagtagtaatgtagtgacttttcccccgctagcctaattaggattattaaagatttagattgaaccctttctgaacaatagttgtgttgtctggctttttgcctataatgtcaccactatctttcagttttatgtttgctacaggagacttaatccagtatagctgaataatccagttggctgctgtgcagatgaaaatgccagtgttttccaaacaagcagttcaagtatgcttgcaggttttgctgtttcctttcaaataccatatgtagtactatttaatatttttcttgtaatcaactgactcttttgcttacatttattttaaaggaaacttttaccattattataaatgggaagttagtatattacttaccctaaataagttattcttaaacataaatacgtgactgtaaaacgaagtgttcaatcacataccaccgaaagtcctctaacataccactaccaactctgtccttcagttgcttggaccaaaaacctgggagctgtagttgactcttgtctctcacacctcacaggcaacctgatagcaaatctccacagctcagacctctgaaatgcctagaattacgccactcctcactactttcctgctatcaccctggtccaaacgggtattatcttttgctaggattattgcagtagcctcctagctgcttctgcccttgctcccttcactctcatcctcacacagcagtctgagggatcctattaaaaacaagacagatcatgtcactcagtaacagttggcatccttaatctcctcttgctctctcatcttcctcacttggtttgagctaaattggcctccttgctgtcctttgacaccctaagcagcctctattttagggcctttgcacttgtttgctctgtctcaaagactttctcctcagctatccataaatcatgccctctcaccttctttaggtctttagttatgacacctgattgcaataacacttttcctttatccctccatttaaaagtatagcccctcccgtattactccctcctccggaacaccaggatctgtcatactgtataatttacatattcatttttgtccattatatgtcttctactagaatgtaagctgcaggcatttttgttttattcactgcttgttcttcagtgcttagaaaagtccccgatgtatactaagtactcaaatatttattccaattgaattaatggcgtgtgtcctacactttgggaaatacatatactggcaacacctcccacaatctggggtccctccagtgagcctctcttcacagtcacatggttagtcctgtttgtctctgagagtctggccaattgagagctcagcattcaaggcagagaacttgaaacttgactggatcctgagttttttccagagaaaatagtgcatatgccagggaaaatggaggaaggagagacagtcaggattggttgggagtgcaaccctaggagagatgatttgttccccaagcacagaaggaaagtccatctctctctcctcccatagccccctcccttgtctggccccagtacctaggttctgttctggaagacacctagaaatggctcaagcctcagcctgaacccggtactgtggcttgaacctgtgaggtgttttcatgcgttgctttcaagagctacttgccaggctttgggatttttggaaaacaattgagaaccagctattcccttttagcttttttgtaagttaaaagagaaactatcacttaaataattgaaaaacaatagaatattttatccttggtgccttcagttgactcttagttgattaagaggataccatttttatttcccatatccatggtgactattcctcctaaaggttgtttgagagtcatgccaacaaataagcgtagtcttagcctcttgtcttccaaggtacttttgttagcacctgatattgatggttttcatctcatactagttgaccccaattcatagacatttagacatgtaagccccttaggaggtttgtccaaggggtaggggtggggtatctttctaagtttggttatctagccctagtcacttcacctgtcagagaaccatgtgccccttccctctggttgtgctggttgatactgatagctttataagtagcaagtttgaggtgtgataactttccgtgatttttttgcatgttagcatcttgattcccagggagagataatgagcagctagctctaggcttacaagttcccctggagttgctggtatcttgaatttctttccatttattttaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagagtaagcgtcgagctacggctataaatgtcaatgtcttaaattcactgtgcctccttttaaaaaatattagccttatcacggaaaaaaagctcaccaatggtatattttctgaaatgtggctattcttttttgaccagtttcagtttatatatttgaaccccctctgatgctgtttaacccctctaaatggtaagcaaaaacctgtttagactcatagtgtgaatttatatgacaatgtagacagtgaggtgtgaagtcattgcaccatcagatgtcgttcagaacaatctctgggctaaccaaataactaggccctaggtatagccagcattcctgaagccagtctccaaattaactctggaaagccttcccagttgtggtttttcttcactgtctcccaggtctgccgtgcacctgtatcctagttccttgggccattcagcaaaggtccctggcaagcctgtcagctcctggtctattccaggcactactagacccagaggcctttgcaaagaagacgaagacaatgaggatggggaaaagtggcctctttcagaccttcctgatttgtgagagttcccagtcttcataatgccagccaaccgttttttgaggacacatagtaaaccctcaagaaatgtctcttaactctcacaagaccccattgttaggtgcaattgcattccatttcacagatgaggagacagactcagaggagtcagatctcttgcccaaagtcacatagctggtaacccccaaaccagatctgactccagagcctgtgctcttaaccactgtgctgtggtgtctcccttttgtttacattttgagttttcatctgttaccattatagaagatactaatcaagtagtaacttgatgtaggagtcaagaaattgatttccatactgtgacacacacttcagacaagcagtaagggcctctgcctgaatgtagcaagacctgtcctgtgtctgcttgtgtttaaggatgatgacaacattcattcttttgattgtgtgcaggactctgcactagcactgtgagagcagaaagacatgtagggcgtggcccgggctggaacagggacaagtgacatgttcgttaagtgttaggacactaatgctcatttcagatggtcatcaacactcatggtgaatgattggctttgccatttaatgttgcttcttaagtcattttgtgaccctatagttttgtggagttttaaaaatatatacatttgatctgtttttactcatttctttatcctttttttcctgtgaaaaccagaattttctgcgtctgctaaataccggggaaaacccaatctagaaatcctgtttctccatggagataattttctttgctgtctctgaaggtccatcatatgctgacatcttcttcactgcatgtcttctcttcctaagaatgatttcggtttcttgaggatgagaactgtgcttccctccttacttcccagaatacctagaaatgactcagaatggggtactcagtagatttgttaatcaacttactgatttacaggttctaaaatactgagaattgaaccaatgtacaacattgcgatacactaaataccactgaattgtacactttcaaaaaaacacacaaaacaatgcatcagtaaattctgctgaaaatattctgtctgcctaaaacagcttgggctaccctgaatttcagtttatctctttccaaaagaggctttggaagttgtaatgcgtagctacggtatgccaggagtcctccatgtatttgtttttggtaacagctttattgggatagaattcacccttttaaatatacagttcggtggtcttacattcagagttgtgcatccgtcactaatttcagaacgttttcatcacctcaaaaaggaacccatacccatcggtaggcaccccccattctccctcccacatcccccatttcccatctttgacaatcatcagtctactttctagctcaatgaatttgctttttctgaacatctattataaatggaattctacagtatgtggccttttgtgactggcttcctttactcagcataattttttcaaggttcaagcatattgtagcatctatcaatacttttattcttcttatggctgaataatattccattgtacagatacgccatattttgtttttccatttgttgatgaacatttgggttgtttctaccttttggctattataaataatgcttctaggaacatttatatacaggtttgtatgtggacatatattttctttttatttttttatctacacctgctggaatagatggacatagttgtttttagctacctaatttttcctcctttgaagatggacatatattatatataattatatattatataatgcattatatattatataatgcattatatattatataatgcattatatattatataatgcatatgttatatattatatatactgtatatttatataacatatatgatatgtaatatatattacatataattatatataagatatataattataatatataatatatttttatttaaataaaagcaaatcctccaagcctatatatattatatatataacatacataatatattttatatatatatattttattattattattattattatttttttttttttttttttttttttgagttggagtctcgctctgtctcccaggctggagtgcagtggcgcaatctcggctcactgcaacctccacctcccggattcaagcaattctctgcctcagcctcccgagtagctgggattacaggtacccgccaccacgcccagctaattttgtatttttagtagagacggggtttcaccatcttagccaggctggtcttgaactcctgacctcatgatctacccacctcggcctcccaaagtgctggaattacaggtgtgagccatcgcgccctgccggagatacatttttgaattcccctgggtgtatacctaggagtggaattgctggatcatatggtaactgtgtttaacatttggaggaaatgccaaactgtttcccaaagtggctgcaccattttacattcctactagcaatgcccgaaagttcccatttctccacattctcaccaacacttgttattgtcttttcacccttgtagtttttattatcctggttccccaaggtcagaaactaagtcataaaaggaactatctgtgtgtagatgcttcctgtgaccaatctttcatgattagcacatgagctatttgctgtgtaactcgaatatccacataattattaaagcatctaaatagagcacttgagtaactcatctccctattaggtttttgttattgttttactcaaaagaacattttccatcaaaatttcaaaggtctataccatgtgatccaggaattcttctaggaatttactttccaatttctcttgaatgtattgcccaaaggcagtgtacaaaattatttcatgcagcattgtcagtagtagcaaaatattggaaacaacatcattgtctttgagtataccatattatgtcctgtttagctgttgaacaatgagacagatttatgtgtgctgaaatggaatgatctccatgatattgtgaaaaagtaaattataaaacaggagacagagtatgctgccagttggagtggggggccttgggtgcagaggaagagctcatgcatacactgcttctgtgtgcttagaatacctctggaggaatgggaaagaagctgctgacagtggttgtcttcttcagaagggagctggctggctagggctggagtggaaaggaaacttactttttaccatatacccttctgtactctttgaatgttttagtcatatgtgtgtgctgtttgaatagtgcccccaccttttttgtttgtttgtttatttaaagaaaagcaaatcctccaaacctaaaaacaaagcttctgagccaactgctccttgcacaattctggcaaatgtctagctgtccacagcgttagacatggaatatttctactttgaccacagaagtactaacaatagtcaagttatatagagcagagtttctcagacgtggcatgtagggctggttcttttctttgtcatgagagtgctaggtatgtgcgttgtaggctgtttagcagcatccctggcctctactcactagaagccagcagtacccccgtctccattgcagcaaccataaatgtgtctaggcaacgcttgatcctcccttccccttcccagcagaggggcaaaaatggccctcatcgaggagcactgttgagcctctggggttctccaaaatagtgttttttctgtttttttgagatggagtcttattctgttgcccagggtggagtgcagtggcgtgatttcagctcacggcagtctctgtctcccgggttcaagcgattctcctgcctcagcctccctagtcgctggggttataggcacataccaccacacccggctaatttttatatttttagtagagacaggtttttgccgtgttggccaggctggtctcagactcctgacctcaggtgatccgcccaccttggtctctcaaagtgctgggattacaggcatgagcccaccacacccggccaagtgttttatgtgtggattagagcctggatgtgtgtttataccctggagtactggtacccatgcttcagaggaactgaacataattacaggggtgtaggaagtaaaagaaaagtgatcctttctctgattcattatgctcaccatcgaatgaaacttaagttggtgtgtggtgtggttctacccacttttgctgtgggtatgcaaacgtaaatatatatctttttaagaaaaatgggatcttcctatgcataatgttttacaacttaattttttttcacctaatagatggtggacatctttctatatcagtgcatattgactgatctcttttttaaaagctttgaggcggggcgtggtaactcacgcctgtaattccagcactttgggaggccaaggcgggcagatcacctgaggtcaggagttcaagaccagcctggccaatatggcgaaacccggtcgctactaaaaaagtataaaaattagctgggcgcggtggcagatgcctgactcaggaggctgaggcaggagaatcacttgaacctgggaggtagaggttgcagtaagccgagatcgcgccactgcttgcaacaagagcgagactccatctcaaaaaaaaaaaaaaaaaagccttaagttatatgactgattaatgaatatgaatatattcttgtaaaaatttttaatgacaaaagcccaggtgtggtgattcacgcctgtaatcccagcgctttgggaggccgaggcaggtgaatcacttgaggtcaggagtcgagaccagcctggccaacatgttgaaaccccatctctactaaaaatacaaaaattagctgggcgtagtgatgcacgcctgtagtcccagctactcaagaggctgaggagggagaatcgcttgaacccaggaggcagaggtttcagtgggccaagatcataccactggactccaacctgggtgacagagtgagactcttgtctcaaaaaaaattttttttccaacaatacagagtatatagaataagaggttaacttagtcccgctttaactctgtgtcagtcaggaaaagagaaatcataccagctaatttttttcccagctttattgagatgtaattgataaataaaagctgtatatatccaaggtatacagtgtgatgatttgatatacattgtgtaatgattaccacaaccaaattaatcaacgcatccatcaccacgtgtagctaccttgtgtgtctgtggtaaggacacttaagatctactcttttaccaaatttcaagtaaacaatccagtattattaactgtagtcaccatgctttacattagattcccagaacttactcataactgaaagtttgtgccctttgaccagtatctccccttacaccctggtccctgtcaaccactgttctgttctctgcttctgtgagttctacttttagattccatgtataattgagatcatacactttttgtctttctgtgtctggctgatttcacttagcataatgtccttcaggctcatctatgttgtcatgactagcaagatttctttttttttttttttttgagacagagtctcgcactgttgcccaggctggagtgcagtggcgccatctcggctcactgcagcccccgcctcccaggttcaagcaattctccgactggcaggatttcttatttatggctgaataatatttcattgtgtgatatatgccatattttctctaggacatttaagttgtttccatatattggctattgtgaataactgcaatgagtgtggaagtgcagatgatctctttgagatactgatttaatttcctttggattgatacccaatactaggcaacagagataatttaatataggaagttgatcaaatagatgttggactaaaaaatcaaagaaggcacaatatgagaacacagagatactgctgcagaaacagtaaccaccctctgggtttgggaggccagcagaggaagcttgggctgtcagaacctggcacttggggaaaaggtgccccctctgctgctgctggcacctgcggggcaggggcaagcctggttgggggagtgcaaaagacactgaagcccagaaccagctcttgctgccgaggtaaggggctcatactggggtgatacctaaaggaacagcaagcaaatgtgaagggtcaaatgcctcctactttttattttctattaggatcatgtggttaatttgaccattcagtccttaagaatatttgagtgccacccaaatattctacaacctaactagagaagtgaaaacttactattgcctagagatgggccccgtgctcactcagaaagataccatgaatggtgggaagagggagagtctctgtacaaaggataattgtgtctcgtcgctgtgcagagaggtgcctgctgctgctggctaggaaactccaagcccacttctctccactctgctttggatgctggggctgggactctgcacactacacttttcctttgtcagctggcttcctctgaaggttccaccagtcagggacacaagagagagcctgaaaggcatggggaagggaaaagggatttgctgtatccagtttgcctgtttgttctgtctgtaccaccctggtaacagcccttcatcctggcatcagcagtgtgtttcaacctccagctttctggggacattcacaaaaccagcctcatcacatcccgccaagccccctccttggaggttctagcagcagccaggcagcaccccttcctcagagttctgagttcaactcttcagacctcttccttagcctccaaccctggtaaactcaaccctggtaaactccagcttatccccccctcccttaagagtttccatcctgcttcatttcgttattacatctgtgttagcttagattccctttgaacattttcagtccactgacgcctgtttaagcaatgtcttatattaaattctgttataaaacctagtgtggagtcttttttcctgatttatccctaactgccatatccccactcttctccccaacagttactgtgatctgcattctaacatagcatgtacccacattgtacattaaacgtaatttgtatataactatgtaagattggaactgaatagcaggtgactggttgacctaatgtttcctttttgtatgtttagattttgtaattttccttgcatatttttgtaattaatacctttttccttttctcatatctcatacttttttttttttttttgagatagggtctcattctgtcacccaggctgaagttcagtgacacaatcacagctcactgtagccttgacctcctgggatcaagtaatcctcctgcctcagcctccgaagtagccaagaccacaggcgcaccaccacacctggctaatttttttttactttttgtagagacagggtctcactttgttgcccaggctggtcttgaactcctgggctcacgcagtcctcctgtcttggcctcccaaagtgctgagattacaggcgtgggccaccgtgcctagcctagctcatacatttttaaaacaaattttattttctaatacttacaggcttatagaaaagttgcaaaggtagtacttcctgtgctaccttttccctgttgctagcatcttatgttattatggtacatttgtcacaaccaataaaccaacgttgatacattattattagctaaagtccatactttattcaggtgttcttagtttttacttatatctgttttttgttccagaatcccatccaagataccacattacacttagtcatcatatctctggctcctcgtggcaatgacatttctcaggtttttcttgtttttgatgcccttggctgttttgaggagtactggtcaggtattttgtagactgtctctctattggaatttgtctttttttttttttttttttaatgattagactggggttatctcatatgtatgcatttggcccaggaaaaatttataatctccaggctctgggcctgtagtgcctaatggacaaagtagcctgtgtgcacacaaatatatccagaattggaagaaagtgtatgtctgcttttataggctatacatatcctacaatgtatcgtctatacctggtgccatgttttgccagtctttcgtatgtgtgtgtgtgcccaaggagtgtccctcggcctttgagaaggctacgaagtctccgggttatatgaatatgccatgttcatatagtcccttgcaaggagacatgtagattgtagttatttttgctattgcagacagtgcttcacattttgtgcacaagtttgcgtctctctgaaggaaattgctaggaaggggcctgctggtctgagcatgcccatttcacatgttgatgagcactgccaaacggctccacaaagcatgagccatatcaacaaagtggaaagtgtttgtttcatgatcaaataatgaatcttaagagcagtatttctcacagacgcagaatgttccagcaattctccttcaggcacatttcctttgctgaaacctttttagcaggtccctggagcactcatgaacaaaataaaaaaaccagaaaccctgtaaccctggtttctattaaagtctagcttggggctttttttttttttttttgacaaagtgtcgcaatgtcacccaggctggagtggagtggtgcagtctcggctcactgcaacttccacctcccaggtttaagcagttcacctgtctcagccccccggttagctgggactacaggcacctgccaatatgcctggctaatttttgtatttttagtagagacagggtttcatcatgttggccagatgggtctcgaactcctgacctcaggttatccacccacctcggcccccccagatgccgagattacaggcgtcatccaccgcacccagccttagcttggggttttttgttttttgttttttgtttttgagatggagtctcgcactgtcgcccaggctggagtgcagtggcgcaatctcggctcactgcaagctccacctcccgggttcgtgccattctcctgcctcagcctcacaagtagctgggactataggcgcccacaaccacacccggctaatgttttgtatttttagtagagacagggtttcaccgtgttagccaggatggtctcgatctactgaccttgtgatccgcctgtctcggcttcccgaagtgctgggattacaggcgtgagccagctcacccggccttaggttggggcttttaaatgacccttcaggtgtgtgtctgtgatgacttgaggcttttttttttactgtcttccagtgaaattaccagatgaatatcagtggtgagaaatttgattccttaaaatgtaaggaatttcattcttgaattgtgtgacaaaaccagggagcatgatttttgctccattcaggatctattcagtcaacactgagtatatagttgttgatggagactatgataggttctgaggatggatctgttatattctccataaatctgtatgtgagtcatgcctttgtttgcttcctacttgttctgtttactgggttttttttttctttgaggaaacaccttaattgcaatgaggtgtttattttataatataaaagtgtgaagagaaacattcaacaaacatttgagtaccaattcagttgagggcccctgtcaaggcccccaccctcctttttctgtgtttagtgagggtgtctgatgcataactgagcctcagttgggaggggctgaggggatcgggaacacttccaaggggaagcagctggggtgagagccccaaggtggagagaacttggcaaggttgaagaggaatggtgggcaggggagggagaagagtaaaagaagaggcagttagggctgcccgggtcagtctgggaactttggcttcctcttcaggtcactaggagccatcagagggttaagccagcagagacagcttcctgtttttaagacgttggtctggctgctgtgccgggagcaagagagaaagagacttgggggagttcagaagaggtgacggtggtggaggaaagtggatggatatggggtctctttcagaggtagaacagtggggtctctttcagaggtagaacagtgggaccttctgaccactggcaggtagagggtaagggagaggggaattgggttgcctgctagtttttgctttagctaactgggtagatgctgatgtcattcactgaggaggaagagggcaggttgagggtaggtagaaattcacagttttggtttggttgtagtttgggatccctgtggacaagaaaagtttccatgggtatattatgaatgccttctgaatcaagggtttaaatcacatcctctgatttattctccccaaagaccactagatgccgctgtttacacgggagcaattatgcagtacaagactcctttcctgaggagagggcacggatgccggagagggtactgatgccggagaaggcactgatgcctgacaggggaacccacagagaggggagcccctgcctttgagggggttactctttactgggagacatcacccttcagtgtggtcttcagacacatgtgatagcagtgtgacttcatatgggatagaaagctagggactaggtagtgtttgagctgggtcttcagggttgcaaggcatttcaggtgggggcaggacgctccaagcagaaggaacagccgggcaacagagcgcatctccctgcttatggggtagatggtacagtgaagaggttattggcatagggggttggacttttcagtgtttctcaacaaaggcacagttagccttttaaagaaggacggtttttggctgggtacggtggctcatgcctgtaatcccagcactttgggaggccgaagagggcagatcagctgaggtcaggagttcgagaccagcctgaccaacatggagaaaccctgtctctactaaaaatacaaaattacccggccatggtggcacatgcctgtaatcccagctactcaggagacaggagagtcacttgaacccgggaggcggaggttgcggtgagccgagatcgcaccattgcactccagcctgggcaacaagagcaaaactctgtctcaaaaaaaaaaaaaaaaaaaaaagactgcttttccctgtgctgcctcacccattgaatgccagtaatctctcaggtcagactaccaaaaaaaaaaaaaaagactgcagggagggatggaacaccccagttgaaatcccttacccagtgcctaaccccggagtgatggagaagggggaagcagctctgagtctgcacccctccctcgtcttgtcttaattttgaggttctctaaagcagtgacctgttctgtgctttaataccacatagtgttatttaactgattggctgatgatcctggtgagtggacatttaactcggcttcctagaatagagaatgcctcttaccattccccagagaaggactgcaaagtagagaaattaacataaaaacaggtccctctgattagacttaatactaaaaacttcactggtactagcttaaatgctccatcttctttgtattcccccaaggcccggaagtcatataaactagtgtaggaactagtatagaactgctgacctaccacagaacaagtagactccatgctggaagcagatgtaccagttctacagtcagggataaatggggtttcacaagctctacctttttgaatgctttgtttgtaattgcgtgacatctccgtactctttttttccagacaatttatgaaaaccgaatatacagccttaaaatagaatgtggacctaaatacccagaagcacccccctttgtaagatttgtaacaaaaattaatatgaatggagtaaatagttctaatggagtggtaagttgttttctctgtcccacttgttccttggagttgacagttgctttgtacttaacatcaggagcttttagactgggcccaattcctaggttctttggttatttgttgataaactgtatcactgtgcataggagcacagatttgggatggggcctgtttcccaattatatctggcgatcactcatatagcacttaccctgggctagttctgtgctggtcgctttgaaatatgagctctttcctcatgccaccccagtgaggtagagatgaggaaactgaggcacagacgtggaagatctttcccagggctacacctttacccccctgggccttatttgtgaaccactggcatgtaatatttttttcctttaatggccttgcttttttatttttactaccataaatgaaaaacctgtctcagttgtcataactgggcaataatggcaacagtaaatattacaaaaacagagcaatgttaataaatcttgactccatgtgtcatttgccaaaagctttgagcctttgaggcctgctctcctgttcaaagaggagatcagcaagtgttgaagggatgctacacatgttaacgtcacgccaagccttcgtctttgagatactcagaagactggaaaattgaaaagagatgagctttgttacagtgtgtttagtgtttaatcctgaatctgagttccacctaaagtcctgagcccagagctcaacctgtgctttggggaatttattttgggaaatgctgccttaacctgagaggtgctggctctgtggcaggcccttgtcactggagcaggtgtcctggccaccctttgccttggctgtccgtactgccctgcatgcacatctgtccccctgacctgggcgcagtgaagaggacaggtcctgagcccggcagccgccagcccagcagcggccattattgaagagccaagtagggctgggttgagtctcacccaagtgtcagtaccaccgtttccttatcccagatagtaatggttcagggcacaaaagggaaaggcaggctgactggagggagggactctagcaggtaggtattccgcatgtaaggtattaggattagcagcaggttcagcttaaaaagtacatcttactccagtttgcaccttagcttaaccccggcatatagctattttgtttgagagtctgagagtaatttgcttttgtttgccttgttgtaggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatattt

SEQ ID NO: 35739 - DNA, 72598 bp, Homo sapiens; identical to SEQ ID NO: 35738

SEQ ID NO: 35740 - DNA, 37873 bp, Homo sapiens
gaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctgggtgagtgagcgcgactgccgcgcgctcctctcagggcccacctgttcgcgggccccggacactggccgcggccgcgagtgccggcagctggcactgcccgcaccgggcaggcaccgggcgggaagagagagcgccctgcggctgccagctggctccaaggccgggtccagagccgggcgggacggccgcgacgggcgcattcgggtgggggctcatcaccgcccagccggcgtggggagccgggccctcttgagatgaggcgtgcgggagggtcctgagcactttagctcgcctaggatttgagctggggtgtgtgtctgctcccagctcaagtccctccgagtgccagagaggaaggcagggagaagcggagcacccctctttgggccaaggccaaggaggactgtggtgagcagtatggcttgtgaccgggtggggtctcccaggtagtagggggcgccaggaagggagggtgcgggcacggcgagagctcagccaagagcggctctcacttttacgcaggagcggcaggggtgcctcggccgcgggtccggccccgggacccagtccctgagagtcgggggcccctccacccttgaggaggaacctcgcaggcccccgttccctcagactttgattctgagccaccgtgagagcgccgaactccctggtagctccctgaaagactagcttgtcttgatttctttcaaggacgataagtatcttcactggagagaactcagagttcgggagaggagggggcagatacctatctgcgcctctagtgggatgagtcctgtgtgtgcatttccgggagagatcaggtgccagccagctgcccgcccaggagagccttggccttgccctctcccctccccgccagcccaggcggcccacccaaggccaggcagggcgcagagcggacgttcatctggagaggccagcggggccaggagctccagagacacctgctgcaggccactcagcctctacaaatgggaaggctgagaggcgacagaagcaaggaataggaaacccttgtgtccttgtttctatagccacattccctgcacacacatgacaatacttgccgctctgcaggcaggaagagagtctctatgccactctcaagatagatggatgtagaaacaggtgcatgccaccagagtcttgtaacaaaaaagtgcacttggccaggcacagtggctcatgcctgtaatcccagcactttgggaggctgaggcaggaggatcgctttcatccaggttcaagaccagcctgggtaacatagtgagacccccatctccacaaaaaaataaaaaattagctgggcgtgttggcatgcacctgtgatcgcagctactcaggaggctgagatgagaggatggcatgagcctgggaggtcaaggctgcggtgagtcatgattgcaccactgcacttagcctgggtgacctagtgagccctgtctcaaaaaaagtagaaaagaaacaaatgcacttattccccctggagctggtcactgaggtccccacaagcctccttagggaaatcttctaagattcactcctccccagagctgaaggggtggttgaacagtttttccaatttgcagagactgacttcccccagtgcatcagtcaccataacacacaccccagtgaggacggcatataggtgtgctccttcccaacccttgacttgctttaaaaagaccctgctggccgtgggcacccctcctcctgtgttgccacccaccccagcaaccacccagctgccacgcttagcttctttctttcaccaatccctggcagcagaaaagtatgcgggaaggcagctggcctcacccacccttgaactttgggagttttcctctcccctcccaggtacagtctctcccggctggtgtgttggttagtcctcagctgtctgcctagactgcatccaggtttgggactgcagggaaacacagactgccacagtgtgcctccctacccccatctgccccatggcatatgcaggaagctgatgcgaggctcacagggccactggtatctactctgtctgtggcctgctggcctgcaatctgtccgtactgtcctcagcctgccaccccactcgtattcagaaccccctatgcctggccccagcctaggtgcagctgatgacctatgtagtctgaaacagaaatcactcacactggaaatgtttggaatgacttttgaagatcatgcagtccagctctcttattcatagtgaggcagcagaggaagagagatggggtgatttacccaggatcgcagagacagagccagtattacaattcctggggcccctactttacttctgtcctcttccatcttcatcagaggcaggaagatgggcagtagctatgttttcctgaattactgttcatttgtcctgtatctgggtccctgtggagatgaagccctcatccctaggagatgatgtaatgaaaaggaagactgtggtcggtccacttgtgcagagtgttagtctttagagcctttcttgttctagtcccatgatgtagccaagagcaggaagcattgtccccactgtactgatgatcaggaaaccatttcccagagaggttaggtgacttatccaaggtgatgcggcagggtggtctcagaactaggttactttacccaactggttttggctgctgagtgggaatgggagaagggtgggaagaagctcccaagactcccttaaggaaaggtgtaacctaagggaactgcttgggtgattatgttgtcaccacgtccgtttctctcttgagaccagacatttataaacttggcattcggaacctgatgtgggccttgaaaagcaggaattgtgaggccagtgcccagcagcactttgcacagaggctgctgagagggggtgtccaacaggcatccagagagaggccaacctcagtggagtaggatggttattggggggctgtgcctcttccctggcctgatctcatccctgtgggtcactccctgatggccacagccaaaccagcaaatcagtctgttcttccaccacctccagaaccggccctcctagctctattttgattgtttctacatttccttcagacctccctgcccgcctgcccaccccccaaaaaacagttgagagggaaaacatcttgctgatgtccatgtggtagacacacaagtatttctccagctgaaatggggaaccagggttagggccagtccagtctgacacatgcatgtctgccctctttctggtcagagaaggggaggaactccttagggcaaaagagggaaaggtttggctatactgacagagcccaatcccctccccacctccctcagcccctttgcttactgtctctcatgcctcgctcactgatggaaacagcagtgtggggctgggaggtctctttcccaagaaaccatatcccctagacctaggggaggctggtgcgaaacacagagacctacactgggaattcagagacctggatgtgagcccagctctgtcctcaactcactttgaaaccttgggttggtcacttctgtgctctaagcctcagtttcctcatctgtaaaacaatagcttggaacaaatggtctcaaaaggtcctttcaagctcagtctatgaacccaacacccctacacataccacatacaacaatagaactctcctacacaacccaaaataggaaccaatattgggtacgatgtatactatgttggtgatggtcacattaaaagcccagacttcaccatgtgtaacaaaactacattcgtgtcccctaaatctataaataataatataataaacaaaatacaagccctgaattggaaatgggagatggataccaaggcttgagtcctcagaacttagcttttcttggcctttacctctggagcaagagcccagctggtgcttttctttgctgttgcttctcagttccctctcctcaccctgggtggggtctctctcaggggtgttcattgcccgtataccttagtacttggcctagtgatcaaagcaccagtcctgggttccatgtctcatcaccagatggggctggtgaccaccccacatggtgctgtgagagttaaatggggagtatgtgtagtgcacttagcatagtagattgcaccagacatatcttccaacagtagctattgttattcactagtggagagtagaatgaggccctggggagggtgagagcagttctctaagaagtgtggaagtctaaaccgcagatgtggccaggaggaccctcccaatccacacactggcctccctgccccttcctgtatcagtgccaactttgtcctgtgcatcaaaaccctgactccatttcatgggttgctactgctcatttggctgcgggaaggccccgcttctgaaaataaaattgcctgtcagagaaaccctaaggatcaggattccggatctgggcagggcatggacaagttgggtggcagtggcaaaagcccctccccatggtctgccttttcccccagaagcaagttgctgggactgttgcataaaatggctcccacctccagtgcccagacagcctgcgctggggtgaagctggctacacgtgcactgaagctggcaggcttggggagaggtgagctgaggccaggtatctgcttcctttgcccaggattttgatggtctctcccctacacccacagtgggtgtgaacaacaaagacccaatcttttgatggtggtgaggattcctctgcacacgctcacactcacgttctctacccccttcttttcaacgtggcccacagcacgattccagaccctgctctattgtgctcagaggaagcagctgctggctccagcccgaatttgggagtgctttgatatgcagccctctctggggccctgccagtactgactctagatgagccctctgcggctgctgggctcacaaatcagccttctcaccccttcctccaggagcagtgttggatgagaatctcccccttacacacatagatcctgtgtttgttttgtctgcttttgtttgtttgtttgtttttgttttcctgttctgttcaattttataaggaggcatagcttttggacttggttgcagggttgggtttggaacttaataataccttggattgacaaaggcgccttttcttctaaagaacacaaaccttgatggttcttgcctgggtgtggttctcacctgggtgagcctggctgtgagggtagggggcctgaggtcaccccaaccacagcttctgtggtcctactggcagcatgttctagacagacctgtgtggagctggggaaaggagagtggagaagtttgaggaagctgcatgtttatgttttgtgttcctccctcccccaggttggggtcagcgggactttatttggatccaccacaggtcttttcaaccaaagccttgcagaaacaggctttaccccatacacacagaagagcaacgacttccttgttaagagtctgaaaatctgggtgagagcctgtcagacccatggcctcagagagcaggaaaaatcctttgcaactgggaaggaaattcagaagacaaaaaaaaaaaaaaatgcaggggaatagggggcgggggctagtctttatacatttctttctttctttttttttttggagacggtgctcactctgtcacccaggctggagtgcagtgttaacaatcatggctcatggctcactgcaaactcaacctcccagctcaggcgatcctcacacctcagcctcctgagtaactgggactacaggcatgtgccactacacccagctaaccttttaatttttttgtagagacaggatctcactatgttgcccaggctggtctcaaactcctaggctcaagcgatctgccaaccttggcctcccaaaatgctaggattacaggaatgagccaccgcgcctggcctacatttcttaaatttatgttttaaggcctgactacagattacttgcctgttttattccatggaaaaagtcatgctggtccagggacattctcattttccatcaagtgatggcatgcagccgtagaaagcaacatcctgtccccagatgagataatttttttgtgataattttataataattgtatctatctggtaatttcctccccccgcctctccaaaaatacttagttgtggatagttttaagtgctatatcctgtcatcctagactaatacatcttaacgtttttagggaaattcctttttagggaattccttggaatcagtacgacctgcctccagaaaaatgttatgtctgtttctggaggcccatagacattttttttttttttgcctttttctccattgcccaggctgcagtatagtggcaccatcatagttcactgcagcctcaaactcctgggctttacacaatcctggcctcagcctctcaagtagctgggactacagcacacaccactatacccggctaatttttttgtacagagagggtctctctatgtcgcccaagctggtcttgaactcctgggctcaagcagtccttcagcctcggactcccaaagcactgggatcataaatgtgagccaccacgcccagcctgagctcacgctataaatgccccatattggtttttctccctcagtttccagacaacccctgctctgtcctgagtcccatatttctgccataagaagcaggttgcctcaccgttccccgggggctgcaatgggggcatcacaggggactttgtgaaaggcattagaaatgataaattccctagtgatcaagtgcagctcagatgggacagctggcctcccacccatccctctgactctcagcttaatcattgcctaaggagtggttttcactcggttaatttaatgagtgctctgtatttctagtacacacgaaaaatgcaactgtatgatcttccagccaggttgggcctcttggcttagcttttcccagagcttggtgcttcatctttgttcaggaagaaaggaggtctgtctctcttctccttccctccaaatgcagacggaaagtctcgtcctctgaggacttgcagaaaggaggaatgtctcaggagggatcatttggggagctgcactcccaaggagttgagaagcagcctggttgagtaactgggaaaggcaaagcagcctgacttggagaggggcccggattaatgtgattccagaggaggtcccggtagagagaagtttggggactactgacttggagaaaaatcagaaacccgggtcttaagagcccttcctcttcaatccttaagccaggcattgtgcctgagggaagaaatagtggctcttatgagctctgctagaaaagtaacccttcaggccaggcgcggtggctcacgcctataatcccagcattttgggaggccgagacaggcggatcacctgaggttgggagtttgagaccagcctggccaacatggaaaaaccccctctctactaaaaatgcaaaattagccagtcatggtggcaggtgcctgtaatcccagctacttgggaggctgaggcaggagaattgcttgaacctgggaggcggcggttgcagtgagctgaaatcgtgccattgcactccagcctgggcgacaagagtgaaactccatctcaaaaaaaaaaaaaaaagaaaagaaaagtaacccttcacagcttacccaatgcacatccaagtttccagtgacacctctgagcaggctaagcagctggtggctcctgccaagccctctcctcggaactgagcttcacagcttcaggtgccagtcccttgctgacactcccagtctaagctgtgtgttagtctccaagttcagaaacaacacaatacatgggtcataggagaagaacctcgactgaggctaaaaataccataaagttaatcaggcagttttattaattatgaatttattaattcaaaacctattcaaggattttagttttttttgtttgtttgtttgtttttgttcttttttttttgaggtggagtttcactcttgttgcccaggctggagtgtaatggtgcgatcgcagctcaccgcaacctccgcctcctgagttcaagccattctcctgcctcagcctcctgagtagttgggattacaggggtgtgccaccatgcccggctaatttttagtagagacggggtttctccatgttgatcaggccggtcttgaactcctgacctcaggtgatccacccgcctcagcctcccaaagtgctgggattacaggtgtgtagtttaatgtcttttaaacctaagttgattgaatgtagtatgataatacagtgtactgatttattaaaactctaaatgaaatgatcagcaaaatcatactatttgtgaactcatcattgctttttttgttgtttgttttgagacagagtctcgctctgtcacccaggctggagtgcagtggcgcaatcttggcatactgcaacctctgcctcccaggttcaagtgattctcccgcctcagcctcctgagtagctgcgactacaggcacatgccaccacgcccagctaatttttgtatttttagtagagatgggatttcatcatgttggccaggctggtctcacctcaggtgatccacccacctctgcctcccaaagtgctgggattataggcgtgagccaccgcaccgggctcgtcgtagcttttcaagtcaatagaaatctggtgtttgaatccacatcatgtcttcccttgtaggtgggcagttgcagtgtgtagtgtgcatgcacaccccagatttatgcccaactccactggatgttttctgggtggggagtcatccatacctccctcagcggccccgttcctagagacgggaggcccttcccactaagacatattcctcctgctctccatggtgcaatgtaaacatcttctttctcacaatgtgggactgtggatttaaatttattattgctaagctcagatgttttaaagcttcctgtctacaagcctgagaaaatctcttcatactctcctttcctcctctctagtcaaattgtagccctggctccctaagacacaaccctttagagacccagactgcaaatttctttttttttttttttttttttctgagatggagtctcattctgttgcccaggctggagtgtagtggcacaatctcggctcactgcaacctctgcctcctgggttcaagcgattctcatgcctcagcctcttgagtagctgggattacaggcatgtaccaccatgcccggctaatttttgtgtttttagtagagatggggttttgccacgttgaccaggctggtctcgaactgctgacctcaggtgatacgcccacctcggccttccaaagtgctgggattacaggcgtgagtcaccgcgcccagctgggactgctcatttcaaatagaaattagattatcttctaggatgaggagggacactttggccttctttgtcatgggaggctggcactctcctctaggaccctggggtgtgtcttgagagctcgtgcccagggctataacacagagaggcctgtgctgatgtcatcttgttctgccctttgctggcagggtggttctggggaagggcagaggctccgggtcccactctggggctgttttcacgggggatggaaggaccatggccactgaacgggctgcggtcccgtctatggacacaatgccaatgggcagctgcaacagtgcagccaaggggaaaggaggatgtgcgagttgccctggagagtcccttcccagagcgccgcctctgtccaccctgactatatgaccagtggaaccaagggtgtggctgaagctctcaggacaaaggccagggagaggaagcaccggctgttttttttagactctcttcgagcacccactacccccactgcccccaagcgaggccaggtgtaggtggcatctccagcccaggtggccatgcagctgccctgctgtcagggaggaggcgcgtctgcaagctgccttccttccggtgcagatgggctcccttgtggcctttaaagatcgaaaacaccactttgaaatgggattagatatgaatgggggggaaacaggcaaaagggaaaaaattctggcttcagaatagaagaaatggatcaaaaacacaaacagcttaacaaaataattgagaattggggctctgcagtcagaccattctgggttcaagttctaactctgccacttacttgccctgtgatctcagttgagcaacttttttttttttttttttttgagaaggagtctcgctctgttgccaggctggagtgcagtggcgtggtcttgggtcactgcaacctctgcctcctgggttcaagcgattgaacagcctcagcctcccaagtagctgggattacaggcacgcaccaccatgcctggctatttttttatatttttagtagagatggggtttcaccatgttggccaggctggtcttgaactcctgaccttgtgatcctcccgccttggcctcccaaagtgctgggattacaggcttgagccaccgtgcccggcccgagcaacttaacttttgtgccccagttttttcatctaaaaaatagaagacaatattacctctttggtgggcctattctgaaaactaaatagttctggagaagtgcttagggtggggttgtggaacatagatagcaaatatttgagtacttgctgctagtaattaggtgacctaatatgaagaaggagctcctggcagaggggtagggcaggttgataggttagacaagagtttggggatcttggcctcccttgctggcttggggtttgcaagatcccatgttggagcaggagggccgttccaccaagcggtgccggaagtgcttttagccgaccctgccactccaggcaccacctggcattgcttgaaaactgtcaaggaaggagcatctcccaccactcagggccacgcacgcacgtggcggccaactctgcagatggaatgagagcaagctgctgcaagtggctagagtgtgtcagcaagagtgtgtgcagtcatcgccagacagctcggcgaggcatacacaacggaaaacaaatgtgtggtattctggaatttaaagcaaaacatccaaaacaatcccccacatcagatgattttggttaagatcagaatgcctgctttcagtggaaaagggatttatgggctggccagtgtatgctacgcgtctggcaagcaggcagtggaaacttgaaatgggatttcttgtttagaaagaggttaccttgggctggggcctccctcccaatcagccccaacatcctaacgccagtacacttcactgaagcttttctcctctccagggcagaggaagggctccaggtttttaaatgatgctgactttgtccttgaaaggagggaagatttctcaactcgaacttgttcagaccaggtagctgcctaatttccagaaagatatgctgagaaaaagcttacggagttcctcatcctctgccacaccctggagaggggaccaagctgtctcccttctatcagggaggagacaggtcagcaagtaaccgatctctgcatggcatgtgctgtgcaccgtcagaggaagagtgctgacagctgggtcactcatgcctgctctgtgaccacgggcaagtcgctttacctctcggagcctgtttcttcatctctcacagggatgattctaactagctctcaggctctaaggcagcccactaagaatcagaaggggcagcagggccttgtagtgtaattctagtctcctccctgggaaacctctcatgcattgcattactgttgctcccacagggaatgttctcttgtaaagtaatggcctgcaccagcctgaggccaggctcgaacatttacacacaacgagccaggcatagcaaggtggtggcacccccaggctgtagctgtctagggccaccttcacccttccacccaggagccccccagctgcactagcacccctggaaagggaggccacagagtcagtaggcaggctaagcatgtgcttagggcaccaacaatgcaggcagctcaaggaatccagggaaataggcactttttttgagctttatcttacaagttcaactttttttatgttgaattgtatgggttgtggggtaggtaccataatcatctcagtgtctagagcactaaatggccacagaaggcagaagttggcctccccagggacccagcttgtcatggaatgttgggtttaagtgtatgtgtggacccctctccccagcctgcccttatggtataaaagagtgacatataatagcaggggccatttatgacccagggacattgctggggttggggggagtgggccaggagcgggcaaggagttgtcttgatagaaacgctgattcccgtggggagacagcaaattagtcactctccttaagccttactttccttatctgtgtaatgaaggtaataacacaaccagcgtcttacgattgttactgggactaaggggatatttaatgtaaagctattatatgggcctggctcacaggcagagcttctgtgttagcttctgctgctgttgctgtagttgctgctactggtacctctccttaacatttttcacagattgaggttgtctaagtgttcacattcatccatatcttctcacttcagttcatgaaaccacatcacacaagatcagtcaatgctgaaatttacctccagtctttctccctctcgaacacgaattggaggacgtatctttccacctgtctataaaacactcatttctgagacttccccagtttggggaagacggataaagaagggaatcagttttgcactttgctggaagcgcctgtaagaatgccccattggcagagactcgctttgtggagctcaacttggaaattaatttacaatggaaattgaaggaaaatctacttcatgtccacaccaagaagggtggcctcaatgcctctccttcagttcactccttgtgccttccaaaaggaagttgattcttcgtatgtagaattttctggacacctagaacacctacacccagaaaccaggtcccagagagatgcagagccacggtcaccattgcttgtgtagacaccaggggtaggaagtggaaggaaggtagcgcctgagggtgcagcttcccagggaccaccacctctcccagcctcaatggcgggagagaacaaacccaagggagaagctacgggccagcatcttccctccctccctcttggcccccaccagggctagggtcaacaccccaaattgaaagcatctgttgtcaagctgcagcaggcagggaaaccctgtcaccaggttaaggcttaagtcagagcattttgccaaattcaacacgtccaagcctcccacttgtcccccaagaaaatttctcagggattcacatctttcccagtcaccccctggccagtgaggaagcaccgtgcatcgagaagagcatagctttgagtcgtctatgtggagctggttccatctgagctctgcctcttcctggctgtgtctttttgagtcagttgcttaaaatctctgagcctgattcatccataaaatgagggtgatgagaggattcagtgagagactgtacataaaccacctcctgtaatgtgtcgggggcgtgggtccttgtacatagtaacttctactgttaaattgctactgtggtgttattttccctaagctagacaacctgcaacttgaccattagcctcttttttttttttttttttttttttgagatggggtctctgtcacccaggctggagtgcagtggcgcagtgtcaactcactgcagccttgacctcctggatttaagccatcctccttcctcagccccccaagtagctggaactacaggcgtgtgccaccattcccagctaagtttttgtattttttagtagagactgggttttaccatattgcccaggctggtctccaactcctgagctcaagcattccgcccccctctcagcctcccaaagtgctaggtcaggtcagaggcctgaccatcagcctctgagtgtattcttttaaaaaattgtttttctagagttcggggaggtttgaggagaagtccagtctcatgcataacagcgagctggcctagggagcacagccggctgcagaattcaggggggaggttcttaccaggagtgccctgctgcaggttgtgggagcctctcacgggcccactgagtcaccagggcctgttaccagaggagagttcacgcaggcagggcctgggtggtggatgtgcatttgggagccaaacgcaggttccaacttgagccctttaccatgacttcctggctcagtgggttcagcacagagttgtccagccgttctctctcctttcttacctcttcctgccttcccacctctctgcatcctcacccttaatggtcacaatgccgcatttccagggtgaccccaggttccctccccgtggctcacagtgctggtcaaagcatttgagcccccaaatgccccactctccagatcggagtgtaaagtagtaggtgccagtcctgctccctcgtggggctgggcagtgagctctccctaacacacacaaagcacctccagctcagaggaagctcacacctcccatccatgccttcaggcttttcggcactggcatttagaaagctattctctggattcagaacccccagagagagcttttctctgtccttcctgattattggtgtgtaaatgaaggcctagagtagtggttcttaaacttgagcgtgatgagagtcacctggggaggtgttggaaaacagagtgccggcccagtcccactccagtttcactgagtgagtctaggagggaactgcgaatttgcatgtccaggttcctgggtcatcctgctgctggtctggggtcatttcgagagctgctggactggcatagagaagagtttcctgggttgcctttgaagataagaatttctgaaggtttgagcactgccttcagacagtggctcggtagaagtcccaagagcagaagttgtctggagaggagagatggcccccaggatgcgcctgaccaaccagtcatacctacaaaagggagttctggttctctagggctgtgatctctggggcttttcaacttggctgtagtaaaactaaagttagtaatatgccctgttgtcatctagaaattccgccatgagctattacagtagtttagttgggacgcttaaggagagcaagtcgtggcaatttcttctgctgattacagcggagttttggttttcttgttcccggtgtttactgtgtggtggagctggataagggagcaccccaaagcctctagtcctgcccaagtggctttgcccttccaaagacaacagccccagccttcatttggaggtgggagaggaggacacagagagggttggaggaggctgtgggcatcgggatcctgtttgttcttgctggcactgcctggcccggcttcctgaggagtgaatcagcccatccaaggcttggcatgcagtagtgagccaagggttgccatggagatgggcgaggcccagagcccacaggtctgggtggcctgacttgtttttaaatgttgaagtctgtgcgaagagggagggcctatctccacttctgtggctttcttaaagcgtgactggtattttggggcctggaaaactgctggtgtgggaaacttgcatccccagtatttggtgtgttgcttacttcctgggtgctatggacaactatgactaatgctctcccaagtttagtagatgacaaaaacaaaaaccagggctgacaagcatcttattgaaggagggtgataaagaggccaaggtttcctctcctgcccaacccaggaaaatcccctctctctctgttatctgctgctgtaataactcctttcagcagggttaatttgcccacggaagcagtttgtgatccaaggaaggacagaagcctaaaatctgagccaacagtctccctttagccttccttccccactttcctttggccattcccatccagtcttagtggagctctggatggcagtttgcaggtgtgaagcagataagtttatccattttcctccactacccagcgctcacacagactcccacacaaaccaggaaacagaaccccagtgtcctaaattcccccgctgccacccagccgccttctccgatcacaggaggacacaacagccgtccacagagggcccatgaattgacccagtgtcacctcacgtctttctcagggtttattattattgtcattttttttccctatggaatccggctggctgtaacacttcacagttttcagaatgttttacatgcatcactttatttaatcctctccttcaacctacgttgaaggcaggacaggtatcatactgttttttttccacaaacgaggactgtaacgttcagagaagctgaggaaagtgtgtagtgtcagagagctcctaggtagcagtgccagaattagagcccaagtttatatccatcacagtccagtcattctcaacagaggcgtgcaatagaatccctgggagcacaaagagtcccctgggattgctgaggcaggtgcatgtttagaaatcccccaggtaggctgggtgccatggctcacacctgtaatcccaagctttgggaggccaaggtgggtggattgcttgagctcaggagttcaagaccagcctgagcaacacggtgaaaccctgtctctacaaaaaaaataagaaaaaaaaaaattagccatgtatggtggcttccacctgtggtgccagctacttgagagactgaagtaggaggatcgcttgagcccgggaagcagaggttgcagtgagccaagattgtgccactgtactccagcctgggtgacagattgagacctgtctcaaaaaaacaagtattttcccagatgattctgatgcccaccccataaagaagcaggccctaggtggcacagctgtgcaggcagcagctcactattctttctattaagccacctgtcccttgttgaaaattgtgtatcattttgaccatgggctcagcagagtaaccaagtagccattgcttttccaggaggacaatgggaagttgggaagaaagttctccctccttcctggactccatccactcaccactgcccacctccaacccctcccaaagtggtagatatggccacctcaaggccaaggcatcctcagcaagaaatcactgtgagcaatgatctgctctccactttctgggctttccaaggcagctgaatagaggaagcataacaaatattttgtcctttttaaaaaatgggctgggtacagtggctcatgcttgtaatcccagcactttgagaggccaagctgggtggatctcctgagcccaggagttcgagaccagcctggacaacatggggaaacttcatctctacaaataatttttaaaaattagctgggcgtggtggtgcacacctgtagtcccagctactcaggaggctgaggtgggaggatcatctgagcctagagaggtcgaggctgcagtgagccatggtcataccactgcactccagcctgggtgacagagtgagaccctgtctcaaaaaaaaaaaagtgtatggccagtcagtacatattacagaagatgggacctggaggaaaagggggcccacgccaagagcacccagtttgtttgaccacaaaggatttttctttgcagtaggatttgtcccataggcaaacttggcttctcccacccggggagtggcatgcagtatgccctcccccacactgaaaccacgttcaacccactgctcttttcctcttcctctgggttacctcctctttttcagcacacctacttcaagaatttccatcaggaggccaggctgtacatacgaacctccccaggttctaactggaactggttttgcacacttggcatagagtccccagagcagccaggtgcccctaagctccgttacactttgatgttttttgtttaatcctcctttgaaattggaaatgtttcctgtaactccaggtgtgtgtttcagtgtaagatttctgaacctgtccctgcagcaagattttgcagtgtgagtcactgaaattctcatctttgcgtgggagccttgggtgaattgtgctctcagtggtgagtgggtgtggcaagggatgaccaggacaccattcattgtgggcctgagtttggggcactcttgggttctcatgtctcctgaggctcacataagccccaggtgaccagcttacctgtgttcgtcaaacataagagtgtttgactggacttctttgagggatgggggtgctggcagagttgcagataaagaccgaggacagcaatgcatgggttgtttttttgttgtttttatttttggagatggagtctcgctgtgtcacccaggctggagtgcagtggctcaatctccgctcattgcaacctctggctcccgggttcaagtgattctcctgcctcagcctcccaagtaattgggactacaggcacacaccaccacgcccggctaatttttgtagttttagtagagacggggtttcaccatgttggccaggctggtctcaaactcctgacctcaagtgatccgcctgccttggcctcccaaagtgctgggattacaggcatgagccaccgcacccggcctgcatgggctttttgtaaacttggttttccaaagtctgtataaggatttgcctgtaagtcacattgggacatgcttcaccaacagaaagggaaattgttgtcattccccaaatattccccaaccaaccttaatggggcttccttagtatttactctgggcaaataattgttctttgtggtttcttttttttttcttttgagatggagtcttgctctgtcgcccaggctggagtacagtggcgtgatctcggctcactgcaagctccgcctcccgggttcactccattctcctgcctcagcctcccaagtagctggtactacaggcacccgccaccacgcccggctaattttttgtatttttagtagagacagggtttcatcatgttagccaggatggtctccatctcctgacctcatgatccgcccgcctcggcctcccaaagtgctgggatgacaggcaagagccactgcgcctggcctctttgtggtttctgactcttgtgagacatttgaagatggatctggataaaaggcctgatgggaaaggaagctggtccaaatgaagaggacacaggagaggagatctgggtggatttcaaatactttttcactgaagtagtcattcatttatggagtaattacttactaatgaccatccgtccaaagcatggatggggcaaaggagataaaagaatgactcagaggtcccctggacctcaaggagcttgtgctctgctgagatgggaggcaaaccccagatagaggaagggcagagagtgtggagcatggatgctggagaggacaggatggatgcgacactggcctgctcacgtgcttggcttgctcaggggttgcatttgccatttgcatgggaggaatgggaggaaatgggtggggaagcagcaggcttggcttaggcgatcacgacagcattctaagagggacttgtactagcagaggcacaatgcacgaggctgaactcgggaaacttggagagattgcatctaaggagcagacaaggaggaggcagggttcagtggtgtcagctgctgtgggatcccaagacataaggattcagcaaaagtcttaagactcaccacccctttcgggttgggagagatgcagtgacgagccagtgaggacttggaggtggttaagacgccagctcaggggtgaaaggaaagcagagagcaccctgaaggagctgcgaggttgaagaaaaaaagggttctatttctggttttcttctgtttggatttttaggttagggagacctgtctgtgtcttcgcaaaggtcaaaaaagtggcagaggcagacctgcatagtcaggaaagaggttaattagtggagcaggttcttgaaggagacaggaagctttgaaagagagagacccctgcttctttattattgttttatacactttgttttagaataattttagatctacagaaaagttgcagagatagtgtagagaattccctcatcctcctccccagtttcccctattgtaccatctcatattactgtgtttcatttgtcacaactaggaaaccaccgttggtacattctgttaactgagctctggacttagtcggatttcactagtttttcatgtaacgtcctatttctgttccagggtcctatccaggacaccacaggacagttgtcatgccccctcagtcttctctgggctgtgacagtttctgtctttccttgttttccatgaccttgacagtttggagagaagtgctaggcaagtattttgtagactgtgctcagttgaggtttggctcatgtttttctcagggcctagcaccagtgaagaaacgaagaaatttccagtaaaacaatgggaaaaaatgacccttttcctctcggccctctcaaagggatggaaccattttttggccagatagcaaaggagcttttcccagcaaaaccagaatgtttccatttggcttttcttggaaacaaaagaggaaaccatgggcagggccgcgagctgggagtagaagctatgggctctctcctgcatccccgcatccccgcccgaccagctgggcatactacaggttgccatcctctctccagagccctgggaacagggcactgtctcattcagcatccgcatcaaacctgctctgctcctgggatgataggctggggtggggcagccatcgaagaaattacatggtcagcatgccgccatatgtctgttaattaacctgggtggaagccatcgaccccttggcctcccggactcctatattctcatttatggagtccctgaataattgacttggcaccctcttttaagggttaaagctctctttttttcttgctcctggcccctcccatttagtttctcctattattaaagtagctgaagctgggcgcagtggctcacacctgtaatccaagtgctttgggaggctgaggcaggaggattgcttgaggccaggaatttaagaccagcctgagcaacatagcgagacccctggctctacaaaaaaaaaaaaaaaaaaaagggtttaaaatattagccaggattagcggcatgcacctgtaatcccagctactcaggaggctgaggtggaagaatggcttgagcccaggagtccaaggctacagtgagctatgattgcaccactgcactccagcctgggtgacgagagcaagaccctgtctcaaaaaataaagcagctggggtgaaagccggatggggacaggggagcccctctatgccacaccagaaagtgagttctcctagaaaatacttcagagcgccttagatagcgctgcctgacaaccatgaaaggcattattgggtggcactggttatacaagttttgtgaccctgtgaccccaagccattgtgactcagccaactggagcaatgtctccaacagcgttacagaaaatggggcagctgatggttcacatagcatcccccccggccggtgaactcagtcattctgtcagaaaaggcagcagggttcactcctgatttttgtccaagtgttcccagtcatgcccctggccctcccttttctctgggttacttgaacctttctcctctcttattgtgagttgttaagcctgtgagaccgagacctatggcagcttttcccatttctccagagccagctgcttttccttcctggttgtagtgaaatgttgtagctttgacaaccaagccgcatgatgtaaggtttaaggtggggtccgaatgcgggggactcccgactccgggcttggcctggcccttggccaagataagagacctgagatgcttccttttccctcgtggttccagttctccagcccagcatccttcttaccacctgtgcacagagaccggatcaatgactggacttaacatattggctcagggtcctcgacattggggctctctataagatggaaggggccttacccctggaggttccactggggtaccctgtcattatctgagcgtggaacattcccagagagacgcagctcctgctcgtgagaggctgctgtgcagagcgtagctttacctcatcttacagcttagttccttggcagacctgggattgttttcgttcttttctgcgactcagttttcccagcagataaggggtggggtcataacttcactcatcaggggaagtaagatgacttgggagataattgcttgataagcacaagcctagagcaaaaaggacagtaatgagcactgtctcgctatctccctatgcgcgcaagagcatcacaagaccagggcgagagggaggaccagggtgagaaacaggttgtggctaaacgtggaccaaaattgagcaccggcctacagttttcaggttaacgcttttatgtccaggaggccagcagcttcagtcttccattcccaggggactgactgggcctccctggggttggggtggaaggagggaaggtatcacctttgtacttttttttttttttttttgagagggagtctcgctctgtcgcccaggctggagtgcagtggcgcaatctccgctcactgcaagctccgcctcccgggctcacgccattctcctgcctcagcctctggagtagctgggactacaggcgcccgccaccacgcctggagaattttttgtatttttagtggagacggggtttcactgtgttagccaggatggtctcgatctcctgacctcgtgatccacccgcctcagccttccaaagagctgggattacaggcgtgagccactgcacccagcccacctttgtacttttaatgctcagggacctggggggggacccaggccaggacttgccatgtacagagtcaagaccgcccagtgtgtgcttgtctagtcccttgtgtacgtgaattcaagccacataactcttctagcccagcacgctcccagcagggcccgcctccccgcctaagctaactgcagtgctcttggtcggggaacccatggtctgaatgcgagtaccctgctgggtccaggacggtggagactcacgcttctccccaaccaaacagtgatctgcttgctgcctttggattaggccaggagaccctccctcactggccttttattaagaaagaaaatcagactcgtctttgaactcagaactctcaagttcatttgaactctcaaattcttgtgcctgtgtgagtttttctcctctgccttgtccagccgcggggcatgtggcgtcgtacagtccttaccaatgtttggagctgcctgccctaaggtgcggctgagaggctgagaagatgctgagtgacagtccacaggctgggagtgcagggctggtggggcttcatgctggtaaagtgaggtggttctcccagagcccatttggtaccttcctcttcagatgcacttctgatattatcttctttattctttagccatacctaaaaggcagggaagggccgcatctcacaatccctgctttacagatgggaacactgaagcaatagaatatgaagctagactctgcagcccctcgtggtggaagcacacctccctggcaggagcaaatccccttatgctcctggggggtaggtgagtttgtgactgctgcaggcggaggtctgggtggcccttcccactattgccacatctgctgtccacccaacatgcccacactcactgccatatcgtaagggaaaggagaggaggaaaggaggaaggaaagagaggcctgtccacaccatgggctatcaatagctcctggagccgagaaccaaggtccctgatgagcgggctctgacataagagtgcctctgttgaggagggtggaccagcaaaacctgggcccacccactcctgcgtccagccggctaccacactggaggcctgtgagtcactcccccggcaagccctggtacgggtgacgacgagggagctcagctggcactggggggacttggcaggaggcctcctgcacagcatctagttcagcagtgccagcgaggggaggccctggcatgtcatttactgagcagcaggtctccagggacattgcagctgccctccctggtgcatgtgtgtccggaactgtgtaaccatcacccaagtcaacagttagaatacgacacccccagccacatggcacctccctgagcataatttcctcctccacctaaacatcaccactcacctgataacaatgcttttcctttatcatttataggcacatgtaagcgtctagctctgtgtgcatccctaaacagcatagcgtttttaactacatggaatcatattgtgtgtgtgcctgtggctctggcttcttggtttagcattgtgagatgcactcatggtgttgcgtgtagctagagttactcgttttcactgctgtatagtgttctgttgcctataaaataccccttcagccaatgggcggcaggtaggtcactgtttattcctcgcttgctggtatttttagtacctgcatgaatcaaacacaccccgtaatggcatctacaactaccaggcgtatatgaggggcagagaccaagggtggtcacaaagtcctttgcaagtctcacccttaagcgcgtggggactgtgttgttgctggcagccagaattaatgctgatgtcctgtatgtcttgcagcttgccgggattgctgtccttgccattggactatggctccgattcgactctcagaccaagagcatcttcgagcaagaaactaataataataattccagcttctacacaggtgagggacggggaaggctcagtgaattcagaccctggctccaacaaagttcctgcaactttggaggccccatgttgacccagggacttgggcttgggaaagacttttgctctagccacgctggccagtcgtgtccctttcaagttgtgcagtttttgtgtgtgtcgttgtgcctgggaatttgcgtttaactgatgtggtttcttttcctgatggccaagtcaggcatgttgatggttctctgatgtgatgtagcctctgccaaagttgtactcattcttgagggtttacgaacctctgttctcatctctgatgctctctcctgattgtcttcttatcctgcatcatttccttaattcaaaaagctttgtcctggggatctgcagtgctggaagaagatatagacagctttcctcttcactgttcagatagggactctgagactgggaaaaacatcagcctcctggaaaacacagcaacaataggagagactagaatggactctgcccagtcctttggacccctggtactggggtaaatgctgtagtgtttagttttatttgtttgtatttgacacgacttttgctttgggagagaggcttccagtttaaacctgcctgggatcctctgaacatgaacagacttggcaggtttctttctacactcaggcttcttggcagccttgctagaccattctatccctctcgttgccgtatcaccacgtcaaagctcccttcagaggagggggagcctggtgcctgccaagtgcagttgcccgcgtctgcgtgaattcagactctgcggctgtactctgcctggcttggaggtaggaaacttttcatttgtgaggaacaaaggaaacctcctatttttaggatgacgctgacatgttgtcaggctcaaaatgtaagtttggtcacttccttcccacccaccaaaaaagttatttttacaaacgagggagaaaacagttatctcccagtccctcagggagaagcaaggctggccagccacgtagaccttccctttcccacctcttgaactgggtagggagagtctttaaaaacagctcctttggttgcgtaacatttgagccctgtggatagttttgctgggtttactgctttttattgttagctggggttttttggggtgtgtctctctattatcggaaagaaagtgagagaaagcacaatgtatgtttagaaaaaaaactacacatacacacagagtttttggggaacaggtttctatagcgccctgacttgttttggcaacagaccattttttgggagtctgtgacaggcttagaatgctgtcctgcagagcaggagggaggagccgggtgcgggtgctggggaagactctccacactccacgccgtgttccagaagggagccctgtgctgggggagcaggtctgccggcaggagcaggcacagtcaggcctgctttcctaagcaaaagccctgtggccggcgcgtgtgtctccaaagagagactcagtcctcccttgtcctggctgcttctaacaacccactttttcttttctgttacccaaagcctctatggctgattctttatatttttagatgtgggagttaagaatctcatgggtaagaggatggaactgggaggaagacactaacatttttattttttattttttttattttttttttgagacgaagtttcaatcttgttgcccaggctggagtgcaatgacacaatctcggctcaccgcaacctctgcctcccaggttcaagcgattctcctgcctcagcctcctgagtagctgggattacaggcatgtgccaccatgcccagctgattttgtatttttagtacagacggggtttctccatgttggtcaggctcgtctccaactcccgacctcaggtgatcctcccgtcttggcttcccgaagtgatgggatgacaggcgtgagccacctcgcccggctggaagacactaacatttttgagcccccttctttgtgtgtcattcattgtcttgtgtgtattatataatttaatccccttagctctacgaggagtgtggagtgattctcatctcacaagtgcagaaaccgaggcctagagagctgaaataacttgtctaagcttatattccctcaagaggcagggccaggttttgaacccaggcctaaaagagctgcttctcgggttgtcattgccaggttgtggggtctccctctgtaggaatggaagaggtctgtactggctgaatgtgccccattggcagggatggggtggcgctgtcttggcccttttacttcacccaaattgcagtcagggagagaaacccctgcgtcggtggcccagccagcagctgacaggtgggaaagctgcagggtggcaggagaatggtgagtgccattagaggagctggggctcacctctgggaacctcacaggattcagatcctgcaggtcattgcagggccctgctggtggccggtggtcctacctgaagtgaccaggagggtgatttgaaggcacaaccccaaagagacacagatcccctagttggggtctaagggccactgtccacttagctctgccagggaaatacagatcctttgcagcgacaccccattcggggaagagagcggagctttgaagacttcgttctgcctgcagaagcgccggcaagggggatgatgcacggtaaagttagaacagcagcactgtgtctgggcacagtgatcagccctgatctcaggtgatccgtccgcctcagcctctagcactttgggaggccgaggcaggcagatcacccgaggtcaggagttcgacaccagcctggccaacatggcaaaaccccacttctactaaaaatacaaaaattagctgggcgtagtggcgtgcacctataatcccagctactcgggaggctgaggcacaagaatctcttgaacctgggaggcagaggttgcagagagctgagatcacaccactgaggctctgtctccagcctgggagacagagcgggactccatctcaaaaaaaaaaaaaaaaaaaaaaacagcagcacagcactctgagcactgcttaggtctgagctatgccctgaacgtcactgaacgctttaggaaataataattgtcgtccatgggcaaagggccaaggaggcgtcgctctgtgtccccttccccacgaggctgtgagaccagccttctgtactggcccagagcccttctcctagcagatgagcttggagtgccagccacaccctggctacttttccaaggaatagtcatggggtgaccgccccttgcactgggccaccaactgtctgcagagcaacccacaggccagcctgaccatgcagctgacttttcaggaaacctgaacagcccaggggtgtcttttctccagtggggccacagcttaccaagtagagaaagagtatataaccaggcagaaaagcaagtgaaaacctttccaacattcagaacagtctatggtaagtccagagcagctgacagccttatatgggccttctctccaatccaggcctggagattcagcccgtcagcaagatccctaatcccaggctgcaaacttgttggggaacttcattttcttggtcctaggccagcagcctttcccagctccctggtgtccctccagaaccatggctgctgaatgagggcatctaggggggctccagccagaggccgtgaatgcccccccttcctcggccagccccctatccatgatgaggtgcctggtgattttcaggacacgcgacacttggccttagtaagctggcatccccatcctggcttgtgacctggggcagttcattttattgctctgggcttcatttttctccctcctgaaaccagcacagcttacacaaccacagcacagcttacacacccactcccctctggggcaaagaagtacagcgtgtggcaaatggaattccattgtggcacttattcccgtgaactcgggagggcgggaaccaagacgaaaccagtcggggcagaggtagggctcctttgaacacctggtggagttatttggatataataaacttttattgcaggccagaggccctaccggattttgttctccttcacacaaacgggcgtggtgagtgctgtttgcaggacagagctggtgtagggacgggagcctgctgtgtcctctccctgggctaaactgagagccctggtgaacagtgaaaaacactgttccatttcttgtgtaaaggacacgctggcatatgctactgctgctacaccagcctttcttttttttttttttttctgggcctgtaatgtcagcctgaaaaaagcagaataaacaacccttaagcaaattaataccgtaatcctagagaaggctctgtgatggataactttttccatgagtcagacagcaagctaacattcgcttgttttataaaggggaacactttgtcatttatcaacagcagccttggctaacaagcttggggtgtaagcgatgagtagcttctccaaagggaagcactgaatagcccttgtaaaaaccagcccgagccctgcagtggttccgtgacttccatggggcctgcttccagatgagctgtcctgtagcttgccggctgctgctgagtccccgaacacagctgccaggggatcgcttcccttttcccgtgactagagagggctaaagctaggcactgcagatccgtagccatccacgcaagatttaaagcccacaaaacccgtgatcctaaaatcttcctctgctgagccctagcatgaatatttaatattaaccacaagccccattaggagcatgttctctttctctgcgtgggaaatactttctctttagtagctcacttgcagctaatccaattcccttggcctctgccaggaccgccaggttcaagaactgggatctggacttagagaaaacatgtctgcctgttcgttcccactccacggtatttcatgtgtttgtaaatccttttgatctcttaatacctcctgtttattcagcccctgctatggagctcaaaggagtgacctcatccttccttgacttgcccccattagatggggagaaactggggcctttctactgtccccatgtgagagaaccaaaggaggctgccctcttacccagtgctccatgcatggggctgcacagcctccccaagcccagcttgtggcctcaacagcgtttgactgcccaggaagatgcgacctgacttgaggacaagctacatttgtccccttgcccagtgtgggccaggcatgcacaagaacaatacccatattcttgcaacatggggtttgccagtaaccccacgtgacttgacctcacgacggatgtgggggagaagggggaggaacaaacgctctctgtgtgcattctgctctgtgctgcccgtgagcctcagctgcgggcagactgcatggtttgttgcctgcaaagtctcacccctgctcggggtgcagatgtgggacagtgaagtcagcgtgtcacctgccgagggttctcatcgagtgtcctgctgtgtattgtggggaaacatcacagactttctctctcgcgtgcgtgttttcagcccctacatcaaggatatctctctggtcccagtgaaaggacagtagggatacagcagcaggttaaaattcaccatggtgattattaatgattgttactcatgcttggtataattgagattaacaacagctagcatttgttgtgcacatgtggattatatcacttaatcctcacagcaatcctggaagtgggcattattgctactcctgttttacagatagaaaactgttgcacagagaggttaagtggcttccccagagtcacagatctggtgctctcgacatgtgacagtagcctctcccaaggctagatagaacatgcctgcaagacagggaggcacagagactttgctgctggttttcctttgggacccatgtagggctggggtgctgattaagggaatagtccctgcaggacagctgtggcttctcaagaatagaactgtggggtggcccctctgggcattcctttggtgggttgtggaacgaatggggccagtgctgctctactgtttgtgtcccaggaatttgcattgttctgggtttgggcaaaagttatagaagttgctgcccttctctcacctcctttccatgagccactcagatcaagggcttagtaatggtgtcactcatcctctccttagcaaggaggagcctcttcacccttaacctgcaataactgagttatgactgttaagatcttgttagcatgctatagagatcttttgaaatttccaggaacatacctctttaattttactagtaaggaaattgaggcccagagagggaaaatgtcttaccccaggtcacacagcaattagcatcagtgttagggccaaaagaagggtcttctgacacccagatctgtgtcctttgcactagagtcaggtattggacctttgccaagaggtgcctttgggtgttcctaactgtatgtgcctaaccaccacccagcaacagggcaaagaggcccgccttctgggaacaggcagagttggttccccccacccctgggtaggggggtgcctaggtgtgcacggccccttcctgctggaaatctgctctgacagcgtcctctgtaaggcagggtcccagaagttagccagagtgtggaaggtatatgctaactagcttgagtggattcatcttgctggaaagagctgacagactggaccagtttgcattccgaatgtagggattcccgtggatattctctgtcctggattgagggctaatgggcaccttccagaagggctgagggtaaggtaggagcgtgagcttgatgaagcagagtcatgcaagagaggctggtgggaaggagacctggggcagaggtggaagaggaggctgtattttaaggaaagggaacttcttccctgagatgaggggaataaggaggtggggaggcaggagttaggcagagggaaacaggaattgccggagatgcctgggcctctgaactgatgtctccacgcgtgtgtgcttcctctgtcctcccgcaggagtctatattctgatcggagccggcgccctcatgatgctggtgggcttcctgggctgctgcggggctgtgcaggagtcccagtgcatgctgggactggtgagtatcccctcggcatccccacagccaccctgactcccaccaacaaaaacctcagcaggcccagacccagaccacagaacagatggagggggatggggtcaggaaggtacccaaagggcatgagctgtcctcagcctgggcccctccccgatgtgaggcgtcgcccctcttcctttctggagcctgtcttatcgcttcccctaggcaactaaaaggactatgtttcccccttttctcgaggaccacgtttgctttttttccctgaatccacaggtacctttgccttctccttcttgtttcaaaatctgttttggtcttttccgaactccacggagtggattcgctccctttacttgcccaaatctcttgtcttttgtgaacaatagtagttgcctgctcactgactcttaactaacgccttgtaaatgctagttctgggctcagctgtgctcagctctttcctcatgtccgggcaccttgcctcactgtggcctctgtcctgggcttggttaactgcctgttctgtgaacttcttccctgcccctgctaggctattcatttgtgtcaccagatgcctgttcccagggagttgtccttcttccttgtcccaaaataccctttgattttcctggctggttggctgggactgttctcaccccgtcccctcgttgccttccagttcttcggcttcctcttggtgatattcgccattgaaatagctgcggccatctggggatattcccacaaggatgaggtaggtttttcccatgagatctcttgggtttgggagttgggggatgggggacagtgaagcagggggcaagtcctggctgggcactttgttcagctttcagctgttgaccaggcctcttatctcatcgcgtccctgtgtgccagcgaatgtgccctcctcggggcagggaatgtcagtgcgcttactgtcctgtccgagattgtgccagccatggtgttgactcatagtagatgttcagaaactacccattgggcctgtgcgtgtgtctgtctgtccatctcacacctcagcagcccttccccacaacttttagaaagattactcaggaaatacaggctttctgtgggctggacacccttgcctcctcctctgatctataaataacatgttcaagtgctgcccccatgagccaagtgctgcccccaagcctgtgcagggtccacagatgtttgaactatgggccccacatccggagacttggccatctagtatggggaaaagacatgaaattgataagggtcatagaggtgatttatatccaaagtactatgggatttgaaaaggtggggctgggaagggaatctcttttggcttcatagagaagggagccgtgacctaaaccttgaatgagagatgcgttcaggaggaaagttagtggaggcaggggacttccagtcaaaggggctgagcatggctgagcttgggcttacgtggggagccctgcagagttttggaccaggatgggccatatcagagtagtgtttttggaagggctgccttgtcatgttcagcaggaagggggaaggaagagagatgctgagatgctggaggcaggaaccctattgttttgttttgttcttgagactagtcaagcgcggtagtgagaaacagggaagagtagaacaaggacttccatctgtaactgacgtgagcaatccattgagataactcactacttttagcccagccaagggaactctgtttaaaaaaaaaaaaaaaacatgtctgtaagcaataacagctacagccatagaaataggaggggatcattgtgaaaaatgtcagacagatgctgaaggaaaaatgctggctgttggtctgttaactggatgtggtgagcatcaaaggggcagacagacattaaattgggatgcgccaggcgcaggcacataataatacatcccctatattatgatacaatagctggcacgtgctccagatttactctgtactggacatagtggtaaaggcttaacatgcaatatttcatttaaattctcacaaataatctatgagctgtagggacaaatgtggaaactccatacagagaggcttagtaatttgccaaaactcatacctaagtgaagagaaaaacaagatggaagcctgagaaaatagtcaggtcaggagtagtatttcaattattatcatcctctagatcatagagattcaatttaggagccaagttaggagccaagtagagctgaaggactgaccaaagtgtaagggacagggagaaacagcccgagtgggtttctggaggatgtgggaggagatgggaagtgcccaaaggccctgagagaaggcagtgctagcagctgccatctgcccagtgacgttgtccaagcacaggcatctggtggctgagagcttagagagaacaagatggaacgcataacatttgttcgtggaggaagatgtgaaaatgccgtctctgcccctctctcgtctgcccattgtaggtgattaaggaagtccaggagttttacaaggacacctacaacaagctgaaaaccaaggatgagccccagcgggaaacgctgaaagccatccactatgcggtatgtcgccttggcaaagacaccctcctgcgctttctccggattgtgtctgcacacagggtgctgactgcaccagaccagtgcaaacattctaatcgtcttcttacaatttgtttctctcatccccatccctgccttctcgctgtagttgaactgctgtggtttggctgggggcgtggaacagtttatctcagacatctgccccaagaaggacgtactcgaaaccttcaccgtgaaggtaaactcagaccaggatcctggtgtccctgcccccattgctctggacaaaccctgcaagcatgaaagtgacagcagccaagtgctgcttcagcaagacccgttctgcctgtgaaagggccccagggcacccatctctttctctcccactttgggccctctgtttactcaagggcaataaaacaaaggccggaccaggggaatgacaagtgttctggcaccgcccactgctgccagcccggaagctctcaagggcaggcgtgcttctgagtcttggactcccactctgactttgtcagtggctcctgtctgtaagccagagttaatgtccaactccagaatagtaaaaggtgaccttacaaccatgtcagaaatagacccccaagcagggcctgtccctcctccttccctgacgtcctgcccagattttagggatccactagcatagccatccctttgttcccctttccatccaccagccagaacttctcttatccccgaacactcctgtccccagcccaccctctgcccaccagttctcccgggtgagacgggggccatgggagggaggaggtgccctgggaggaaggattgtgtgtgacccaggtcttggtttgtctccccaagtcctgtcctgatgccatcaaagaggtcttcgacaataaattccacatcatcggcgcagtgggcatcggcattgccgtggtcatggtgagtggcaggacgtcgtcccaggagggggactgaggagttcacattgattcagcccatgctctacccagacaccgccgcactctgtgcatttgtcaactcactttgtcctcgtgcccttagtatttccattttaccactagggaatggagagacagagaggccgatgttctgatcaaagcctctcacctcctgagtggagtatctgaggctccccctgggcttctaaagagtcgactctcttagccgttaaggttcagggcacatgggtggcagtgctggcactgctagtcctcggagcatgtctcctcacgcacctgctgttcttctccctaagaaagtcgttcactagaggctaccggcgtgggaattgttccatttcctgaagtgcatctgaacatgggcagccagaaggaggtctctcgctaatcagcccctagaaaccaacaagggccaaccaggttccttggggtcatgtcctctcttcccatgagggacagccccagacggaacatggtcctcgctgggatggccttggctcactgagtcttcccccacccccgcctgcctctgccctcttgccagactgcccccaaagagagaatcgcctcctttcttagtggttatttgcacccttcaccggcatcttaagaaaggcatgaagcacctttcagcaaaatatacgacaataccttcttttttttctttttttctttttttgagacgaagtttcactcttgtcgcccaggctggagtgcagtggtgtgatctcgactcactgcaacctccgcctctctgggttcaagcaattatccagcctcagcctcccgagtagctgggactacaggcgtgtgccaccatgcccagctgattatttttagtagagatggggtttcaccatgttggtcaggctggtctcgaactcctgacctcaggtaatctgcctgccttggcctcccaaagtgctgggattacaggcgtgagccactgtgcccagccaagatataacaatacgttttaaaatagaatattaacattttgggaggccgaggcaggcggatcgcaccacagcactctagcctaagcaacagagcaagactccatctcaaaagaaaaaaaaaagagtattaaataacatacacacaaagacaaatgcaaaagtactaacctgtatggactaggactataggaaaacctggaatttgagcattaaatttggctctgagcttactttcccaccctgaaagttctccaaggaaaatgcttgtgcagctgactgccaacccccccagattcctcacgtcccgcacccttctcattatctggcctgcatctctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctagatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtc

SEQ ID NO: 35741 - DNA, 3942 bp, Homo sapiens
gcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgta

SEQ ID NO: 35742 - DNA, 18527 bp, Homo sapiens
agtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttaaaataagaaggtccgcttattacttttttcatttaaagagggtgtggccacattccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatagttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacaggtgcacaccaccatgcctggctgatttttgtacttttggtagagacggggtttcgccatgctggccaggctggtcttgaactcctggcctcaagtaatctgcccaccttggcctcctaaattgctgggattgcaggtgtgagccaccatgcacagccaaaatatataacactttggaatcaaaagggatggatttatgtctccattcttgccactactagcaggaagactgcttgaaaatagcactcagttttcccagatagaaactgaggataatgattaaaggctattattccaagcaagggttagtcattgctgttactatcattgcaaaactctgatagttctagattgtaaccaggaagatacaatcaaccacaaaactcagcttcctctgtcacaaattctagatagaggtagcctttcatgaggctgagagatggaaaaatgaagcggggggactctcttaggacacataaatatgcaaaaaaattgctacgctttagaaagctatacattcaaatcatagataagctgacattagtaggcagtgcatgttcacaaaaagaccattaattagaagaaatgtgaaatattgttaatttccttatagatttgcctatgtataaatggccaatttcaccgtcaatgagctcatgctaagtactgaaataaacttagttttagagcttatctttggttagttgaaatctgtattgagttagttgaaatctataagttgatagaacaggctctttaaaatctattgcaagctttatacactacaaacaaaaagatagaaaaaagaaaacctttcatgaactcattggcttaggcaggttttcatgcagagtgtaggtattgaagagtcagaacggcttaaggatagaatttggccaatatataaaaaaatatatatttggtatttgttagttgtattataattattcagaagttcagttaatacgtgcagttggctttgagcccttaaccagctgtatgtgataaaatctgtttcctttagagcaatttcttatatcctgccttgatgctcctgtctttaatctttgctaagagctggtggtgaatttggctgaattcagattccgtttttctctaattgatttcttgaagaaaattctctattggttgcttttctttcctagattatgcttttagtctatccaaatacttcaggctagaatgtaggaacttagaagatacaaatcacaaagctgtctcctctagggatgctctctctttcaaataagtgacttaaacaacttatttttgttatcttgtgttatgtaattaatataccttttcctgggctttctctggctttttttttaaatggacattattcaagtattttttagaagtaaaaaaaaaacagtacagtaaagtttttataacgtttattttgaagttgtcagagacacctttaatattagactggacaatatctttagtctttcttttgctttcttttgaagtttttatttgctaattgaaaagaatggaataataataataataataataaataaataataataataaataatataaataaataaataaataaataaaataaataaataataaaaacatgtttttataagtgatggagtagtactttgccaagtgatgaattttaacactcattttgatgattcttccttatcaaagccttggatgaaatgatgaaaatggaaattttgagtgcctgaagctgctagaattgcttttaaagtattgggtgtgccaattaagaaggtggaatatgaaactccatgtggcaaccgcaattgcatgaaactagactgtaatgggaactaaaaccttgtgcaaaattgcgggttgttactttatcaggaagcaattttaagtctatcaattatatttaggaaacaggctgctttaaatgaatggaaaaagtattggttcttctcacagatgacagaatagtaataagagcaatcccatgcgaattaagtggggatgatttctgctttggatattattttcttcatgcattcagtgttattacttgcaactccagttactttttagcaggtgaaaatggaaagagtttgtctgaacatgctgttgaggaatcagtttatggaatcagtttatgcctcatgagtcatttatcttcatatcaagaatttaaaactgccaagattgtcctcccaacctctctcacaaacattcatgagagtagtctctagaggggtgaaacagaatggtgtagatagacagatcagtgtagaccttgagcaaggcctctgaaaaacatccccagactaaaaggatctgtgatggcattttgtgtgtgtgtggccaaaacagagaacacattaattttcaatatacttaagatcttaaaaatatatgtctcattaaataaaaatattgccaagtcatgatagcaattcaagaaatttcctttaagatagagtttgccaaaagaacatgcatgttacaattgcacctctaggcttcctgctacaacaaaaaaatccagtataaaataattcttttctgggttttttgtgttgggtgggaaaatatgtaggactactatttagacagctcaaataggaagaaatgtgaagatagcaattacttcaatgctgagtacttttatatcaagaaatagaaaaggaaactaaattattcagggagaaatatcacctggatatctttttacaattaaaattttaaatctgaattcacttgtacagattggcacaagttattttaccttataaatgtaatcattggctgggagtggtagctcacacctgtaattccagcactttgggaggccgaggcgggcagatcacttggggtcatgagttcaaaatcagcctagccaacatggtgaaaacctgtctctactaaaaatacaaaaattagccgggcgtggtggctggtgcctgtaatcccagctactcaggaggctgaggcaggagaattgcttgaacccaggagacggaggttgcagtgagtcgagatttcaccactgcactccagcctgggcgacagagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttgtaagtagagtgataataaaattatgattacaatattgaaataaaaacgaatataagtaaatggccattaatttatttctctctcattcttagcaaactgtgaagtcatccaaaggtggtcccggatcagcggtgagcccctatcctaccttcaatccatcctcggatgtcgctgccttgcataaggccataatggttaaaggtaacgtgtttcctcaaaacagttccctcctggacatttcagaatggctatttgaatgactgtcaaaaaacagacatgtgcaatggaaagaatctgtttcattttgaagataaaaacatttctttgccaaacgaagatgtaattatttacttaacactgaggaaattgtgttcacatcagtggaatctctattgttacagcagatattactggctcatttctagcagaaattccatgctgaaattaaaagctctgttcacatatagagttgcaactagtatcaaacactgcaacactgagggccaggaaaagttaattgtctcttcctttctcactcgaatgaaatgtcattctcccaagtgcttccttgatatgtagtatagcatcgattttttaggctgatatataatttatatttcttaatttgttaagaagttcttttggagcatctcagtaatgaattattttatgtcaattgatgatgaagaaaattggtgttaaaggctgttggccctttatttccaggtgtggatgaagcaaccatcattgacattctaactaagcgaaacaatgcacagcgtcaacagatcaaagcagcatatctccaggaaacaggaaaggtaagttagagtggtaaatttagatatttaatttcagcatagttatacttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggggacaaatttttaatttgaacgtaaacatcgagattgctgctgtcaataaagaatatggtctgattgaaatgtactaatatttaaactgaactgtttaatgcctaaattttatatataattctactttaaaaataagccttatgtcttttataccaaatatgagtagttttctaaagcaatgaaattagaaaactatataatttcagtatctgattatactgcttgttatttgagaagtacaaacctcaaagattggaaacatgaatatattattttaaaagtaattttacttctgttttctgttagcacacagtcctctgtgttttgatctttgtgatttctcccctgtgtataagattactaaccctatgctttaagaagttattgatgaattcagtaaattttattttaatccctctagatctggaagggtaagataatgtttcaaaatatttggtacactttgtatgtgaagggaagaagctctaaaagatggttgggtttagggatgagttgtacgatgacctaaagtcaggtaatatcacattttttaacctagcatgttacttattggaagtcctgattctaatctttttttttgtagcccctggatgaaacactgaagaaagcccttacaggtcaccttgaggaggttgttttagctctgctaaaaactccagcgcaatttgatgctgatgaacttcgtgctgccatgaaggtaaatcgcccaatttgagcaaactcctttcctcaagaggatgtattgggcaagtcacttatgcttatgttattttcaaaatctagtatagtacctgtcaatcagtgggagtttgaagaataaataaattaatacctcaatgaaggaattaatatataaatgaaaacagaaatgttggcactaacaccttccatgtcatgtcactatatgagtcatatatttgcatttttatttttacccaaaatattgatgataaacttgttttgttttagggcaatgtaatagagcttattgtaattattaaatgttgtgggtgaaatttactaaatgacagagtcaaacaaattttggaacaccaaaaactcattgatcctcttgcatgaagatttttttctacatttatccttttcttctcttcaaatttagggccttggaactgatgaagatactctaattgagattttggcatcaagaactaacaaagaaatcagagacattaacagggtctacagagagggtaagttgtaatgtccaacagtccaaacgccttatttgaaaaggaaatctaatatactttcttaaaattgactgtctatggtaattatggcagctttggaatctccacatatcaaaatgtttctttattgtttggcacatgtctattaaatgctgttaccaggcaacgcttgagttgctaggttgctgacaagggagatggtgtcccaatccgcatcaagcttgcgttttaatagaaaatgttcctctaggataaatggccacatacgattataatggaaacctcaattcagagcattgaatttttaaaaatttctgaaaaacacttttctattattctggaatgtattttataaaaatgtcccaaggtcattttttttgaaaagaatatataataacaaaaaaatctcctaacaaaatgtttttcatttgtccttgaaaaagtaaagaattaggtgcttataattctctgttggaaaccttaactttatcgttatgaacataagagactcactttatctctagttaaattcacagaataaaagactagtcttagcttattttatctctccagtgaagcatctcatttaaatgatgtgctcaacactgaaaagagggtaattgcaagtctcttaccattttcctactctcatttccctgagctgctggctttttggctttcccaatgcaatatatggcatatagaagatctttctgcttgattctcataccaagcatggagaatacaatagcttttgcatatcattttcagaggaatttaataaaagaataaaaataaggaagcttttaaacctcattttctgcaattcttatttaattaccaatgtttatgttagatccatgtgtcagtggtaataatgatgattatttttgtttgataaaacatagtttataaaaataagtgtttatatatttttcatatggccaagatataggccagtgatagtttattacattgcccagtttcaagttgttttagtccgtttgtgttgctataaagaaatatctgagaccaagtaatgtaaaaagaaaggaaatactgtacaagtagtatgggaccagcgtctgcttttgatgagggcctcatactacttctactcatggcagaaagcagacagaagcagatgtgtgcagagagggagagagagaaaaggaggtgccaggctcttttcaacagccagttcttaaagaaactatgaatgagaactcactccgagccattcatgagggatctgcccccatcatccaaacatctcccaacaggccccaccttcaacagtggagaataaattgcaacatgagacttggcagggccaaacaaacaatatgaaaaccatagcactagtcaattataaattcaattattttttcctattacagtattattttatgtagttaagcagaagtgtttacacacacataaatcatcaaactgcattacttataagacatttatagtttttaaactaaataaataatttgcattcaagcaagtacctcattttgttcttttaaacaattattttattcattctattgcttaaattctgccatgttgtatttcagaattaattactaatgtatacctatacaatttattcttaacgaaagctttatgactgtgagttttcaatcacagtattatctaaattgctcccattgcttcatatgaaataaattcaatgatccaaaaatttacctgctttaatttttctcttcttatttaaaaatgataatattttgcaacatgttccataagtcattgaacactgtggcactgtgaattttcaaccaacttagagatgtcagatattcttattattattcatcactggtttactataaaatctatttttcttttttctcagaactgaagagagatctggccaaagacataacctcagacacatctggagattttcggaacgctttgctttctcttgctaaggtacaactcagatactttaggaaatgcctcttgttttataaagactaatttcttagtccattttgtgttgctataagggaatatctgaggctaggtaatttttaaagataaaaaggtttatttggctcaggattctgatggctaacaaattcaagtttgggtatctatgtctggtgagagcctcaggctgcttccactcctgacagaagaggaaagggagctggtgtgtgcagagaccacatggcaagaaaggaagcaagagagagaatggggaggtgccagcctcgttaacaaccagctctcgtggttctcatgagcaagaactcattcccagtgacggcattaatctcttcatgagagatcagccccaggacccaaatacctccctctaggccccacctttaacactggggatcaaatttcaacatgaggtttggaggggaagaacatctaaaaccatcgcaagtaaaatcttgtatctgagctccttctagaaatgagtaatagaatacctttttctcaaaaaatattatttatctgagtttaagataattaagtaaatcatgcaattacatgctagagaagagcttacaatagaatgggatttctttcagggtgaccgatctgaggactttggtgtgaatgaagacttggctgattcagatgccagggtaaggaagtgcttacaaaatactgctgcagttcatcttcctaccttaagtggggctaccacatgatcccctgtgaaagcaaatctaagatcttctgagagaccaatggcttcttaatgttcatttcctgaatgaggcatgtctttctgtagcccccacacacaaaaaagtagtctttgtaagttttcaatatctctcattattcgtaaaaccagagagaactgaagaaggacaatacaaatttgatttgtcattcccaagaattgtttgttaaaaaaaactctgacctttcgttgtactaggtataagaaggggaaatgtaatttttttattatgtgcaatggaaagagtaagcatatttaacgttatttttaacagagaactttggaatggtttatagatgtcaatttatattgtcaaaatattactgcaatgatataacaagagtataggataaattataataatatatgctttctaacatattgttttatttagtttcagtgacattgctgattatttatatgccaaaccactggcaacataagaaaaatcatatcattttaaagcctggaatttccatttaaaacaaacaaacaactaatatttgcattatgccttctcatggaacagtattctctagagaattcattacagtgcttcactaaggatagagatttctttgtgcacccccatccacttctgctataccagtacattatcatgtacataataggcactcatgaactttttgttcaacaaatgcatacatatcagatcaatttgcttgaaaaatgcaaaataatttttacatacattgaaggttttatcattttaatagaaattgttcaagcatattaaggaacaagagttagcatttgaataattgcccataataaaaaattcttatttgcttttgacatttctgaatttgctttccattttaagactatcagggttcttaatatatatttatggaggttacatggattagtgtgacccaagagaatgatggtagtcaacatttcaaagttaataaagaccgcttgtgacaatagggcagggattatatttttcatatataaaagaaaaaaatctgtcatttagtaaggttgatctatttgtctaagattatgcagctttgaaattgcagagtcagaatttgaatacagaaattctaacatcaaaatgcaaggtccaggttacggttgaattattgatttataagtaacatttgctgataattactttgaacaacacagagtaaaaaatctttagagatccccttggagttgtcttactatagagcataatcttaaagcaatttagttcagcaaacatttattctgcaaacatatattcagactctagtgtttacaaggcaccttgagagaaactgtggaagatatttgacaaacaaaataaggtccctatctttaaagaacttgcaatcttattgttgactactctgattgtattgggcacaaagcgattgcctatataatctttgacaaggtctaacattattgtgcagatatcatttcagcagatagtgaagtgtttacttttgtgtttcttgacaggccttgtatgaagcaggagaaaggagaaaggggacagacgtaaacgtgttcaataccatccttaccaccagaagctatccacaacttcgcagaggtaacaataaatttctttttctggaatctgtttatggaagatgcaattttcttttttgatgacaaataagagaaagtaaaaacagaaccctttttcaatatcactcctgtatcaaacagatacagtgttcctgacccattgttatttgtcaatttgtccaattttgtacagccgctactttatcatatttaatacattttgtgacttgggcatgtggaacataattttgttattttcactgcttttactcccctaaaagatttggaatatgtgtgggaaaagacatgcataacagaacaaatgaaattagaatgaagaaaaacaaaaaaaaaaaaacaaaaaaccctcagagctaaatgaagaaagaaatatgtaggtgctttggaaaaacaacaacaagacaaaactcagaaaaagtcctggcctttgagtgcaagatttagctctgggcctcttggaagtgaaggcgatggaaaagttatgacaattaccaaagttcaccatcttataatagtatactgatttctactgttaaatgtaagagaaatttagtgcacaggtctttatataagggaagatccatttgctgtggctcttagaactgctgtaggaagtgctatagttgtcaatcacatgccgtttctaataactgtcaacatttgcaaacatttcgccaaaatatataggaataccaaaatggccaggtaagttacattcctaggagaggatgaagtattcacgttatgattaattgggtatattgctttaaaaggtgtagccaaagttgttattctaaaaaattctttgagtcagttgccttgattttgctaaagctttctaaagaaaaggatgttttgcatgtatcttagtttgaatttaatattcagtgtttcagaaatacaccaagtacagtaagcatgacatgaacaaagttctggacctggagttgaaaggtgacattgagaaatgcctcacagctatcggtatgtagtccagcagttgaaagagttttctaactagaaattgtattttcaaagctatcctatacttaacaagaacaacagcaacaaaaccaataaaagaaaacaaaaaacaatcagaagtagtgcatctgtttcaattgaagcaacgtaaaagattggcaaagtactataaccttaataacaatagatattattccccttttcaaaaatagagagagatagactatacttattgagcacctacttatatcaaacaatgtaccaggctgggcacaccacagaggcaattcagaatggtcactgagagcatgggatctggaataaatgtaacatctggataaatgtaacttcaagtcctggtctactgcttgttaattgtacaatcttgggcaggtccaggagagtctgattcagtgggtccgagttggcctctaaaaatcggtactttttaaagatctcccaggttattcagacaaccatcagggttggggaacctatgttctcaagcagtgtttctcattcatgactatgcacttgaatcccctggaaagcttgttaaaatgcagattctgattccccaggtctggggtggagcttagattctgcttttctaacaagctccccattgatgccaatgctgttggtccatagatctcgacaagatgaagaacactatgaactggaatgtgctagtattatttgggttctgttttatatttaagcccatcctatcccagagttttttcttcatttattcatttatttttacttatttgtttgtgcaactcttactttagacacagaggtacatgtgcacgtttgttccatgggtgttctgcactcaggcagtgagcatagtacccaataagtagttttttgaccaatgccccttctctccctgccctctctagtagtctgcagtgtctgttgttcatagggtgttctttttaaatgttcttatagtaacataaataaagtatttacataggcttgaacacctagtggcttctccactcccaaggagaatatatgttggatagcgcaaactactgaagttgctcttgagatgtatttaaggtaataaaaaaattgatcgtcagggaaaagaatattcaaaaccaccatctagagagtcacaaataccttctcagaagttaactgccctatattgggagatgagaggtgaagaatgatgatgagggatagaacactgttggcaaaattctatatttcctgtttctttcatatggatatttcatttttttcatggtaaatacatcaactaaaattttcttctctaacagtgaagtgcgccacaagcaaaccagctttctttgcagagaagcttcatcaagccatgaaagtatgtaccattctacttatatgtcctgcttagaggaagaattatttgtagaaagaacagaaaacctcatgttgtttgaaaatctcacatttaatatcttcccattaatgagaatcattgttctatttgatgaaagaggtaatacactaccttctcagaataaacttctgttagattcggtgcttttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaagttatcttccttttttctttgcagctccaaaataaggaggttttcagagagagagagaaagaaagatctaactatttgaataatatgaaggaatattttgaatatatatgaataatttgaataatatgaaatgatagacatgctaggtactgctctgtagtggttagcatagttgctgccccctttctgccatagtctagtgtgatatttcgttgggtaatgatgaatacctggtgccatggaagagaaaagtgggacatatactccagactttggaaatccaggtagcattgctgtcagctaaattaacacctgaagtttaaatagaaatgagccagatgagggcaagagtggaagagatggggataaagcaagggtggtccaagaggaagaagtaacccacacacaggcttgaaggcaaaaggtaacataaccttctcaagacagtaagtatagagtgatggtgcacactggaagagatggtagaattaggcaggatattgtaagccttgaaaaagaattaggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactgggtacatttttcaactaaagtcatggaaacatttagtttcccatgcataaattcagcaagcagaatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtcatattggataactaaaatctacccagaaaatgtgagaaaattacaggcactatacatttctcttcttctggtgagtgaatcaggtatctcctcacataagatatgagattatattgtgttatacttatttaattttgtgtgatatttcattcatagaaaataatggcactaatataaaacataattaattcagaaaagtttgtaatctcagtcttgaaggctattgcttttttatgcaatgataaaaaatcagttatctgttgtatatattgtttaattaagtgaatggtaatgtgtaatctcatctacagctaagtctaaaaataattcttctataagtaaaaaaaaatagagaattatggtttcgactaacattaagtatacctttttttgaatcaacaggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 35743 - DNA, 25585 bp, Homo sapiens
gaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttggtacgctccaacttctgagtcgctcccgcagccgagaaggggccggggtatgcgagcttccgcagagtggggaggggccgccagtgcgcgccacttttcgcctgtccgggcactgcgccagcgcggggcggcccggaggcggggtcgcgtctctgcgcctgcgcggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgagggtgagtaacagggatccgggcccttcacggtctccctgacccccaggccgtgagctcgcggccacgtgcgagccgcgaaactctgtcccgcctccctgcagcagcgcctctaggcagccgcgcgggcgcacacgtggcccaggcgctcccgggcctccccgaactttactgcctcggggatggggagaaggagcaaagtagaggagaacgagaaatggccaaggggtggaaaggtgcctggaagtattatttataatcaatagctattgcaaaatacaagcaaatcagtcttgattcgtcaaaacctgagtcttgctttgcccgttaggttaatgacctttctaagaaggttaataattgaaacttttgaaagacctgtctagaggccgggcctggtggctcacgcctgtaatcccagcactttgggaggccaaggcgggcggatcacctgaggtcagtagtacgagaccagcctggccaacatggcgaaaccccgtctcttactaaaaatacaaaaaattagctggacgtggtggcgcgcgcctgtaatccccagctactcaggaggctgaggtaggagaatcgcttgaacccggaggcggaggttgcagtgagccgagatcgcgccattgcactccagcctgggcgacaaagcgagactccgtctcaaaaaagaaaaagaaaaacctgtctagggggcgtgtgtgtaagtagtctttgatgccatggtgtgtgtgtgtgtgtgcacgcgcgcgtgaagtagtctttgatgccacgatagcttggggtgtgtgtacgtgcgtgtgcgtgtttaagtagtctttgatgtcatgggtgtgtatgtgtgtgcgcgcgcgtgttgaagtagtctgattccatgatggctggggaggggggctgtttttaggtagtctttgatgccatgatggtgtgtgtgtgtgtgtgtgtgtgtgtgtgtgtgtgtgtgtgttcgttccagtagtctttgatgccacgatggctttgaagaactccaaaacctttaggcaaaaaagttgcactatcaggaaagattgttcttgctatttatgctggaaaaaaacaaatgctggttttttccacacacccagttgctatatgtatagtgaggcaaattgcttttgtggctgctgggtacattcttttccacatagaaagtaactgaattcagattttaaaaagctgtagactcaggccgggcgctgtggctcacgcctgtaatccccagcactttgggagtcccaggcgggcggatcacgaggtcaggagatcgagatcatcctgaccaacatggtgaaaccccggctctactaaaaatgcaaaaatttgctggacgtggtggcgtatgcctgtaatcctagctactcgggaacctgaggcaggagaatcacttgaaccggggagtcagaggctgcagtgagccgggatcgcgccactgcactccagcctggcgacagagagagactctgtctcaaaaaaaaaaaaaaaaaaaaaaaaaagctgtagactcagcaaaaaagattcagatgatattgagtatcaactccctagaatcaaggcaaggaccagaatttttcttgcaatcatggtacctgtacctctaaaatggcaaatctctaaaatctttgctcttccacttctttccatttgtgtaccgttggcaggttgatttttcttaaatgtcacttttatggtctctaaaaggcaaaagtggcaacaaaggcaaaaatggcatctctagagatgttaaatccagtctgtccagtctgaaatcccttttcattcaaatcctgaatactgctatcccttctacctcttcagccctaactttgatttttctctcctgtgaatccttagctatgttccagtcaggttaattcaccaaagtttgtttttcattatatacattttatttatattatttttcccagaacattgctggctaatggaaatataatgtaaatttgtcttctataagccacattttaaaaagtaaaataataaaaaaaactggtgcaatgtgtttatatatatatatatatatatatatatatataaaaggttttttttgttgttgttttttgtttgttttgctttgtttttgaaatggagtctcgctctgtgtggcccaggctggagtgcagtggcaagatctcagctcactgcaccctccactttccaggttcaagtgattctcctgcctcagccccccaagtagctgggattacaggcacactccaccacacccggctaatttttttttgtattttttagtagagtcagggttttgccatgttggccaagctggtctcaaactcctgacctcaagtgatctgcctgtctcagcctcccaaagtgctgggattacaggcgtgagcccattttaatatattttatttaaccctatatacacaaaatacatttcaacatggagtcaagatgaaaaattctttagatattttacaattttttatatcgaatgcagtatatattttaacaaatgacatttcaacttgtaatagccacatttctagtggctgccttattggacagcagagtcctagaattttcttatcctttgtgtaaattctgtgctttcccagactcttaaatttcaattccatgaatcattttcagtcctcatcaatctttccagaattcatctacaaatttgtagcaaccattttggtacttgcagggtatgtcacgtatggttgtttcttatgttgtttctacccattaattcaaattccttccctctttaatgactaagtaatacagattcaactaaattaaggggaggggcattagatacaaactttgcccgggcttactgcatattaatatatataaatgttaatttctttatctgatctgggcactgttttttttgtttttgttttttcttgagacggagtctccctctcttgcccaggctggagtgcagtggcgccatctcagctcactgcaacctccgcctttcaggttcaagcgattttcctgcctcagcctcccaagtagcaaggattacaggcgtgcaccaacacatccggctaatttttgtaattttagtagagacaggattttaccatgttggtcagcctggtcttgaactcctaacctcaagtgatccgcccgcctcggcctcccaaagtgctgggattacaggcatgagccactgttcccggcccactgttctttacccttccctctcttttatcctccatgatgaattctcaaagctactatcttaaatatcttgcatctttgcccactactctttccttagaccaagacatttctttttcttttcctttttttttattgagacagggtctcactctatcacccaggcttgagtgaaatagtgcaaatcttggcccactgcggcctcgacctccccaagtagctgagactacaggcatgcaccaccatgctgggctaatttttgtttttttggtagagatgggattttgccctgttgcccaggctggtcttgaactcctgagctaaagcaatctgccctccttgtcttcctaaagtgctgagattacagatgtgagccactgcacctggccagacgtttcttgttcaagttactgcaacagcatcctaactggtcttccaagctctagtttttgttcactcaccccttcctcccttcattgtccatacagaagccgtaatgatctttccaaatagcgttttgctttagcacttaaaagccttatagctcttcttgggttaaagtctaaactcaatcagcatggcttgtgaaacaagaaggatgtgtagcaaaatggaagggaagttttccaggcctaggaaagaagagattgtcagaagctaggggaagattgtataagaattaaagatgttggagttctagataggaaatagacaaataagagtttggagcagtaagccagggctgtatcttaaagggacttttaaaccatgttaatgagtctagacattacattagggagggtagagattcatcctctaaattaggtgccctacagtggcaactgttaactaaattacaactactttgtttaatggttacctccactagctggtgatgtggcccctgtccaactcttaagtcttgtctcctgccattctttagctgcagcccccaccccttcccctgcccaacagcaatgtacatatacccagagctccagctccaaccagactgaagttctgcaatccactttgaccaccttgtatttattcatcaacactacctacccctttctctcctttggctaaatttcgatgattcttcagatttcaacctgtcactttcttgtagacttctttttctaatgtctagactagtcccatagtctgtatttattgcattctattattatgatgtcttatttaatatcagctcccctcagactcaggtctcttgagagcaggaattattatttactggtacatcccttggcacatggatacaccgggaaaatgttgatactgagagtgttgtggaagtatgagggttgatttctctctttcgaaattttaagttcctaaacatctgttatctttactctttctctaaatcatccttttgtgtacttcttaggttttgtgaccagcatcaaaattggattcctttgtgctcacttcctcacaatttcttacaactgttagtgaagagaaaggattaatgggggcagggacaggattaagaaatagagagggatgcttccaaatgtgctaacttcaatgggatggcatgcctcctcttgaatattaacttgaaatcaagaaactcatctggctgaatgttcccattttgcctacaaaaaagcaaatatcagcaaaaatcgcatattttttcctgcaagatagtttagatactatactgtgagtgtgtctgtgaaaatactagtatagttacattactttaagtgggtcttaattaattttaattctagttcagttctgctatgagaggcaggttaatagtggaaagagcacaggatttgatgtcagaggagttaggattttatctacctcttatatttcctaactgcatgaccctcaacccttttgatttctgctttactaatttctacaattatttatgtaattaaaattcttcacaagatcatgtgaatcaaatgtgatggtatgagaaatacattgtagagtatatggttttatacagatgatttaatttttattaatattacttaatcactgtatatttacagattaattgttctaggtgatttagtcttcagcattcaggaagtttctgaattttggtctatttccattttatttccacagtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtaagcagctccctcaaagtctcttctctcaccttctctggtaagcatgtcgatgtctttcatgtgaagttggcattaatatgaacaacttgtttgcagatgtctcaaaagctaagtgaatttaaatcaaaccaagaacccttaaacttcactataacaccttatttggtttgggattattagtatcattgaattaaaaggaatcttaacaagtttgctgtaatctttatctggcacatgcactctctgtgcagcttacctctccaaggccatcttcactttaaggaatttaactatgaaggaaacccattttaatgttaagcagttctaacatgaagaactgaaatttactccctgtaattctatacaaatggtctttgttctgcctctgggagataatacagaatttcaaattcctcttccacttgaaagccctgaaaagtagttgaagacagcaaccaaaccttctcctcctgccattccccaagtgagatatttgaactaaaaccccagagcgccctcctgttcaaaaactgaatgaaggctctattttcaatagagaaatagattcaaaagaccaaatgaagatcagaacattgtgtggtgggtatttgaagcaaagggaaggaaattaggataaaggggttttctgcagggattcagtcagttgctggttggtctgtagtatatgaaatttcagctaggaaaagatttgaactcttgccacacagtgtaaatagcctcattgctttggatcattcaacctacgaaaccttacctatgaaataaaagctttttctttatcattcttgccaattctaattttataatttaataactttccttacttttaattccaatattcccagttgccctttcatttcttagagtttctggtagcactaatctttcttaaattcaacaggggatttaatgcttttgttttcagttaagttagatgtacgtgccttccacaaaataacaaggtaatgtaatttaaatacattgtcagtgcattcttggcgtagttttgtctcttccaaagtatcctatttcacaattttgattaatgtgaaaaagatttaattgcaaacctggattgtcatctacatcataaattcctctatgctgtgaaagtgagtgtattgctgtaaatttaaaggatcttccagagttcctaagtcacagaatctaagatttttatttcaaggtttcttgattggtagcttcccaatgactgaggtaatttctaaagagagcatcaaattaattttgggttccttttgcaataccgataagtgttccatctatttatttattttatttttttatttattttaagtcagaatcttgctttgttgcccaggctggagtgcagtggcacaatctcggattactgcaacctccatctcctgggttcaagcgattctcatgcctcagcctccccagtagctgggattacagttataggtgcacgccaccatacccggctaatttttgtatttttagtagagacgaggttttgccatattggccaggctggtttcgaactgctggccttaagtgatccacccgcattggcctcccaaagtgctgggattacaggcgtaagccaccacacccggcctgttccatcgatttttttttttcttcccaagttttaactctccccattcacttaaacattttttaaagtgcttaactctttaaaatgttagcagtcagaagattactttctgtgtacccttggtagtttcacatagctacaggattatattaagtaatggaagataaagcctgactttttatttgcttatttagtgtattttctgagtgtatttacactcatcccattatccatttccagaactttataacaagtaaattagagtgactcagttgtgttatgtttgtccaggactttctgctttaattctgaagagtcctgtgatcaggggaacagggaaggatggttacctaaatgaaatactccaataattatctttaaactactttatttggcacttaacatagctaaaacttaactggttcacaggaaatgttgaaagatattttccagattttatgtctagtactatgaaactaagtaaacctgaattttttaaaatttctaaacagactagttttagggtacatattaggaattccattaaaccttatgtaatttttacttgcttagtcaaataaatgccttatctagttggccatcagtggtctatttaaaactgttttctttacaacctgggttgtgttccaaattaaggtagaaagtagagaggaaagagcattggaatgagaatcagaaaatcaggattctacttttctcattgtcactcaggaacaaactgtaaaggactatataaataagaagtaatctttttccgtggaaatagtataactgtgttataactgtgttatacaatttgtggatttggttttattacttaaaaattaaaatctggccttcttagtgatgatgaaatcccaatttcctcacagaaactcactataattacattaagtgtaatactagtatatgaagaacggtactacagttgctaaaccacagatgggcatctggaccaatctaaaagagggatggccacggggacatatgtattagctagaattactattctagctaatatatgttcattgtaatccagagtgtgtcagtgacataaacattttttagtaacctgaatgagagttttgagctttgtagacaactaagataaacaatgggaatttttttctcaccatgcacagtcatggaatttgctttcatatttagcagtattagaagccatcattatgtcatctaaactgagtctgttttagaaacttttagggattttttgtgcagagatgattactgtagcttcattatgtgcttttggttctccttgggattggcggggggatctctctaagacgaagttatctttatattaaaaacaataaaattggatactactgtgtccagcttggtagacaaatgagcaaatatgtgactaatgattaacagatctaagagagaagagctcttgaaaccaaggatgtagttaccaccccaagttgagaattgattgaagtcacctgtctatccatgagcctgatcattcattaaaagttaaacaacagattgcatctaatttttttttaaaggttaaaatgacagttttacttcccctcttttcattttttccttagggtttctgttcatgcaacataccacaattctttctttttttcatttgagtcttacgagtcagattcaaagagagggcagaggaaatagtgtagggtttggacagtgcgtttcaagtccaggctccattaccaaatggctacatgacctagtgtgtgaaattacttctttgagcctctgtttttttcactgtaaaatgtataaataataatacctacttcaaggccaggcgcggtggctcacacctgtaatcccagcaccttgggagactaaggtgggcagatcacgagatcaggagttcctgaccaacatgatgaaaccctgtctctactaaaaatacaaaaattagccaggcgtggtggtgcacacctgtaatcccagctactcaggaggctgaggcaggagaatctcttgaacccaggcggcggaggttgcagtgagccaagatcacgccactgcactccagcctgtgtgacactttgtctcaaaaaaaaaccaaaaaaacaaaaaaacctacctcaaaattttatgcacagttaaatgagacaacatatataagacacttagcacagtggaggatttccataaatagaagctcccttcatgtacagatacacatataacagcaaagatccccaattctttcctgataataaaagttagactagaggattaggttgggattggaaatagtaatgcaggctgaaaataagcattatctcaaacccatgtaggtttccaggagatattttaaatcatgttaatgctgtagcattactttgtactgtgatgtaataacacttccaggagaggcaatacagcaaagtggttaagtgggcggctcctagagacagggtaggttggaaatcctgctatacctaatactagctgacattactactgtgtcttagtgtccttacctgttttgttgatcttaatagtatcttatcaaatgttatgaggattaaacaaaaaagatgtatttaaaatggttggaacaatatctgccataaaataggctcctgatattttttaaaagaaaattgtgataaatacataaaatttaccagtttgaccatttttaagtgtccaattcagtggcattatgtgcattcacaatgttgtacattcatcccattatccatttccagaactttttcatcatcccaaacaaactgtgtagcattaaacaataactattcctcccactcctcagcccttggtaacttccattctcttttctgtctgaatttgcctattctagttacctcatataagtcaaatcgtaagtatttgttcttttgcattttgtgtttttcatttagcctagtgtttttaagcttcatccatattatatagcatggatgtatcaggaatttcgttcctttttatggctgaacaatacattgtatgtatagtcatgtgctgcttactgtttgagtcaacaactgaccgcatctacattaaataaagagaaaaattacacttatttttgatagaggttctttgttgcttgtaaagggtagagttttattgtgcctcagatctacctttttacatatcatttcaataccttttttaactttggttatcaatatgtaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggtaattatcttatgcctctgttttatgtcttactgtaacacggcaataaatttataattagaaactctaaaggtttaaatattcaagcaaagtttttgatattttgatattgcaaatgtcattccaaaatttgtcttatctagttgccaatgtcaataatgtacacttccattaacaatgataaatcaaattttaaaaagaaagcatctgaaaatcttacctttgaaccaagatgactaacaggaagaagagaaaagtaacatttagttaatttttttaaaatttagttgaaatctttttatattctaatacaggaaaactatactaacaatgtctcttgtaagtgaaaatatataaataaaggttgtaagaatcagtggttatgaattttgtaggctttactgcttttaaccatcttgatttatgctgttaagcatagatctgcttgggaagcaatatcagtcttgctttttaatcaatgagttatgtaacttgtgtgtattatgattatatagatcaagaatttataaagatattgtcatgtaaagttgggacactgctgagaataaaatgaaattatttcatttttttcacttacctctttgtctgaggtctcttgaattatcaaataatgtccctaaaaaattatagtgctgtataaattctaataaaaagtgaggttgggaggttatgagaacggtggttttggaaagatttgattgattaaaatgtgctttggccttcctgtcatgtctgatgactgttattaaggaaaaacaaaaatcacaaacttaaattctgtttaaattggtttatagaggttaaattctttgaaatactttgtgacctagaataagttactcacctaaatactttgaattttaaagtgctattgagagtaaacaaattaagagtaatagttttttctgcttgcaggagctaactaggaaaaaaaagaggagtaataattgctttgaattaaggagtatcgtaaacaaaaaatttctttagatgtctcattttgttgcccaggctgctcttgaactcctaggctcaagcgatcctcctgcttcagcctcctaaattactgggactacagtgtgagccactgcacctggatcaaaatttcttttcttttttttttttttttttgagatggagtctccctctgttgcttaggctagagtgcagtggcgctctctcagctcactgcaacctccacctcccgggtttaaatgattctcctgcctcagcctcccaagtagctgggattacaggtgcacaccaccacacccagctaattttttgtaattttagtagacagggtttcactgtgttggccaggctggtctcgaactcctgatcttgtgatccgcccacctcagccccctaaagtgctgggattacaggcatgagccaccatgcccggctgtggctaaaaatttctaaggagttcatgctcaaggtgaaaaggatgttggtttttctgaaaagtttaaaaattttagattgaagttaattgtactactatactttattcacaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaaggtacagataaaacaagtacagataaaacaacaggatttgaaagtaaaggttatagttgagagatgctttcataaaatagtttttgaaaactttgttgacatgctgtttccagattgaatttggtgttgatgtaaccaccaaagaaattgttcttgctgatgttattgacaatgattcctggagactctggccatcaggagatcgaagccaacagaaagacaaacaggtagataatgcttcaggtttttttatcctttttgagatcaagctgagatagaggagaaaggagagatgaggggaaaaagcaaattattgttcctaatgatatgaacctgttttgtggattgctgtttatttttaaagataaatgtctctggtatcctaatagaagaataataggaataatactttacatttataaagcaaatttctcatctgttatcttaataacattgtcacaacagtaacagcaagtattatctttgtttggctaaatgaaaactaagggtcttaagaggatgggtatcttcacaattactagagtcagggacagatctgggactctattccaagtctcctgcatgttaccaggccacatttctgctcctatataaaacaacagacacttctcaaaagaagacatttatgcagccaacaaacatgaaaaaaagctcatcatcactgatcattagagaaatgcaaacctaaaccacaatgagataccatctcacaccagtcagaatggctgttttaaaaaagtcaggaaacaacagatgctggagaggctatgaagaaataggaacgcttttacactgttggtgggaatgcaaattagttcagccattgtggaagacagtgtggtgattcctcaaggatctagaaccagaaataccatttgacccagcaatcccattactgggtatatacccaaaggaatataaatcattctactgtaaagacacgtgcacaggagcagcactatttacaatagcaaagacatggaaccaacccaaatgcccatcagtgttagactggataaagaaaatgtgatatacacacaccatggaatactatgcagccataaaaaagaatgagattggccaggcgcggtggctcacacctataatcccagcactttgggaggccaaggcaggtggatgacaaggtcaggagttcaagaccaggccaagatagtgaaaccttgtctcaaaaaaaaaaaaaaaaaaaaattagccaggcatggtggtgggcacctgtaatcccagcttctcggaaggctgaggcagagaattgtttgaacccgggaggtggaggttgcagtgagccgagattgtgccactgcactccaacctggttgacagagcgagactctgtctccaaaaaaaaaaaaagaaagaaaaagaatgagatcatgtcctttgcagggaaatggattcagctagaagccatcatcctcagcaaactaacacaggaacggaaaaccaaacaccacatgttctcactcataagtgggagttgaacactgaaaacacatggacacagggaggggaacaacacacaccggggcctgttgcagggtggggagcaaggggagggagagcattaggagaaatacctaatgcatatggggcttaaaacctagatgacaggttgatgggtgcagcaaactaccatggcacatgtatacctatgtaacaaacctgcacattctgcacatgtatttaaaataaaaaataacagaaaacaaaattagagcaagaccctttctatacttaatatataaaaattctcaaggcagttaattgtagttgctagtacagaaaacacttaaccttaagtgaaaataaaagtatactttactatggaactttgttagtttaattcaggaagtgaaaagatgcattttcagaagtatcccttgctatacaaactcttcataatccctccccaaaactcagaaaccaaatagtttcaggtagcaagagatacttgttttctaaactttctatcttattttctagtcttatcgggacctcaaagaagtaactcctgaagggctccaaatggtaaagaaaaactttgagtgggttgcagagagagtagaggtaaaccttctatagtaaaactgtatgtattatgtgtttttcttctaagaaaatcttgtttcaaaagaaaaaaaaatgggagagtatagtgcttttcttttcagtgactttgttttttgttgttgttttttttgagacggagtcttgctctgtcgcccaggctggagtgcagtggcgccatctcagctcactgcaagctccgcctcccgggttcacgccattctcctagctcagcctcccgagtagctgggactacaggcgctggccaccacgcccagctaattttttgtatttttagtagagacggggtttcaccgtgttagccaggatggtcttgatctcctgacctcgtgatccccctgcctcggcctcccaaagtgccgggattacaggcgtgagccaccacgcccagctcttcagtgactttgaaagtgaggaacacttttaggaaatgtatcagctgggctatccttactaggatactggaactccgtgctgttaagctggccaatacatacctcccagatcctgttggggaaacctggaatctgtctcctccctaccccgtaggagaaaccttatatttcctactcacctgcactgctagtcagagttccattagcatgggatggatggaactctgtgtgactttaaatattcctttaagttttatggtattactataattctgggagttgaatggggtttgtgattatgcaagggtcataatcacatttgagaacattattcttataggaatatatattttgagttacaagcaattaacttacaaagacttagaacatgacttctgatttggctaatcataccttaaagcttccattaaacaaagtgcactaaaggtcttaggatgaaatattttgtattataatttcctgaaaattaaaagattttgagtatctttactgtttattttaaataatttgtctgataaaaattgaattctttaggtcttgatgaagaccactttcctttatatattgagatttttaaaaataaatcctgtctttttgttgtttgtctctgtcttaaatttgatctgttaagaaagaaaatattgggcccagatataattttactacaaactctagctcatttattcatttttgtttttatgttcttttcatatccacgtattttttcttcagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggtaaaccacaagtaatatggacatttcaggtatttctgattttgctaaaagtaattacacactttagactaataatgctgaaaaaagagctttgtcagttttctaagggaaaaacacatgatatactaggctttctttttttttgagatggagtctcactctgtcgcccaggctggagtacagtggcgccatctcagctcactgcaagctccacctcccgggttcacaccattctcctgcctcagcctcccaagtagctgggactacaggcgcccaccaccatgcccggctaattttttgtatttttaatagagacggggtttcactgtgttagccaggatggtcttgacctgatctcatgatccgcctgccttggcctcccaaagtgctgggattacaggcatgagccaccacgcctggccgctaggctttcttaatactcacctccaaagagcttaaggtattctagaagcttagaaaagaaaggagcagggagaaataattaaaaatgcaagtatgaaaagaaaacaaagactagaatgatgagaacctctggcatccttacctggtaagaagcccctggagcattgcttctaatatactccaatagaaaataggcccccacagttacaggaggcgggaggttaaaatagccggttctcccgggaatctttagttgccaccctttcctgggaggcagtcagataggaaattaaagaacagtttcagaatatagtacataaaaaataatggtatagcagtgatctaaaataatggagccctgggtttacaaccaaatgtttctcaactggaaaaaaatgttgattatttcgtgtacaggttgttgctatggaagtgtagttactaattttgggggagtgggaggttgggggaactcagactcctttgatagctaatgaattctagaactcttttcagaaaattgcaaatacatacaattttggattctaggttaacaaatctctgctttaggaaacaggaggataatttataaatttatcaaagaatgaattgcttaagagattatgttaaaaaatgtatcaaagggccttaaaatttgggggacactatattaattaaactttccttcaactcttgtttgaagacgtgtccctaaacccctagtttatattaactggttctccctgcaccagttgagggaccacccagtcaagaaagacacctgttcagatggtgtcattcttcactttggccagcctatacagcaatagaagaggcctatgagctattccctcactgacaccctgctatcccctttataatgtagatctcaaaaacaaccaaaccgattccagctactttattacttgacttatagtaagtggcagagtaaccttatgttttgaatatatgtgtaataatagtatcttttatgttttttcagagaagactattcaaggacctcaagtaattaaaacatataggccttaaaccaaaaaaaaaaaaaaaccctgtctttaaatctgttttgaatgtttagcataattatactcttgtcatttccctaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtaagatacattgaatttttaaaaactgttcattacaagcatttaacagatgcacaacagtagacagaatagcataataaaatctcatgtacccatgacctagcttcagcaattaacatcttgttgtgtctacagccatctcctgctggattattttaaagcagatcttagacgttatagtaatttatacttaagtatatgtttaagtaatacaggctctagtttttaaatcataatcatgatattgttatagaacaaaaggagcccactatctgatgcattagaaaccagtactatctaagccaccaggtttttgagaaagaaaggcttcctctttcaagttgaccaacaaggagacatgagtccagctcaaatctgtgctggctttaaggcagcaattttattagaaaaggtttaggggatagattctgggattagtaggtgattggtggaaggaaaggggaggtctagaaagtccttgggcatgtgcagttatctcttcatgttatttcatggatcacgtgtgtaaatttgggggagttagaatgaattgtggtggaaattgggcctgtgacatcagtaagctggttctgtgcagactctagttggccatattgtttaatctaccattctgcaaactcaggaatttctgttagttgttggtatcttttaactcttggggacacagtttcaataccatattcacacctaagaaagactagtggtagtttcttaaggtataatttttagttggggtccaagttttctaattgtctcatctgtttgttcagatccaccacagtccttatattgcatttagttgataatctcttgattttttaaatatataacaattcatcctccctttttccctttcattttttcaatagaattttctatattttggatttggcttcttacatttctaggtggtggtaaacatgctcttccattccctatattttctataaactgatggtgagatctgtaataaaatcaagtttagatatttttttcccaagaattcatggtattgatttttttttttaaagtaaatgtgatcatgttacttctgtagagagaatacaattttattcttaaatattggggataaggctgggtgcagtggctcatgcctgtcatcccagcactttgggaggctgaagtgggcagatctctggaggtcaggagttcaagacctgcctggccaatatggtgaaaccccatctctactaaaaatacaaaaattacctaggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaattggggataaaagataataacataaggaagtccccttttggctgatggaactggatcacgtaacagtgttgtggttcgttcatcatagtccaagatatgatctgatattctgcagtttatgagggtcaatattgtttcagtaggagatttgctttattactaaaatccctaacttttctcatatctgtatatatccagtcttgatatgtgtcaagtatattaagtctttgagccctccaacctggtccagtggactggcttctctctaggcatcctgtactgctgttgtcttaggatccccctttaccataattttggagactcattttgcctttctctaggcttggatctcccatgttttccccttacttggtttatttttattttgttggagtacattcttgaacttgggggcaaaagaatacaaaaggtaaattttgataccttgtgtatctaaaatgtgtatattgaagccctatacttgatagtttagaaatagaatcctatgctgaaaatcattttgctttggaattttgggagcattattactccactgtctcctagcatccacagttgaggactccattgcttttccaccagtctgattctaggtttcttatgaattttgtttctctctggaatctttcaggatcttttgtctgttttcattgttcttaaattttacacagatgtgatgtgctgagtctgttttcattatggactttcggtgagctcttttaatctgaaattctgatttcttagtccccattttccttgaattatttaattttcatacccctccatattctctcttctcatttttgaatttgaataaatttgggcttcccttgatttctattctacttgtttgtcttgttggtatactttctggaatatttcctaaattttacattccaacccttctattgagtttttcttttttttcttgagacggagtcgggctctcttgcccaggctggagtgcaatggcgcaatctcagcttactgcagcctccgcctcccaggttcaagcggttctcgtgcctcaacctcctgagtacctgggattataggtatgcaccaccacgcctggctaatttttgtatttttagtggagatgtggtttcaccatgttggccaggctggtctcgaactcttgacctcaggtgatctgcctgccctggcctcccaaagtgctgaggttatgggcgtcagccactgtgcccggccttcattttggatacaggtgttttttgtttgttttgacacagggtcttgctctgttgcccaggtgggagcacagtggcatgatcatatctcactggacccttgaactccccgggctcatgtgatccgcccacctcaaactcccaagtagctatgactacaggcccacaccatcacacctggttaatttttttactttttgtagagatgggcactccgtatgttgtccaggcttgtcctgaactcctggactcaagcaatcttcccacctcagcctcccaaagtgttgggattgggtaggaaccactgcctctggggtttttttttttttttttacacaatgtttttatatttcttttggtttttgttttctgggtttttgttgttgttgttgtttgtgtttgtatgtttttaaatttccaaaagctcttttttgttctctggagatgattatagtctgttgcatatagttactttcttcagctgtctggtaatccttggctgtttgcgcttttaagagtggaatactataaaaaacaattggaaacttcaagtgggtggtccgtgtcaaaattgggcttcactgtggggtgtatctggtagggattgttcttcaaacaacccctcacattagtgtctaggtattttcttaagtgttgaccagaattactcagagaacaaaagttgtctgtgcctggcgtcccctagttcaaagacgccaagactgaagtctgttttaccttcagaaaaattaaaggcctggcttggtggctcatgcctataatcccaacactttgggaggcagagattggtggattgcctgagctcagcctaggcaacctggcgaaaccccatctctaccataaatacaaaaattagctaggcatggtggcacacgcctgtggtcccagctacttgggaagccaaggtgggatgatcactggagcctgggaagttgaggcagcagtgagccgtgattgcaccactgcactccggatgacagagcgagaccgtgtctcagaaaaaaataatgtttaaaaagaaaaaaattgctacagtgctttaaagaggcagttactcaggtagatggagtggggaaggagatttgaggacctagcttcttcttagacttcgagtcagtcatcttcttcttagtccctattcccttccaaaggtatctggtgccactaatttagtcagtcaccctttgggggagttctgtaatgtcagtcatgttgcttctcatctttccctgctttcagtttagaattaagtttttttttttttttttttttaaatggagtttcgctcctgttgcccaggctagaatgcaatggcgcaacctccgcctcccaggttcaagcgattctcctgcctcagcctcccaagtagctgaaatcacaggcatgcaccaccatgccagctaattttgattaagttttcttggtctgctaacttagctaccactgtgtttgcctttcagttgccaaaatgttactgctgttatctggccttgtgtgttcatgcctatttcctttactgtttttataggctctgagaattaaattttgtgcctaagctatctttaacaagatgtgattatacaaatgtctcaagctaaaaatcagcggctacaaataaagctgtaaccaaatttatgccagaggaattgtatagatacccatggagcttacaaaaggggagcatgataagcaaaaaattggcagtttttatagtagtgttgtttcaggagtgacaaataatctggaagacttgtacataatgatcactagaattggggataatcttttgaggagtagttttacagtaacctgtgtaaaatcctgaagaccgcccatatttctcatctctgatgtcatgctcactagataacttttttttttttttctgcaatttaagctattcttttaccagaaagggagtcctgggcaggaggcacaggttatttcaaatattagagtggagcactctacctagcgtgctaacaatagtggttgacattcttggagcacatactgtgtaccaggcaatgctctaagcactttatctatgttattaactcattgaagtgtcacatcaggtagctactagttaaaattcccttctcacagaagaggagaataaattaacgtgaagtaacttgaccaataccacatattaaggggtggagctccataaaataacgtattaatacaaattagtaaattggccttgtgatttgtatttgactctgttcttgtggataatgggagtcaaagagcctgatgaattccaagaatatcgggaaaatcgagcttttggaactatagcaaacactagacataatagtacccctgattctagcaaacactagacataatagtaccacctcaagacactctgcctgagcagacatgtggcccctaggatgttacttttttattctgctgtcttggatcttattaatatttatttataacttgacatttcctaaaattattctacggatttgacttttactgctcaaaaatattaaaatagttcaaatgcagatagaaagattagctagaaaactgtcaaaacaacatagctcaagtttgtctaagaacaggtacttttgtactcttaccttgacccttattttgcttcagttgttcttcgccagggattgaaagggatagtgtatgtgaacagaagtttcaaaaagataagtttctttgtaagtgagttctataagaagggtgatagatgatatatataaaatatctcttcatggcaggtaatactgactgcttttcctcttgtaatcactttaccactccggtattaaagacagttgtacagattctactttagattagaataatgcagtagctttttattttctgtggcaggactgctctgagtataaaattttttgtaaggttgtattttcattactaattgagctcaattttctgtcttttccttgctgaaccaataggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagatt

SEQ ID NO: 35744 - DNA, 25585 bp, Homo sapiens; identical to SEQ ID NO: 35743

SEQ ID NO: 35745 - DNA, 32087 bp, Homo sapiens
ggccagagtccggagcagccgccgcccgaccacgccgagctcagttcgctgtccgcgccggctcccaccccggcccgaccccgacccggcccggtcaggccccatactcaggtgcgggctatcgggggcgcaggtatcgttggggacagaggggtggcgagcggccgcggggccggtcccagccgtccctgggcaggtgagggccggtgccatcgagcgccaccctgcaccggcggcagggggcgcgctggggtcctgggcgcggcgacttgggggtcgcgcggttcgggccgagcgcgcctcggagctccgcgaaccagagatctgagcaaggcggggagggatccggacaggtgcctccggggtcgcgcctcccccggggcccgcgcagctcgcccgacgccgcgtccctgactctcgccctgggctggcgggggagactttgctctgcttcgactgcgtcccagggctcacgctgcagtcaggaatttaccgtttggggaacttgctgccgctggtctctttggggccaccctcaccccaccccacgcgtcatcctcgctttccctccctccctactcccccaggcctgggtggggccctattgtttgcgcccagcttgcccaactgtgggggccgagcgcacattttcccagcgactctggccccacctgccgagcaggtgagcgcacggagtccagaggccctgccctccagctcccagagcctcgtcgatactacctgcggcgcctccctccacgccggtgggagcccggctctggcttcttcagcggaggtgggatggagtgactggggggtgcagggctcggctcagtgtccagctggtgtctggcacccgtggctcgccctggggtctggggggtggggtctgtgcacggatgaagaattcagggtcacctggcccagtttccagtagctgtggctgccagagtgttggtaggggaacaggacccgtcttctctaacctcttattgttggaaaaaatcacccaaaacaaactttgcaggaggaagtattcacagcagctttatctgggggttttcccgtctccttgcccaaaacttcctttaggcttagggggtccttcctggtgcaaaaccccttcccccagccggcccctggctgaacctgggccggtgcctgggctccgaccctgtcttccctgcccccacattcatcctgttcgctgggccccaggggcctgaggtaggggccggggtggggggtggaaagtgctgagaggggaagcagcttcttccttctcttcctgcctcctgggaccaccacaccccctcagacaaggcctgcgtaagtggttgtctctcaagctctgccccctccccaggaatgggggtggggcagggctgggccaaactgaggaaggtggggggagtggttgttcttgtctttttttttttgcctctaccccatcccccacattacttagctggctggttattgaggcagaagcgcatgaggctgtgggacttgccttccatttgatttctgaattgtgaaggtgcatgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccccccccacccagaattggggatcttgatcagggtttgtaccccggtttaaaaaaaaaatctgaaatgtggtctttttgcaggatttggagcccagcctcgttggggaacagagagagaatacaacagttgggttctctctcagtcctgggggtgggagaaagattgtggggggcggggatcgagagtgcttggaggggaagagtctaccacctctttctttgttgtagatgggggagtgaggctgggggcccagactcagcccctttatcctgggtggggatcacgctcagccctgtgctagggggaagtcagtgtgggaactcagatccttttctgccgggggatgggattctgcacctctggggagcaacaggagcagggagtttgggcaaaaataacctgctttccctcttctctgtgccaaggtggaggaggggagggcattgtaattatgttggctacatgattagtttagctaatctggtttgtggctgtgatgaaaagataatactgaggaagtactgctaggaggtgcttggtgaaaactggccactgactggactgggggatgcgggggaggaggagaaggtaggacccagttagtcatttcttgctagatcaagccccagcttgggtgacttgagccctcccacccccactccacccctcccttgcaccctggctccaccccattccctctggagcctctgtttgggctgccagggccgaggctttgagaatgcagtgcataggaacgaaaaaggtcgggctagggctgccaacctttttcccatcctggagccaccttagagtgagatgggtcaattgactagtctacagaaggactgtttatttggagagatgggacagtggggcagttctgagcacagggctttgggcttgaactgagctgggtttgagacccagctctgtctctcattacctgagcctcagtgacctctttggcaaaatgggaatactaatacctatctacccagtaagtacttgacaaacggtaactcaagatcaaggtaagactttacagaaaccaagcactttcttttttttttttttttttttttttgagatggagtctcgctctgtcacccaggctcactgcaacctccgcctcctgggttcaagtgattctcctgcctcagcctcctgagtagccaggattacaggcgtgtgccaccacccccggctgatttttgtatttttagtagagacagggtttcaccatgttgcgcaggctggtcttgatctcctgacctcgtgattcgcccgccccggcctcccaaagtgctgggattacaggcgtgagccacctcacctggcccaaaccaagcactttcattaactatttttacttaatccttatggctggccaggctggatggctcagacctgcaatcccagcacgttaggaggcccagaagggtggactgcttgattgagcccaggagttccagaccagcctgggcaacatggagaaaccctgtctctacaaaaaaatagaaaaattagccgggcgtggtggtgcatgcctgtggtcccagctactgggaatgttgaggtgggaggattacctgagcccagggaagtcaaggctgcagtgagctgtgtcactgtattccagcctgggcaacagagtgagtccctgactcaaaaaaaaaaaaaaaacaaaaaaaacgcgtatcattattcgcattctacagaggaggaaattgaaactcaaggaacttaagtaatttccccaatgttgtacagcgagacccaagcagcaccaagactgacgtttgggtcctctgattccaagcccagaacccatcctgctgtattgccccatgcagctctggaaaggattttttttttttttttgagatggagtcacgctctgccacccaggctggagtgcagtggcgcgatctcggctcactgtaacgtctacctcctgggttcaagcgattctcctgtctcagcctcccgagtagctgggattacaggcatgcaccaccacactaggctaatttttgtatttttagtagagatggggtttcaccatgttggtcaggatggtctcgaactcctgaccttcaggagatccgcccgcctcagcctcccaaagtgctgggattacaggtgtgagcggaaaggatttttctgcacccccttttgagagcctctgcctgactggggagaagagaattcagaagggcccatgaaggcatgtgtgagtggtgaatgtagggcaggttttgtaggtgggggtgatacctgtcctggccaccagcccacttaaatctccccagtggcttgatttttagtttccggtggaagcggcttctccccaaggccagggctgtggtgagtgttggggggaggttgagagggaaagaggaggcaggggtcaaagctgtgctgcctcctagcttgggttaggtagaaccatggctgttctgggcttgttcatgtgtaggaagtgggagttgcctgctttgctgggggctggggctatgccaagataaaggggtgctgccctgtggggattggcgagaaacgagagtccgatttaggcctgggctaatgtcctgctggagttgacgaggcagtgctgccaggctgctcttgatggggaactggctgtcctctgctctgaagcccaagagacctgagataggcagctgctgggagggcttttctggtgatggaggtgggggtcatgtgtgctgcctgtcagccagagccttggccctctagggaggagctggtgtcagattgttctccagacctgcctggttctggtgtctctgccaactggacatctgacaccagaatgggcctggatttggggtctgggaaatgggttctctttatgtgatggtgcagccggagtactgaacctgtcactaccgcgcttctggattccctgagggcaggcggggaccccaggcaacgggattattgatcgtggagaaggctaatgggacttgagacagagaagaaaacagaatgaaccccatcccactgactactacaaagagggcatgaggttgcagtttttccatctcccccgaggacttgagagctgcaggcccgatgcacttactgaagggacgcagtctagacaggaggaggggctttctgcctgctaaagatgaaatcttgagttgagaaataagagggagaggtggagactcagcattgactcttctctgatgagggccatcctgtgcggcagggaggccagacaggaattgctgccctttggggagactcctcatttgtatcttttgggagaagagcgacctggcagtgagagggaaaggcatctgtgagctggtcctgtgacccctgtgaagaggaaaagcaagcagtgtggctgggcaggtcaccagggcttgtgttcctgcaagtgacactgagcggcctctcctgggacatggttgagtctggggacatggaatatcttattgtgaagcgacttcctctgccaggcctgaagggcaagctcatggaccactctcctttgctcagcctcctggcatcttggcctttggggccagcagagcaggaagctcagctttctttttctctttctttctttctttttttttttttgagatggagtctctcactctgtcacccagactggagtgtagtggcacaatcttggctcactgcaacctccatctcccgggttcaggtgattctcctgtctcagcctcccgcgtagctgggactacaagcgcctgccagtacgcccagctaatttttttttttttttttttttgagacggagtctcactcactctgtcgcccaggctggagtgcagtggcacgatctccgctcgctgcaagctccgccccctgggttcacaccattctcctgccttagcctcccgagtagctgggactacaggcgcccgccaccacgcctggctaatttttttgtgtttttagtagagacggggtttcactgtgtttgccaggatggtctcgatctcctgacctcatgatccacccgcctcggcctcccaaagtgctgggattacaggcgtgagccactgtgcccggcctaatttttgtatttttagtagagacggggtttcaccatattggtcaggctggtcttgaactcctgacctcaggtgatccactcaccttggcctcccgacatgctgggattataagcgtgagccaccgcttttggcactcagctttctttcctcctcccttctcctcttctcttttctttcttttttttttttggtttgttttttgagatggagtcctgctctgtcgcccaggctggagtgcagtagtgcagtcttggctcactgcaacctctgcctcctaggttcaagcaattctcctgcctcatcctcctaagtagctgggactacaggcatgcgccaccatgcccagctaatttttgtatttttagtagagatgggggtgtcactatgttggccaggctggtcttgaattcctgacctcaagtgatccacccacctcagcctcccaaagtgctgggattacaggcgtgagccactgcgcccggccttctttcctttttttgaggtagggactcgctctgtcccttaggctagagtgcagtggcgtgatcacagctcactgcatccttgaattcctgggttcaagcaatcctcccgcccagcctcccaagtagctgggtccacaggtgtgcaccaccatgcccagctaatttttaaagttttgtgtagagacagggtcttgctatgttgcccaggctggtcttggactcctgagctcaagcatttgtcccatctcagcctcccaaagtgctgggattatgggcatgagccaccatgcccagctgaagctcagctttctgtgtctttccctaccatggagacagtagcagggaccagagcagagttgggacaggggcttggcaatcaataagctgcttatttaggggagactcctcctcttccttgattgagaaggtaatatctggctggggcagtggcttacacctgtaatcccaaccgctctgaaggttgaggcaggaggattgcttgaggccgggactttgagaccagcctgccagcctgtgcaacatagcaagaccccatctcttaaaaaaaaaaaaaaaaattagccaagcatggtggcatgtgcacgtggtcctagctactcgggaggctgaggcggaaggattgcttgagcccaggagttcaaggctgcagtgagccatgattgtgccactatactccagcttgggcaacagagcgagaccttgtctcaaaaaagagaaagaaaataaaaaaagtaatatctgatcattgtaaaaaaaactgggggccagccgcggtggctcacgcctgtaatcccagcactttgggaggccgaggcgggcgcatcacgaggtcaggagatcgagaccatcctggctaacatggtgaaaccccgtctctactaaaaaatacaaagaattagctgggcgttgtggcaggcacctgtagttccagctactgtggaggctgaggcaggagaatggcgtgaacccgggaggcggagcttgcagtgagccaagattgtgccactgcactccagcctgggtgacatctgtctcaaaaaaaaaaaaaaaaaaaaattgggaagtttagaaaagtttaagagaaaagaaaaaaaatcgcccataatcctaaaaagcaactttcattaaggtctcttcctctttttttttttttgagacggagttttgctcttgttgcccaggctggagtacagtggcacaatctcagctcactgcaacctctgccttctggtttcaagcgattctcctgcctcagcctcctgagtagctgggattacaggcacctgccaccatgcctggctagttttttgtatttttagtagagacggggtttcaccatgttggccaggctggtttcaaactccagaccttgtgatccacccgccttggcctcccaaagtcctgggattacaggcatgagccaccacgcccagccaagtctcttcctcttttcttagcatcctttttttctttttttttgagacggagtctcgctctgtcacccaggctggagtgcagtggcaggatctcggctcactgcaagctccgcctcctgggttcatgccattctcctgcctcagcctcccgagtagctgggactacaggcacccgctaacacgcccggctaattttttatatttttagtagagatgaggtttcaccgtattagccagtatggtctcgatctcctgacctcgtgatccgcccgcctcggcctcccaaagtgctgggattacaggcatgagccaccgtgctcggcaacatccttttgttctttagccttgatcttgatgagctcatcccctgtatatagtaacattttttttttttgagatggggtctcactgtgttgcccaggctggagtgcagatctcagctcactgcaacctcctcttcctgggctcaagcgatcctcctacctcagcctcccaagtagctgggactacaggcacatgccaccacgcccggctaatttttgcatttttttgtagagacagggtttcgccatgttgcccagactggtctggagctcctgagctcaaggggattcacctgccttggcctcctaaagtgctgggattacaggggtgagccactgcaccctgcctacagtaacagattttagccaaaactttattccaatcctggttttccagcatgtgttgtacaataaacagatggatcttcccaggagagggttatatgtagggatccttgcagaatcacaccccagggagtgggcctcagtcagctgggatcggagctgctgttattgagaagtgggccgcccctggaccccaggctgcccaagccccactggtggtggttggaggcagtggaatgagagtacttgtgtattttgcgtcaccaacacacgtcaaccttttgttgttgtttcctggtgtggggtgaagtgtttttccattcccaggagtcccggtttggggtcatctgccagtttgggaatctgcccacgggggtcaccagcagggaacggagctccagctggagccctctccaggggagcatagaggtccctgggtcgagccacttggccgtggcaaattccctctcctacaaatccccttcattttcctacccgggtttgtttgctttgggaaggagcccagaaggaggaaaataaacagcagctgggtcggcaggcctgagcctcccccaggccccagctcatcctcaggccacagcctgggctgctctccagactggaagtgagggttttcctccggaagcctaagaccagcttgtctgacagctcctgcttcagttctgccctcttggaatggaccagcttgctgatggagaccacagtgtctgccagagaacctgtagtctgcaggaggttccgtcctggagctgccagccagaggggagaggcctccttgggcagccccagcctgagagggaaacaggccctcaagggaagccatcatgtccatctctctggactttctagagtctgtgtctgtgcttggaactgctggccagacctcagcaggagccagggacagagtggggaaggtgggggctggagatcctgctgagcccagcttccccctgggactgctatgtggggaatgttcacgcctggctgtgcagctgcccctggctgcaggaagcagcatggactgggcatagggcagccagtgtctccacctggcgtgagcgaagttccactccccttctcctcagccatgttcccttgacctccccagggcctgggaggcagctccctacctagtccccatctcaggggtcagagaaagcagccagggctcccccagacagactgccatccaccttgcccgacaggtctctgtgccagccctcgcctttttaaatttttattatttttctttttttttgagacagagtctcgcactgtatccctggctggaatgcaattggtgcgatctcggctcactgcaacctccgcctcccaggttcaagtgattcgcctgcctcagcctcccgagtagctgggattacaggtgcccaccaccacgcctggctaattttttgtatttttagtagagatggggtttcactatgttggccaggctggtctcaaactcctgaccttgtgatccacccaccttggcctcccaatatgctgggattacaggcgtgagccaccgcgcctggccccctcacctttttgttttgagacacggtctcgctctgttgcctaggctggagtggcatgatcctggctcactgcagcctcaatcacctgggctcaagtgatgcttcagcttccagagtagctgggactgcaggtgcatgccaccatgcccggctaatttctttttattttttgtagagacagggtcttactatgttgcccaggctggtttcgaactcctgggctcaaacgaccctcccacctccgccttccaaaatgctgggattataggcacgagccactgcgccagctggcttccgcctcctctgccatctctttgttcttctagcatgagaatgcatgcctttcctgtggacagagggcttccagagtcacagtgacaaaagaagtcacttgatcatctccattttacagatgagaaaatgaggcttaaggaaattgagcccctctcctcactcagaatcctgtgctcaccctgtcgctgtctgagcctggggacctgtgtctgcacagggtgctggcctctagcctaaggaacctctgggggacccagccctgccctgctccgccctgctcctctgttcccaaatgcaatgcttctgagtctgcttccagcacggcctctggggtaacccactcctgtccttatttccaggtgtcttggcacttggtgccctgcaacccagcctagatgtgcccattgctgactgtccttggcaggtgccggctggggaaggagcctggtgtagctctggtggggctatttttaatgtcagggctgggccacactctgccaggtcagtcttggatttagggtgcccggtgccagccctctgggttggctgcgcagaggaggaggcaggaaagaagggtaggggtgcacccagtctagccttattacttgctcacacttacctggtgtgggtcccatggggaagggtcctctgcaccccctctccagggcccgtcttccttcttcctgtccttgggctgtccctacagtctctgatctggcttcttcctcccgtgctgctaacaatagagcacgctctaaacaaaggccccccattcaactcagaaacccgccctgtctctgtccctgcccgtctctggctgggatgagtgggcagggcctgcgtctgtctctctcgcttccaccctggctctgtccaggggcattgcaggaggtctgactccaggtccagggtggagagggacaagactgaactgggtgtggccccctccaccctgggaactgtaaaaccagcacttttgtttcttgtgagagaagttcctttgttctcctgggcagtaggtaaggagaagggtggggctggttgacagtcctgcctgaggtctgacttccagccttcctgttgcaggaatagctcccgtgaccccttcctcaggaggagttctggagtgtgtcctctctctgaactggttcccaactctgacgttgcccacccccagccttcttctgtctgttgtgggaatcctgtttttttatttctagaatcttagacatcaacattcctttgagatccagggacacaaggacacccagcaagtttgtggcagagctgggactagaacctgggactctttttttttttttttgagacagggtcttgctctgttgtcagccaggctgaagtgcagtggcgcagtctcggctcactgcaacatgcacctccctggtttaagcaattctcccgccccagcctcccgagtagctgggattacaggtgcacaccaccatgcctggctaatttttgtacttttttagtagagacaggatttcaccatgttgaccaggatggtcttgaactcctgacctcgtgatctgcccgccttggcctcccaaagtgctgggattacaggtgtgagccaccgcacccgaacctgggacacttgatttgcagccgagtgctctgcttccatctgcaagcaccttggtcccctcctccccttggcaagagggctcagctccacccaggcttgtctagtggactggatgctgttcctaccacaagtgctgccattttctcagtgtgcaggcacagcttcttcacctagaaattgggaataaagccaggcacagtggcccaagcctataatcccagcactttgggaggctgaggtgggcggatcacctgaggtcaggagttcaagaccagcctggccaacatggggaaacccggtctttactaaaaatacaaaaattagccaggcgtggtggtgcacacctgtagtcccagctacttcagaggttgaggcaggagaatcactggaacccaggaggtggaggttgcagtgagccaagatcatgccactgcactccaacttgggcgacagagagagattctgtctcaaaaaaaagaaagaaagaaagaaattggaaattataaaacatctgccagggttgctttgagggaagaatgagattcacataataataaaggccactgggcgtccacccccccacccccccatggcatcctgtggcttctgtctctccctgggtagctgtctagccctcagcagtctcctggcggttgacctgggctggtgggggtggtgaggggcctgctgaggaagttcctcagcttgactgtggtggtccctttagatgtgaggccggcaaggggtgacccttgtttggagtgaggcccgcttccctctcccttagctgagaagccccagggttaggcactgtctatgcaggagggccctctggctgggatgcagtgtgtttgttgaccagagctgcagatgtccagcagtgtccagatgtcgttcagccttgagcccagcagagcggcattcagtgggttattgctaccgtgtttacttgtacacttgcaccttccttctctcctgggggcagcttctcttccaaactctcctctgctctctcttgggacttgcccttggggcagggaaatggttggggaaggcggcacagcacgaggagctcaggattttagtagggttttcccatgtctgccttctccgagcaccccgccccccgccccccaccattgcccctgtttcctgccagtggccattcccctctgttgctggggaaggggtgtggggaaggggtgcgtgtggaaagggggctggttgggggggctccttctgaaatagctacactttcgaatgcctgggaagcagctgtgcacatctggcggcccgagcctgtcgtctggggtctgccgtctgaggtggcgggactgcttctgtttaatcagcctgaaactctgagtcactagggattgcgggaggagaggaaggaggcagctgggagctggcctggcccctgcctctgcctgttccgggtgtgctcacggctgcctgccataaaaggctgggagacctgcaggaccattcgtcatcctcctggagggccagggcggcactggggcagtcacagggaagacttatccttggtgatctttgttcctggggtggggccaggttgccccagccaccccaccctcacctggtccccatcacagtgagacaacccgggtgctgcctggcttcatgggtggaccagcctgagttctgcttactcactgaggctgcgccgggatgtgcaaagactacagaccttggtgccctcacacctggtcccagtcccagctctgccatttctaacctcagtttctgcatctgtacgcgggggaccagtgcatgggctttgaaacccgcccatgagcatgacggtgtctgtgaaaggtctggctcgtagtaggccctcatgggatcacggcgtccattctccccgcagcctctgacctctgcaggtcagttcccaggacagtggagccaaacacagaccaagcgggaagttcacctccctggtacaaagttcggccctgctactcattaaccttcaggtgcgcctaaacctttgcagagagagagaggggttcctgacggcagtgaccacccacaggcctgccccaccccagatccctagcctgggctcgaggagaccaggaggtgaggaagcacttctggaggagaggcagtgctgatgataatggccgtggcctctgagcacctgctatgcaccaggtcctcgcaaccacctctgagggaggtggcgtgaccccgctttacagatgaggacactgaggttctgtggggagaggaactgccccagtagtgagtagctgagatttgaattgctctgtgggactcaaagaggcgtctagggactgggagggctgggagagagggggccttagggtctggacctcagggccatgtgtgatcctgcccaacctgtaggaaagccagatcctggagtctctgagggagcctggggcgctccagagaaacctgtcagaccgcttccctgccccgcccagtttcctgcccaatggcttgggtgcctcctccctgcagcctttcccagggagccccagtagttgagggtgggcccaggggacctcagaagctgctagaagccctgagtgccttctcttgcccctgggagagttgggtcagggcagcaaggtgcgtgagcaggggcttctggcggcagctggcccttgactgtcctgccccctggggctcatccccctgggaggtcagagatgcaagcccaggacatacacacagccgcacccctggggctcactgctcccagggtatctcgtcgtgggcagcccctccctgggcctggtgcccttctgggcagtccccccatccccagcctgcatcctcattgaaatccctgggccatggtgatgatgtgggaagacaggcggggcttggtgacgggctgaagctgggggctgggccaggtgacttcctgcttcctgacttcctcctttgtgcccccagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtcaggacccctggggactattgcatggggcagaaaacctgcctgggtcctggagagaggtcagagtgaaaggaggcagattgtagggggtctctggtctgagggaggaggcacagctcatgctaactaggggcccacccagtctgaaggaggaggtgcagctacttcagggtgctgcatctgggagggtcacagaatcctcttctgtgaaccatcagtagggagggaaggcatagtccctgcccttagggtgcctccagtctgaaggaaaagccatagtccttgccttctgtgaacataagaatctgatgaagacattgggtacggtggctcatgcctgtaatcccagcactttgggaggctgaggtgggcagatcacctgaggtcaggagtttgagaccagcctggccaacatgatgaaaccccgtctctactaaaaatacaaaaattagccgggtgtggtggcgcatgcacctgtagtcccagctacttgggaggctgaggcaggagaattgcttgaacccaggaggcagaggttggagtgagctgagattgcgccactgcactccagcctgggcgacagagtgagactccgtctcaaaaaatagtaaaaaaaagagtctgatgaggatgtatcactatggctctcagggagcccatggatggcagggaggacgcagccctttggctgcaggagcctcacgtttgtgggagagccagggccgtagcccccaggaacccccagggattcccctttgggtagaggggtgtaggtgtcaagcctgagggcccctcgttggggttggagggagaccaggcctctgcggctgacctgcagataggccaaggctgtgggatgagtgactgactcagctctggggcttagtccgggatggggatgccccgccagcccaagcctcccctgcccctctgggagagaggaatagccaggccctagaactgttggccacaggtgcctccagggccctgaacatgccagggggtgggctgtgggtgctgggagtagtgtgagtagactgtggctggtggggctctatggagctcagccctcgcatgccagtctcctccctgacagctggtaggggtagcagggggccttttggctggcagggccaggcactgtgttggtagcaaaaagtacagcatccaggtgggaaagccatgcagctgtctcctccttctcgactaattagagggtggaacctctgcgtccctctccctgggggcatcaggacagttgccagggtgtggctgcttgggcacctacctgtgggactcccagacccacccaggggatggaagctagagaggaacctgacgtctcagctgaggacccagctcctgctctctgaacccacagccctgactttccctctgatctgctgtgagatgtgatgttggtggttctctgggcctctgtttgcctgcctgtatagtgggaggattgctaccgttggggatgatgagggtgtaattagactcctgagatttcagggttgaaaacagacctgatgggtaagggaggagaatagagtaggggtttgggcccctgagtcaggctgccttataacccctctgtgcccagttttcccatctgtaaagtggagccagtgatagtacttaccttgcagggtcgttgtcaggttatgtgagaaaatataagcagggcattgaattcactgccaggcacataataagtgtgcaaaaaaaaaaaaaaattcccttgatggacagaacatgtggggcctattttacagagattactgaggtgatggtgacttccccaaggttcctggtgagaggtagaatggccagtcatgtgctgggggtttgggcagggcaagaggtagcccagaggacccaggtggggctgtctgtggcctgccctgctccccagtgtctgcccagcccactgcctgcactcagtccctgtccccatggcccccaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtctgtgagggtccctgctagggtgggggctgggcagggaggggagagagcagatgtcctcaggggagggacattgtaggggtggagggaggttatgacccagactctcccgtgtgtgatgagtctgactggggccctcctcagctctgtggaagggtatcccggcctctccttagtgctcacgtccccgcccctgcctttgccctccaggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcaggtacccaaccctgctcactgcatgagcccaggaccccctctcacttgggcctctcccctcccttccctgagcttccataaatatccagtgagcacctactatgtgccaggcagaagcacaccccatccgggtgctcggtggctcacagcccagcagggaacacaggcatgtaaacagcaggttaatgatcaggatacgacacaggctatggcagaagagcattgagattgctcaaaggtggaatcgcttaatggcaggggattgacagatgagtggagtttggctagtgcagaggaagggaagagtgtcccaggcagagggaacagcaaatgcaaagtcccttgcaaactttctgtttcctggccccctacaaaatgtggattggcctcatttctttttttttttttgagatgaggccttgctctgtcacccaagctggagtgcagtggcgtgatctcagctcactgcagcctccacctcctgggttcgaatgattctcctgcctcagtctcctgagtagctgggattacaagcatctgccaccatacctagctatttttttttgttttgagatggagttttcctcctgttgcccaggctggagtgcaatggcacagtctcggcttactgcaacctctgcctcccgggttcaagagattctcctgcctcagcctcccaagtagcagggattacaggcacccacgaccatgcctggctaatttttgtatttttagtaaaaatggggtttcaccatgttggccaggctagtcttgaactcctgacctcaggtgatctgccccccttggcctcccaaagtgctgggattataggcgtctgccaccatgcccagctcaattttgtatttttagtagagacggggtttcaccacgttggccaggctggtttcgaactcctaacctcagggtgatccacctgcctcagcctccccaagcgctgagtttacagacgtgagccactgctcctggccttatttctcattcccataccaggctggaagctccctgaaggggagacactgatttcactcccctctgaacgccttgcaaggcctctctaatatgtggccttccacatggtggttacttagtagggatcagtgtctaggggacctactgtgcgctcagcacagggctggggactcagaagcaggaggagtcattgtcccagttgggagaagagaggtgctgtttgcttcatgcttaagagcagggcaggctcaaggagtgatgagattttagcaaagggatatttccagaggggcgtcagtagcggggaggcttcctgggggaggtgggaacccatgccaggctcacatgtatgccaggcctctgggacctcagcgtactaacccctgcccacccccccagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaaggtgggccctccccaactctcccgaggcctgaagcccacccttgcgccatcttctatcctgcacagccttgggccgctgcccccttactccttttagatgagatataggtgcagatatacatgcttcatcatgcgactgaattgcccagaattattattttgaggataagggaaaaaaaaaatcactcatcctcatatagccactattgtcatttcgatgtgcttccttaagagctgttctgtgggcagattacagatgtgtacacatccttgtcatcataacaatctgcaatattgcatctgttttctgcctgattttttttttttttttttgagacagggtctcactctgtcacacaggctagagtgcagtggtgtaatcagggctcactgcagccttgacttcctgggctcagatgatcctcctacctcagcctccagagtagctgggacttcaggcgtgtgctaccacgcccgactaattttttttttccttttcttttctttctttttttttttttgtttgagatggagtctcactttgtcgcccaggcaggagtgcaatggcacgatctcggctcactgcaaccttcgcctcccgggttcaagcgattctcctgcttcagcctcccaagtagctaggattacaggtgcccgccaccacacccagctaatttttgtatttttagtagagacaaggtttcaccacattggccaggctggtctcgaactcttgaccttaggttgtccatctgcctcggcctcataaaatgctgggattacaggcatgagacaccgtgccccacccccaactaattttttatagagatgggatttctccatgttgcccaggctggtctcaaactcctgggctcaagtgatctgcctgccttggcctcccaaagtatcaggattacaggtgtgagccactgtgcctggcctgtatgatgtttaaaaaaaatttttttttgctatattgtcctcaaaaccaccctctaataatgacagattgcctttcctttcccctttccccctcccctttcctttttccttttccttttccttttcctttccctctcttcctctctttcttccttccttcccattctttccttttctttcttttttgagacagggtctcactgtgttacccaggctagagtgcagtggcatgatcctagctcactgcatcctcaaactcctgagctcaagcattcctcccatcttagtcttcctgatagctaggactatgagaacatactactgagctaattagcacccgggctaagttttaaattttttgtggggatggtgtcttgctctgttgcccaggctaccctcaaggaatcctcctgcttcagcctccgaaatgctgggattaaagtcatgggccaccatacccagcctacagatagcatttcattaagtggagacctcaggctttattctgagggagggtatttagattgctcctattccacctttataaacaatgctgtaatgaatgtctagcctttgtcaaagagcggaaaaaattctcatcaatttttaacacttctaggcttttccccaaatggccagattgatttccagaaggactggactaatttccagtgccataactggtaatgggtgtgcatatagttttgtcatgtccttgtcagcactgggtattatccttttttcaaaattttggcttacataacagtcatgaaactattggggtgggctgggtgtggtggttcacgcctgtaatcccagcactttgggaggcagaggcgggtgaattgcctgaggtcaggagtttgaaaccagcctggccaacatagtgaaaccctgtctctaccaaaaactacagaaattagccgggcgtgatggcacacgcctgtaatcccagctacttgggaggctgaggcatgagaattgcttgaacccgggaggcggaggttgtagtgacctgagatcgtgccactgcactccagcctgggtgacagagcgagactctatctcaaaaaaaaaaacaaaaaaacttattggggtgcttggctgggtgtggtggctcacatctgtaatcccagcactttgggaggctgaggtgtgaggatcacttgaggccaggagttctagaccagcctgggcagcatagtgagacccccatctttataaaaagaaaaaaatacattaaaagaaaaaaacgaactattcgtgctttagctgaagctcagtaatgacagttctgtctcctgtcccgcgcttccttgttcctgtcatattccccgtccatctcacactcattccctctttacccatagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgagtatgatggccttgagggcggctggggtgggagctctgcccagctgccaggctcagtcagccatgctccccgtggctgatggcacccctatccctgccccaggtgggatgcaggccctgggcaagcacctgaccagcaacagcccccgcctggtgcagaactgcctgtggaccctgcgcaacctctcagatgtggccaccaagcaggtgagggaggtatctgggcctggggttgacctcttcagctgccccatccagcctcctgtctgggcatctgacctgaggtactgtgggaggactgggggctctaaatctctcttccttgtgactgaggctggaaatgccttgaaaaccctcatctctttttttttttttttttttttttctgacggagtctcactctgtcacctaggctggagtgcagtggtgcaatctcggctcactgcaagctccgcctcctgggctcaagtgattctcctgcctcagcctcccgagtagttgggactacaggcacctgccatcatgtctggctaatttttgtatttttattagagacagggtttcaccatgttgggcaggctggtcttgaactcctgacctcaggtgatccacccgccttggcctcccaaagtgctgggattacaggcgtgagccaccacatccagcaaaagaacagttttgacctgggccctgggctggagcaatagtgtaccaagagacaggcccccatgactaaaaatacaatttaaggaaaaatgcagctccagggcaagtgccctgtgcctccttccaacaaccattccccaggcctcccctagcaatatgctgtttatcaagtgctcaccctgtgctggccctctgcgtggcatttgtggacagtagctcattcaacctggggttagagtgtgggaccctgtgggttagatgaagacactgaggctcggggagctaatggccatggtcacaggtagtaaatggcagaactgggatttgaacccaggactgtccgtccccaaagctggggtttttctgttccaccacaaggcccacgtgtctccctgggagaagtgagatagacgtctgaggtagtgattttactggaaatggatttggctcagggccccagggtggtggggcagcagtgaaggcccagaaaggtgacaagcgagtagacatggctcagctgggccactgaatcatgcggccccctcaacaattgcctcctggtctcgaggcctcccttggccaccgtactttggcctgaggagggttctgcctgggtctgagggccccagggaaaggctgatgagttggagggaagagatgtggggcttagagccaagcctgggttcagatccagccactagctgtgtgtctgtgggcaagttccccaacctctctgagcctcattgcctcacttgcaccacaggatagtaacgccctctcacagggtgtggcgggtcatagggatgaaagttcccgggcacacacaggcagggctgacccctttaggtcatcccactccccttggacatattcgagaaggctccctggagttggctgctccctgactcccccgtcccttccttgccctccaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggtactgctgttaggcgaggggaaggagctccctgcagcaggcttaggtgctgtattggtataggcaaagccgctgtagcaaagaagccctaaatacagtggctcgaataagacagaagtttatttctctctcgtgtaatagtttagacctcaacaatggctctgctctaaaattccagaattgggatttctatcttgtagctctaccagcccctagggcagagctcagagttcaaaatgcacatgagtaccctgggtggtttcattaaattgcaggttccagggccaggcacggtggctcatgcctgtaatcccaacactttgggaggcaaaggtaggaggattgcttgaggccaggaatttgagaccagcctggacaacatagcaagacctgtctcgacaacaataacaacaacagaaattagccaggtgtggtggtgcacgcctgtggtcccagctactggggaggggaggctcaggtcggaggatcgcttgagcacaggagttggaggttacagtgagctatgattgcatcagtgcactccagcctgggtgacagagcaagaacccgtgtcttaaaagaaaagaaaaacaggaggctgggtgcagtggctcacatctgtagttccagcactttgggaggtgcaggcagaggcggaagcggaaggatcacttgaggccaggagtttgagaccatcgtgggtaacatagtgagacacccatctcttacaaaaaatttggaaaaaaaaaaaagcccaaacaaataaacaatctaaaacacacacacacacacacacacacacacactctctctctctctctctctctctctctctctctctctctctctctctctctctgtctctctgcaggcctgctgcagagggcttgccattctgtatgtcttttttttgttgttttgagacaatgtctattgcccaggctggagtgcagtggtacattcttggctcactgcaacctctgcttcccgggttcaagtgattctcctgccttggcctcctgagtagttgggattacaggtgcacgccaccatgtctggataatttttgtatttttagtagagatgggattttgccatgttgctcagactgatcttgaactcctgaactcaagtgatccaccagcctcagcctcccaaagtacggggattacaggtgtgagacaccaggcccggacaattctgtatttcttctttttttttttttttttgagacggagttttgctcttattgcccaggctggagtgcaatggtgcgatctcggcttactgcaacctccgcctcccgggttcaagcgattctcctgcattttttagtagagacgggatttctctatgttggttaggctggtcttgaactcctgacttctggtgatccacccactttggccttccaaagtgctaggattacaggtgtgagccactgcacctggcccaattctgtatttttaacaagctcgcaggtgctgctccatggagcacatttcttatgccactgggtgtagacgagagggttgtcctcacacgaatgagtggactgtatcatccccacggatgtgttctagccctgagaactggggatggctagcggccaccagaaagtggcacacatcactcctgctcacaccccagaacttggtcattcagccacatcaaggtgcaaggaggttaggaagtgtgatcaccagccagatggccgtgtgtcctgctgaaaatcaggagagccactacagagacacagggcacagaggattctggggacgcttagcatctcccatagggagttgggtgtgtgaaggagtggggtcttcttcttgaggctacctgggtggaagagagctagctgtgtgtcacttccctgtcaggtgggggaagtgagagtgggtcagggtgtgggcagacccaagggacagagttatgggggaaagcgtttgtgtgtgtgtatatctatatgtagagacaaggaaggcagccaaaggcaaggtggcatctggtgccagagagtgaggaagctaccatcgatgagggtcttgtcaacgggcacaggagccagctggcaggggcatccgccagctacatttaagacaatttaatagtacagacaggccaggcgcagtggctcacgcctgtaatcccagcactttgggaggacggggcgggaggattacctgaagttaggagttcgagaccagcctggccaacatagtaagtccccgcctccacaaaaaatacaaaaattagctggccatggtggcatgtgcctgtaatctcagctactcggaaggctgaggcagaagaattacttgaacccggaaggcagaggttgcagtgagctgagatcgctcattgcactccagcctgggtgacagagagagactccgtcttggaaaacaaaaacaaaaaacatggccaggcgtggtggctcacgcctgtaatcctagcactttgggaggccgaggcgtgtggatcacgaggtcaggagatcgagaccatcctggctaacacggtgaaaccccatctctactaaaaaaatacaaagaaattagccaggcgtggtggcgggcgcctgtggtcccagctactcaggaggctgaggcaggagaatggtgtgaacccgggaggcggagcttgcagtgagctgagatcgcgccactgcactccagcctgggcgacagagcgagactccgtctcaaaaaaaacaaacaaaaaaacaaacaaacaaaaaaaacccagtgcagataagaatgactctaagtgattctacacattgaattattattttttattattattattatttttgagacagattcttgctctgttgcccaggctggagtgcagtggcatgatctcagctcactgcaacctccgcctcccaggttcaagcaattcccggctaatttctgtatttttagtagagacgtggtttcaccatgttggccaggctggtctcgaactcctgacctaaagtgatctgcctgccttggcctcccaaagtgctaggattacaggcgtgagccactgcgcccggcctatacattgaattaaaaaaagaaaattcatgtttagaaaaaaaaatgtcattgtgacccctccttgatgcttggtccctgctgcaaacctgaggtgggactttgcatcctaacccagcagctaagtggcaagtgactttggcaagtcatttgccctgtgctcacgtccccatctcacatgattttcatccctgtcctcctggcgtcttgttttgaggatgaaatagatgacaccttgagaggctctgggaggccagagtggctcctctgagtcaaagaccctggggaggagatctcaggacacctctttccagagctgccctgctggggattaatgacaatgtgagcaccacccaagcaggaggcttcgggggcacctagagcacagaattcctgagaatcaggcttggaggactatcagaaaagcaagcaaggtcatggtgtctgtggggggtggttaagaaagaggggacagggtgaggggccaggcatggggctggcaggatgttctggaatggggtgtcattttagcaagggctattagaattagccatgagcagccggacgtggtagcccacacctgtaatcccagcactttagaaggcagaagcaggcggatcacctgaggtcaggggttcgaggccagcctgcccaacatggcgaaaccccgtctctactaaaaatacaaaaaattagctgggcatggtggcaggcacctgtaatcgcagctactcaggaggctgaggcaggagaatcgcttgaacccaggaggtggaggttgcagtgaggtgagattgcaccactgcactccagcctgggtgacaagagcgaaactctgtctcaaaaaaaaaaaaaaaaaagaattagccatgagcactcccagatcctgtggattaagtgacatggctgggatggtctccttctctggatattttccagtatgtctgtgtctggcctcggggacagaagaggtgaaggagggaagggatacttgaagctgggaagctgggatccttcagatgtccaagaagtgcccctgatcactgcccctttttttgccaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggtatgtgagctggtggtgcctctgacagccttcctggggggtcagggtgtcctctgtgggtgtgtgtgtgaatggggaggtcagttgcaactgatgccaattccaagaacctgtgaagttcattcggctgtcatggggaggagttgtggccatgtccaaggcacctgtcccatgccccctgcctcctctcacacaggatggtgtgaggatggaggagattgtggagggctgcaccggagcactgcacatcctcgcccgggaccccatgaaccgcatggagatcttccggctcaacaccattcccctgtttgtgcaggtgagtctggggcaggtgggcaggagaggtccccccaccactgcttaaagggcaaggttaggagtcccagatttgggaggcctggaccaggtatcaagaggtctttggaggagtttggaggaaagttgccactccagattgactacttagcaaccccctgcatgggcatggctttctaagcttcaaagcaaggaaagagatcacaaatggaaaaaaaaaacaaaaaacaaaaaaacttgagattcaaccatataaacatgaaaaccatctgtatttcagaaagaacctaaaaaagcatttttaaaaaatcagcaaactgggagaatatgtgcaagtaccataacagacaagaagagtctaacatctttcacatcagtgagctcattaacactagattccaatggttagatgaggcagagtcacaggtaatttcaaggtagctcatgaacaatgctcagcccagtttaaagcagtaacacttactccccagtgacggcccattttccactatggaattgctacagggtggaggtgggcagtgctgtggggtgtgttgtccggcctgcctcacccctttccacctctcccctgcttcccacgtcccctctccccagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactggtgagctgggggagggcaggaggctgggtcccactcccccagccacgatggaggctggccgacgtttaacctggcttttcctttcctctctgctcagccacctacgctgctgccgtcctgttccgcatctccgaggacaagaacccagactaccggaagcgcgtgtccgtggagctcaccaactccctcttcaagcatgacccggctgcctgggaggctgtgagtatcctaggttggaccacagtagttggttgtgcaagttgggcactgcccatgggcaacacttttgggggtctcctactactgtcaacttcatagatttttattttgtaattggatcatttataacaattcctagcagatggaagtagtgggttgaatcatatatccacaaaatgccaatttttattttgcccaaatgagtatacagtgtttgaggtgggggtgcctttttgtaatttgcgtggaggtgctggataggctatgggcggtcttttccagggtggggcagtgccctgtacccattcttgagtcctctgcctcctcccctgagctgctctagtccggcaggagtccctgcttcatgagtggggaaccctcctccctggggagtaccgaggacatgagtatatcagggcactgggtgaccccatttcatcatcctctattcctccaaggcctctttgcttttctccagccccctcttttatttatttatttatttttatattttttgagatggagtcttgctctgtcgccaggctggagtgcagtggtgtgatcttggctcactgcaacctccgcctcccggtttcaagcaattctcctgcctcagccttctgagtaactgggactacaggtgcacgctaccacacccggctaatttttctatttttagtagagacgcggtttcgccatgttggccaggatgatctcgattgtctcctgaccttgtgatccgcccgccttggcctcccaaagtgctgggattacaggcgtgagccactgcgcccagcctattttttatttttttcgagacagagtctcactcctgtcgcccaggctggagtgcaatggtgtaatctcggctcactgcatcctctgcctccccattcaagcaattctcctgcctcagcctcccgagtagctgggattacaggcctgcaccaccacgcccagctaattttttttgtatttttagtagagacagggtttcaccatgttggccaggctggtctggaactcctgacctcaagtgatccgcctgctgtctcccagagtgctgggattacaggcgtgagccatggcacccagcctggccccctcttttagaagcatctctccctgcccaccagctgagatccagctcggagcctgcattttcaaacctcccctccatgtttctctctcctttttcaggcccagagcatgattcccatcaatgagccctatggagatggtaagtgtgtgccgggctcttcaggaccctggagatcctgggcggctgtgtgggtgtgtgtgaggggacaatattatgtctccggggccagaggaccagtggcaactgctgtgtggcatccacatgtaccccagtctagatgccctggtgtggggtctggggaggggtcaggcccaccaggggtgggcatgggtagaggaggcagctgaaggctgtgcagactgctccctgcagggtagcttgcagaccctaggaccgagccccactttttgtccccagacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 35746 - DNA, 17322 bp, Homo sapiens
ggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaatgccgcccggacccccggaccacggctctgctcggccgggtctcccaggtcctgcccgtagattgcaggtcacccaggccgcagtgaccctttttccttcccgccctgcctgcccgcggctgggcgccccacacgcgactctgagctcgggagaggagctgggaagttaactcctgttgcccagtttggtcacattggggtggagccggcgccatttttgtagggcctcctgcgggagaatgtgggcttttgctcctgattcgcgccagactgaccgctgctcggtggggacggtggcgggaaccttccccggggcggcctaggtttagtagataggcccctttggccttcccgggcatgaggggttataatccctggaagccgttctgaactttcagagtgctgtctgcattcgtgagcaccaggtactcctgcatgggtttctttatggacagttcagtattgttgaggctactcgctgtcccttgtgaacagtgggtgaaaccttgatacatttctaaggctcacctctagagatttactctctccatccctttacaggatatagcttatgtttgtttgctgaagacttattccatattgagccaagttttctacttttgcttcagatgatgcatatgttgtgagaataaagacctaatttaagtgtcctccattctgaggctaagcgttcacaaatgatcagacttgaggataactttatttgggatttccaaaacggaaggcctaatcttaaaaaaaaaaaaacaaaaacaaaaaacagaacactcctaaagaaattacttttatagatttacagtgttcctgtcatttttaatagccgtataacttgaagaaaattgtgcaagtaaatatagggaaaatactgtattttcctacaggagaggagcatacttcatagtccgtaagtagtctcctttgattattcattctagaggaaaccctcccctgacacaggcctacttctgctctcttttctacttgacagctggctccagggattctaccacatttcctctttgtagctgtcacttattactttatcccttagggtacttggtcgaggtgttctgtgcacaagttggtgcagtcactgctcattattttggaaaagatggagttataaacaaaaaattttaaagtcttacagttttcttctgtataatcctttattctctctgaggtggtaaggggatcacttccatcttattctcacctttatttctagtaataagatttccaattcttccaccaggctgtaagctctacaaggcaggaatagtatctgtcttaatctcattggattgccagcacttgacaattagtagatgcttaataaatatttgttggtttaagtcacctacctcctgtcgactccacccttagtgaataataggttctgctttggttccaaggggataggacttctacactaaatcacatctagttccctagcctcatgtcttaagaaagagcctctctgggaatttctccaaaacaactctggtttaaagaatgttgatgtcactttaattgttgtacactcagacctagtctcattcattcaacagagaatttaaagaacatcccattacatggcaataaaatacaaaggggagtgatccgggtatggttaattctggtaaattgacaagtaattagtcttttcttaaataacatttgaggcatacaaaaaatacagctaacatgatatacctgggaacccattactctgaatttaagaattacagcgcagattgaggtaaagccctaatcaccttttactctctttttggaggtaatcaccaggctgagtttggtgtttatcattcctgtactgtctgaaaccaatcagttcttagttatcttacttagaggaatggtacttttcatgacctaatttaagtgtcctccatttttttttgctgcttccaagctcttcccatgagtctcttagggtcattaccacttacagcctttttcctgccttttggaaatggctgccaatgtggtttcctttctggaatgggagcaaaatgctgtggagaggtaagcttatgtgggggctaggggcaaaaaaaacattgtgactttggtcaccccagcttactgactgtaatcagtgaactgatttactcactgaagctaagcgacttacttaacttctctgagcttcagggaactcatgggtaaactgggaataaatgaatgttatgacctcatggggtgattgtgacaagtaaatgggcagaattattgcatagtggttaagagcatggtcactggggtcatataatagaaacagggatgttgagtagggaccagcattataaaagaaagtaaattgggtaccgaacagatcttctttattttttaagagacagtgtctcgctatgttgcccaggctagcctggaacctcctgggcttgctcaagtgatcctcccacctgagcctcctgagtagctgagaccctaggcgcacaccactgcacccagtgagatttcaatatttatggtactctgctaccaaaagtttgaaaaccacagttctctgtccagacactgtcttcacttaattttgaaagtatcgggttccttgcatagggcctggctttagaagacacccaagatttccgcttagaagaatatgtatagaattgcatttttatttcaaaaggatgggtgctaaagtgaaatgtttttctatattttttaacataatatctgctatttatgtgtattttatgtcagaaaaatccccaaaggaaattccaagaagggtagggaggtgataatgtgttaatgttgggattggagattgtaaatttaatatgattgtgtagctaaaatagatgaattttttaatttaagtgatcttttaaaaaatggttttataagccttaatttcattttatttcatactgttttacagataattaatgtcatttacctccttttcttttttttaaaccatcaggtaaaggaggtaaaaacagacgcaggggtaagaatgagaatgaatctgaaaaaagagaactggtattcaaagaggatggtcagggtaagtgttttcataaattacgctttttaaaataacatcctttcttttttagctggggactttatttttttgagacagcgtcttgcccatcgcccagggtgaagtgtggtggcacgattacagcccactgcagccatgacctcctgggctgaagcagtccttccacttcagcctcccgagtatttgggactacaggcacacaccaccacgtctggctaattttaaaaatttttttaggctgggcgcagtggctcacgtctgtaatcccagcactttgggaggccaaggcgggcggatcacgaggtcaggagttcgagaccagcctgaccaacatgatgaaaccccgtctctactaaaattacaaaaattagctgggtgtggtggcacgtgcctgtaatcccagctactcaggaggctgaggcaggagaattgtttgaacctgggaggcggaggttgcagtgagccgagatcacaccactgcactccagcctgggtgacagagggagactctgtctcaaaaaaaaaaaaaaaaaaaaaaaaaaaactgtatagagatgaggtcttcatatgttgccctggctattctcgaactcctgggctcaagtgattctcccaccatgacctcccaaagtactgggaactaagaatgtgtcgtatagttcagagggaattgagctatggttgacagttctgtgatttagttggcagttctatgattagcatttctggtagtgaatggtacatataatatgttgagtagaccatggacatttgaaggatgagcctgaggcccttatagacctctccattctccagtgccattagcatataacttcgtaaactacaataaaatgaaactgaacagttaactgattttattagactgaagaatattgtaagtgccagaccaagatacatagcactagtcaaataaatcctaactggatcgtttgccctttcctgttacttttatttcgagtcatttcaaacctacagaaagttgcagtattagtgcaacaaactcccttaaatccttcatctgtacacacacatataaagaaatatatatgtgggattttttaattttttttttgagatggagtctcgctctgtcgcccaggctggagtgcagtggcgcgatctcggctcactacaagctccacctcccgggttcacgccattctcctgcctcagcctcccaagtagctgggactacaggcacccgccaccatgcctgggtattttttttgtatttttagtagagacggggtttcactgtgttagccaggatgggtctcgatctcctaacctcgtgatccacccgtctcggcctccgaaagtgctgggattacaggcgtgagccaccgcacctagccccatatgtaggatttcttcaggaccatttgaaatttagagacatcatgttacttttcccttacttgatcatgtatcttctaagtgcaagtatattttcttatataactagaagagaattatcacactcaggtaatttgacattgatataatatctagtatatactccatatttcctcaggtattccaattatttccagtactttagcttttaatagaactttgggtggatttattacgccatacatataaaccagtaaacatgagatacgttttctggctaaaagtcctttggtttcttagccttggtcatccttgcctctaaaatagcagctgacttgacttgggcatacactgttttattattactttttccctcacttcagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgtgtgcacgcacacgtgtttataaaggtagcagttgtaggaatgaatgagattgggggtgagggggtgcatatgtatgtctatgaaagcctaatcatttctgggcaatgatgtaaaggttttacgactgacctttgtaactatgaagttttctacacttgacctgagctcagaaaaaagaaagaaagaaagaaatgtcatcatagagtcttagttctagctctgccgttaactaacttgatgtttatcactcccttatgtttgtttatagttttactatatgtatttattcccaactggtgcaactttattctcttgacagttttatgtggactttaagttgctgttatcaaaagttgaacaatattccatacccttttcctttctccccgctagagtatgctcaggtaatcaaaatgttgggaaatggacggctagaagcaatgtgtttcgatggtgtaaagaggttatgtcacatcagaggaaaattgagaaaaaaggtaggtgtgatttgttttactttaatataaaattggttaagggggaaaatccctctacagtttttaactgtccatggacttcatttttggaaattcccaaaagacttaccttggtaaacagtgatttacctataagtaaaatagcaaggtctgtaatggtaattttatacaggttctaatgttaaagaagcatttgtatcacttgtattgtattcctgcccaaaaagtccaaattgagagacattctgcaaaaacaaacggcccagttttttttttccttgtcttttttttgatacagggtctcactcttatcacccagcctgtagagtagtggcatgatctgggctcactgtaacctcaccctcattggttcaagtgatcctcccacttcagcctcccgtgtagcaggggctacaggcctgtgccaccatgcctggctaatttctgtattttttgtagagatggggtttcttcatgttgcttaggctggtttcgaatcctcagctcaagcaatcagcccaccttggcctcccaaaatgctgggattataggcatgagccactgtacccagccagatggcccagctcttaatgcaatgttactgtcatgaaagtttcaaaaaaaaaaaaaaaaaaaagctggggtactattctagttgcaaggagacttaaagagacctgacagttaaatggagtaggttgcccttgtttggattctgatttaggaattggacatatagctgtaaagtgtacattcagaaaatttgaatatgagttatataagcattgtattaatgttgcatctcttgaatgtcatcgtgaatggactgccttggaaagtaatgattaattcaccatcacagtagttattcaggcagatttattaatcaggttgactaaaagtcccaactctgattttgtatttattttttttaatttggtatgttaatccttctattcccaaactaaaatctttttttctttttctttcttttttttttgagacagagtctcactctgtcatccaggctggagtgcagtggcacaatcttggctcagtgcaatctccgcctcccagattcaagtgtttctccagcctcagcctcctgagtagctgggattataggcatgcgccaccacgcctcgctaatttttgtatttttagtaaagacaaggttttaccattttggccaggctggtcttgaactcctgacctcaagtgacccgccggcctcggcctcccaaagtgctgggattataggcgtgagccacaatgccagcccaaactaaaatctcttaatttcttttctttttttttttcttttaaagaagtttatttatttgtttttttgagacggagtctcactctgttgcccaggctggagtgcagtagcgcagtcttggctcactgcaacctccgtctcccaggttcaagtgattctccagcctcagcctcccgagtagctgggactacaagggcatgccaccacgcccagctaatttttgtattttttagtagagacgggtttttgccatgttggccaggatggtctcgaactcctgacctcaggtgatccgcccaccttggcctcccagagtgctgggattacaggcatgagccaccgctcctggcctaaaatctcttaatttctaaactaattgattgttactctggaatttcttgattcttcgttattttaaatgtgacgggcagtgacttttcttttgtaggtttggataaatacctcggacattattttggttggtctccgagactaccaggtaaaatttacatgtaaatttttcctattttactggcttgaatttgatgagccatttcttaagagccagttttgtttcaggcattgtgctaggtatcccagggatttatgtttaaatcaaaatctgggagccattattctaggggatacagctgaatgagttaagtgcccatcccacaaaaggctcatagcctggtagtggagagagttaagcacacaagtaattacaatacacatcacaacataggtatgtgctataaatctaaaggagcacttgggaaagaaagaaagtggtggttgcctttcgtgatggtaacccttgactctgtagactcattgtgggtctgtgagatccatttgacatccacctattggaaatcatccctgtatgatactatctctatttgtatagcctcgatcatactttgatttaaaaaaaaaaaaaacccagaataaataatttaaatcttcactttaagccattgtttctcaactgtgggcagttttgccctccgagggacattggcagtgtctggagacttttctggttgtcacaactgggggatgggtgcagtgctgctagcatgtagtagatagaggctggggtgggcacaggacagcatcccataatagagaatggtccgcctcacaataatccatagcgctgaggtgagaaagcttgctttaaattcataccattttaatgtccatttttttcttatgatctaacaataaccccagaaataggaagaataagtaatttcctgttcgatagataaggaaaccaagggtccaaaatgagtaacattttgactgtaaagtgacagccaggaccaacttctgatttgaaattattcatgatctttccgtgcccctcctacttacagggtggtcaatggctcgatagcatcttctggaagcttgttagaaatacaggttctttgactcttcagtcagaacatgcattttaataagatctccataggcttctatacactttacattttaagaagtactggtctgaatcacactgtccttgaagttgaagcaatcaattttctcccttaactgagttaaattattttcaaatagggaagtagaaacattctaaggcagtatttctcaatgggacttttgcatcagaaatacctaaagaacttctcacaatactaattcttgggcttctcttcacatctactaatctgtcttcagaagatataaaagctccacaggagattgtgattgatacctaggcaaagaagcacagataatacagaaaggtataatttccttaggtcattataccagtctcagttcagtctcagttttggaattgcagtgtttgatcaccctgcaaattattgtcccagggaacttttgtacttcaaaagacttctgatcaaagggtaatattaaataatctaaaatatggggtatgcacagttctgctcttattaaagtgagatctctatatttcccaagcttgttaatcattcaggcatgtacataagcttcctcttgggttaaacctaaggatctttttcagagggtatgagaaagctttaaaatttaaaaggagaaagatttatagtaaaacggtgagatttgattgtttattcaatatgagaatttatgaaataactgataatattttgttatgatcagttttttaaagttatttgtctctatttaaggataacaaagctgatgtaattttaaaatacaatgcagacgaagctagaagtctgaaggcatacggcgagcttccagagcatggtaatgtctgagttactgtattaacttgtcatatggtatttaggttatgtgttgctggttaggtgaaggaactatggattttgcttatttactttagtgctcacatttttagttttaagtatgcctgcctatgcttcataatactagatactataagaaagaaattactggaattctgttcctaataaatatggtgaggagttctgtaagctttggacttccacataatgctaactaaaggaataattttgttatagtatctattaaaattccttcctcgagagactgtcagtgcgcatatgggttaaacacgaagtgcaagtcagccgggcatggtggcacatgcctgtagtctcagctacttgggaggccaagacgggaggattgcttgagtccaagagttcaaggatgcagtgacctatgatcatgccactatactcgagcctgagtgacaaagtgagaccttgtctcaaaaaaaattaaaaaaaaaaaaaaaaaaaaaccatgaagcaagggcaagtaattaggtacagttactgattttgtttgtttgttttgaaatggagtctcactcttttgcccaggctggagtgcagtggtgcagtcttggctcactgcaacctctgcctcccaggttcaagcgattctcagcctccaaagcagctgagattacaggcatgcaccaccatgcccggctaattttgtagttttagtagagacggggtttcaccatgttggtcaggctagtctcaaactcctgacctcagatgatccacccacctctgcctaccaaagtgctcggatttcaggcgtgaaccaccatgcccggcctcattactgatttttattaaaaagttatatttccattttatcgttgtataatagtatcccataggattttttaaaagcaacatttcttggttttcacccttccaaatacaaaagtaatgaattcttaacgcagaaaacctaaaaataagtcccttataacctcatcaaaggggaaatgtacttgacatactgttctgtaggcctgcattttcacttggcagttattatttttggctctgttgtatcttaagaaaaaacataattttgttatattttacttaagcatgaaagtcctgctgaaattacttagcatttctgatctaagaaatgttaatgtatataggaataggactagcgcttcctggttcattttcattgcttaggggtaatcatgatttgaccagatctttctgattgatgagtctatctgatgattagtgaaccagctattcttaaggaaatacgttgttaccatatttccttgtatgttgagaagtatacctgaaagttataatagcttcagaattagtgtaattagggccttccttactaaaaatacctttgcaaacaaaagaaaatggtaacacagatactcccatcttgacttagcagtgacactgcaggaattttttttcataaaatattctttatagttattgtcttatataaaaggaatgctcttatgatgaaactttgagtaaattacagtgctgacttatgagtatttcttactgtgtccttagctaaaatcaatgaaactgatacatttggtcctggagatgatgatgaaattcagtttgatgacattggagatgatgatgaagatattgatgacgtaagtagatgtaccttgtgttttccaatttttgttattatccatggagaaaccaactttcccctaacatccattaattttaagaacatgggacacttaaataaggttgtattttgagaattgtctgaattaaataatattatttagaagacacctggtcaaactgtttatattttgagaattctttttttttttttttttttttttttttttgtgatggagttttgttctgtcacccaggctggagtgcagtggtacaatctcagctcactgcaatctctgcctcctgggttcaagcgattctcctgcctcagcctcctgaatagctgggactacaggcgcgtgccaccacgcctggctaattttttgtatttttagtagagacgaggtttcaccacgttggccaggctggtctcgaactcctgacctccggtgatctgccctcctcggcctcccaaagtgctggggttgcaggcgtgagccaccatgcccggccctattttgagaattcttataaccctcttcaatttctcttcctgaaaaggtcagtgtttgcattggcaatattaacgccagccactctaatcataacttgtttaattaagagtctctaaagagatagccattaagaaatttagtggacagttgaaaaatagatcttatcaaaggaacatgcctttttaattgaaatattagtgtgttgaaagaatcttgtttgaaccagcttgatatgaagcattggaattacaacatacactgaaagccttgtcaaaatggaagcctattgccaattatggtatttttagctgttgggtgtgtactgttggcaaactcttggtttgcagttggtatgtttattttgaggaaaatggattgtctttcctaataataaagtagtaatgcccataagtgtaaatgctttactgcacttctgctgttactgtaattgaatgaaattcaaacttaatcttttggcagtataaatttatttagtgattagggtgttactcttaaatctgttttgggctcttcttttcaaacctcttttaactaaaatgtagttcagaaaccacctgtgtatttcaacccaaaaacaataataagtcagatgtggtggtatgcacccatagtcccagctactcaggagactgataggggaggatcacctgagcccaggagttcaagaccagcctgggtaacatagccagactttgtctctacataaataacataataacgttaaatttgatgcaaagatggaatttcggaatacctagagcagttgttcctgaccaagaatactcacactgtgagttaaattactaatattatagacattttaacatgtacacaaaaataggaagtgagaaataaacatgttgttctgttattttcttaattttggagaccctgagccaagaggagtcttacgactaaactgttactaatattttgacaatagaattaacaattctattctttggtaaataagagcttgcagctgacatgtggattaagcgccaacccaaacattttgacatctgagcaggggtagaaggcctctttaaaaaaaaaaaaaaattaaggaacctaaccagagaacatgcatggatatgaagccgcatgcaccaagataatgggttgagaatctaggcgtggtcaagattttctcagtaaaaatttctggatctgggccaacgcctcctcagaactggacccagctggctggctggaaaagggatggtaaagagtgattattaaaggagttctcttgaacattttgtaaaagttggctctgtcacctgagaaccctactctttgagacatttctccaggtggtttatagatgttttaactataaccagattgactcaggagaattaggtcagtatcacactgaacgggatcaatcatatcatgcttcctgtgtctgctcccatccatgagatacaaaaatctcaaattacaagcattaaaggaaggagacagtaaattttattaagaatattttgcataacatgtaacattacaaaggagatcatcacgatttacttatagcaggccagaattataggaatttcttcttcaaactggatttgtttctcacatagcctaaggaggtgaaagtctcccttatatatggagtagactgttggaatataagaattctttttcctttcatctgatgttcttttcccttccagatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatg

SEQ ID NO: 35747 - DNA, 17322 bp, Homo sapiens; identical to SEQ ID NO: 35746

SEQ ID NO: 35748 - DNA, 13067 bp, Homo sapiens
agcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgagcgcgccgggagcccgggcggctggccggggggggcctggcgttggggagggacggggatggccgcgggcgcgttcccctcccggccatgggcgacccggcgacccggctgggcgtggccgcccgcccgcccttagcccgcgcttcccgctcccgctgggcgccccgccacttcctgaggctgggcccagggtgggggatccgggagggtgcagttcgggatcgcgaaggcagccccggaaggggggcgggccggtcggggtcgccacatcttagttcggaacccggccgggggcagagggtgccctaggggacgcgaaggagccgcatttctcctagagcgtttcaccggacccgggggctccccctctcgtcttcctccgttccccaacttggaataaagaatcacctagtaagtggcgccctgtctcagctggttttctctgccacgacctgaagtctgcaattccgatctgttttgctctgctcgttcgaattgttctggttccatcttcccacgcctgggggtctggctttgtgtgcgaagacccctttcctgcagtctaggcgtggacgggggcgggagagtgggcggagggtgtggggccccactccacagccccaggtttgctgctgcgctgtctgcttggagattaaaatgaaacgtgacttctaggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtaaatgaatatttcctctccctgcgtcaaggtcacacagtggtagaacaactgcgaccaccaacctatgttcagtgtacaacctcctgagacctgggaggatccccttgaactccgccttagacctatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacaaaggctccctaaaatcttaagtcatttggaaagctcatttgaaggcttttgatgttaatatcagatgaaatatgtagttggggccaatatttaggattgttcaggtaagaaaggtgcttgaagagttgcctttcctctggtgtccttgttacacacataactgggtgtgtttggaaaccagcaacaccgttgcccgtatgttgatttgttggtgatcttgacttgagcactattagcatgctgttgtggtgaggcaggttttcttccagaccgggggacggtctaggtctggaggctgaactttatgtaattcagggggtcctttaaaagaaaatctaaaatatagttttgcatattttacaaaaatgggactgacgaatgcatttccttggaagggaccctgaaccttaattttctgtgggataaagctgcctctgtccacagcaggtcacacttaagcccctcctccccagtaactgagtggtgctgggattatgcaggctgaggcctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaacccatttctcccccatcatctaaatggaatatattgtgcttataggtattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaaccttgaaacttacatcttggctttaggtcctctgaagtataaaactagtgatgttgctgttattaacaagtcagttttgccttcagtcttctaacttgttttctgtttccttcataattaaaatgctcacttgataatactgccttcctgtaatgattgatgttcctcattctaccagcgtcacctggaggacagtgttggtaagcttgaagaaaaatcgtgcatactggaaacaatggtcttgcctcaaacctgttgagaacttctcttccctgcttctctccataatttgaagaagcaagaaatgtttctgaagtgaagcataaaggagtatcttcaagctctatctcatacctaccagcttgcatagagtataatagtgggaagaaatattgtgaaagattctagaacctaagtcctttctaggctaggcaattctaggctacacaattcgtagtctctgtaaataccatttgataactgaaataaacctataaagtgggattaaatgttagtccagaagactaagtgatttaaggaaagagggaaaataaccagatagatttctggtggatattcatagacagacataatttcatcatgtattatggccctaagtcatctattttatattaaaacatagatggtaactgtaaagttatcaaatgtaaaaattactgggctagcattgtgttttaacactgatacaccagttgattacagtgttgacagaaaacgggcagaaacacgtttaaagtacctgcagaatatatatatagaaatcttttttttttaatcagtgttgaccaggttggcctcgaacgtgtagcctcacctccccgagtgccagggcaaccggcctgagccacagcggctccctagaaatcttaagtgcaggaaacaaaactacagtttaaggaaacaggagtcggagaggaggggcatttggcccaaccactggcaaaaggctgttgttgcaacaactgtgagattctgggaagtggggaaatgagcaggtgctgtgtaaaagtgcacagctgactgccccaggtgagacagatcagtgtcacagagagtaggaggattttgaggtgtgattagtattttttttttttttcttaaagagatggtctcgttctggaacccaggctggagtgcagtcgtggcacgatcataattcactgtagccttgagctcctgggctcaagtgaacctcctgagcagctgggactacagatgcatgccaccgtgcccagctaattattaaattgtatagacaggatctctatatggtacccaagttggtctcaaactcctggcctcaagcagtcctcctgcctcagcctattaaagtgctgggattacaggagtgagctaccacacccaaccagtaggaaatcttaaagccacattgatactacagtttgaaatatgtaaaaactagggagctatgtttcccactaactgggcatttaaaatgtaatcgtctttgaggaaggaagaaggctctggattattcttgtaatagtttgaatttaaaaggtcctttcaggtgggcaaacagcttacgtggctttcttgcactgaaatagaaactgtagtccccatgtgggtttgggtccctgaattatccccagaagaacttccacagtccggaactgactcccttaaagaaaccaaaaatgtattttctttggtggggattttctttagttggtctttgtctgggattttatatcagtgacagactgtagcgtcacacttttccagaaatacggtttcggagagggtacccctaacgttttatgtgtgtgtgtgttacatttagcaagtttatataacatattttacttttttttttttttttttttttgagacagtttcgctcttgttgcccaggctggagtacaatggagcaatctcggctctctgcaacctctgcctcccgggttcaagcaattctcctgcctcagcctcccaagtagctgggattacaggcatgcaccaccatgccatgcccgcctaattttgtatttttagtagagatggggtttctccatgttggtcaggctggtcttgaacacccgacctcaggttatccacctgcctcggcctcccaaagtactgggattacaggcgtgagccactgcgcttggttagaacttatttaactttttaggcacttggtaaacggtagctgttagtccatgtgtacttttttttttggtgggggggggagtcatgctctgtcacccaggctggagtgcagtggcaggatcttggttcactgcaagctccgcctcctgggttcacgccattctcctgtgtcagcctcccaagtagctgggactacaggtgcccgccaccttccatgtgtacattcttgtttaacaattcaggataggtactgttactcccctttacaaatgagactttcagaggttgattttctcatggtcaaacagctagtaagttgtgaattcaagattcaaactcaaatttagagctctcattttaaccactatgtaacaatgccccatgaggcaaagggataatatgtctagtatacattctggtatattaaccattgtcagcactggtgactgaaatccaagaactcttcataagtgggcttactaaacaaataattttatctgttgggtgcaagtcattttttttttccaaatacgattaagaacaatctgccatttatgggttttagctacaacagagaaacataagagggaaactcacatatctggattttgcttgttctgaaggcttggaggccttttttttttttttttttttttttttttttttttttttgcttaacaaagtattgaatttgagtttctcctgagttaagaagtgcaggactatgttacattttatttggggtattttaagaaattatttcatattcttggcaccagttgtttctccatattgcctttaatgtatttttctccctgcaccctttagtatatttttatgcaggccccaaaatttctgtctctaggttgctggtaaaattcctcctagtgtccaagtggaggcagcttgtcttctgtcccagcattttggtgctcctcccgcccctactcctggctgcagtggcattcccttctgcggtggtgagtgttagcacttccaatgatccgaacctggcacagcttctgaagccttcaattcggatgcctctagggacagtagcatgcagtaatgccattcagatggtgttgtatttaatccttgccaatccccatgaaaatgttcagttatgtcaaaagcaaggcaaaaacagtctcttggctatacaagggtagctgttttatttgactaaaatttagcttagagtggatgttacttacccgaacttgcctgctctgagcttgaagtttagcctatttgtggtcttacagaattgcagcctcatcctggtgaggataaggggctcagcctgaccctggctggtgatgttcttgcccagtggcctgtaggacttggtctgttggtggatatctttccagcttggggcaggccaggcaagatcctcacttcctaagcattaacttgggaaagagctcagcaagctttcatccctctagctcattttttgtttttttgagacagagtcttgctctgtcgcccaagctggagtgcagtggcacagtcctggctcactgcaacttccacctcctgggttcgagcgattgtcatgtcccacccaagtagctgggattacaggtgcacgccaccatgcccagctaatttttgtatttttagtagagatggggtttctctatattgactgggttggtgtcgtactccctggcctcaagtgatccgcctgccttggcctcccaaagtgctgggattacaggtgtgagccatcacacctggcccctcaaaccctcaaactgacttttctcacacagacacacacacatacacgtacacacacacttctgccaaagaagcttaaaggttttatgatgtggttatgtttacttaatcatgagaatcatttactcatatcaaaagcaagctggttgatagcatgtaggtgtgggtagctataaaggatgagcccatagcatgtgtggagctgtgaaggatggcagcatattcgagtgaggtagcattacccctaacttaggcagctatggcctggcagctcgggggtggcatttttgtttgctcagtgttacttttgatgttggatgtttcccagattgagaactttaaattttcctaaatagtccctgtactgtttttggcagtggatctatttttactcacacacatagttttttgccttgtgagtagtgggtggaggcccttaggggtttttgggtaaatgaatagtgtcataggaagataagtgaatgatcagcaggccaggtcatttttgacatttagtaatgttgggggtagtcctggagcagagaaaatgtgtgaagtgagtgccctggggtggggactaggtgtagccaaaggctgtttggtcaggacgtgagtaaaactggctgacagggaagtccaatccttaaaagaaatggagaggagggcctttgtgcatgggaagagcccatcagtttaaggttgtccttcaggaagggtgtaagtaggattacagagggtgggaaggcaggcaggacacctagaaagcagagaggctgtgagcaggggtggcgaaacccctggtttgtggcccggtgaagactcagtgcctagtgtggctacactgagggaaggtgccgtgtggcagaaatgactgttgtaatcttggtgttagagcggaaagaggctgaaaactattgtctaggcctgtctgtaaaattctgtcttgttgttgcttcatgttcctgatttgtggagatgcagcaaatgtgatttcattagattttgcagatgatcttaggtagcatggtcggggcctggagagcatccattactctgtgttgccacccggtgtttgcctctcagtacagtttatgactgaacttttcattagttctcctggctcctgtattttggtatttgaagtgttgggaactggtgctaagtatcatccatcaagattggctatccatctttttgttttaatggactgtctgattttacatgggtctataattttccagtctgggaaaaactcagttttctttagttatctggtcaagtagtaagccatcttcatttcatgtttccttttgttaactgaattataacccaggagtattaaaaaatactgtatttaaatgtatccagttatttcctagttaggctctggctggggtattaggaacaatatttgcttgctgagatatgttagtcaccctcagctaatgctgatagtgattcattcagactggcaggcaaccagatgatttttacataaacactaatactcccagtaaatgatttttcttgtgaaggtgtcatcataaatactgcccagtagccttttttggcagcttattcctgatggagaaagaatatgcttacagatacacccaaacttcacgttagtaggaagccctgccacaccttttattggtgcacaggaaaaacgaaatcatggaacattggagctgaaggaggccttggagatcatttgggctaatcctgcttattttactttggatgtccaaaaaggttgtgatttgtttaaggtcacatagctagctcagactaaacttcagatgtcttgggtttaataattataccgccttttgtgttatgcaagcattctgtattatacatacatgtatttcagatttgtactcactttaaatgatatactctgggaagttaccttggtgtatctttgccagtttcacagaagcagctttgttagtcacaggaggaagtatattgtgactccttatggatattatttgtattttaatgccaaatggccttagtttaattactacaagatgaaaggagctctccaaattctgttgttgccttatgctttgttttattgaatattgctctagaaacgcaagtcattctagaggattcaagcattctgaaatttatcagaatatttgggatggaattttgattcagaagtgttgttcgttaaaagactaagtagttactcatctttttgtagttcataagtgtgatgattgggttttgacatgcaggtgtgagatgtgccaccctcaaaccttgttacaacatagacatgtgaccctctgatgtgggcaaaaaaagactaagttattaaatatttacaaagtctctattttccgtaagaaaatgtatgtaagtgtttaaaggcacttactggaggaggaaactagtggggttataggtgttcagctggatttaaggggagcatggattgtagattcatggtagactggggcagatcacagtgagaggtatggagactactaatgaatatgtgaggatgaataatgagaaccctggcttgaccagagtggaggcagcacccctggggaatggtcaggatagctgttagccaaagaccacactgaagaaagaagtgggtaggcaaaggagagactttgcctgtgttaagggtttgtagcagaagagtaggggtcctggggacagggaaatggagaaattaagagtgagctggtatttttattttgtctggggcttgggggtagggaggactcagacaattgcttgttttactttgtgagaacttggcacgttttctgatttttacctgtaataatgattacacttgctgcttatgtccttgaaccactaattccccaaataaaccatcattgttcatgatttctgatactccactgctcagtcttctcaatccattttaagtgtgtctatttgaatatgctattgataactttccccaatgaacttggccttttccctctggaggttctgtccttacagattggtttaagtaataccttttttgtttagtgttttatggtttcctaagtgctttgctttcttttttttcattattgaaattaaagaccttttggataagcagagactgatttaataaaattaaagacctttaccagtaggtcatattaaggaatccctctactttagacgacacaccatcttttaagggcttgtgaaatgtcctgggtcaatttaggaagtcattttctttgcttgggcccagaccaactctgttagcaactctgttaggaactcttgttaggaaactctgttagtttcctagggggtgctgaacctagtacgacaaactggatagtttaaaataataaatgtattctctcatagttctggacgctagaagtttgaaagtgaggtgtaggcaggccacgctccctctgaaggctctagggaagaatccttcctaggcactctcccagcttctggtggcttctggcaacccttggtgttccttggcttgtagatgcgtcactccagtctttgcctccactgtcacatggcattcttcctgtgtgtgtgtcaaaatctcactatccttataaggacacctgtaattgcacttagggcacaccctaatgtccagtatgacttcatcttaactaattacatctgcaaagaccctatttccaaataagctcacattcacaggaacctagggtcagaacttcagcgtatcttttggcgggggatacagttcaaccactgcaaagtctaataatgctcttcctactaactgcatagctagttcacttgtagttggcatcatggagaactaagggaagttaaagcttgtgaaatttaactcttccacttaaaataattgatgcttccatccttgatgaccagagtttcctgtgaggtaggtcagagtacaacttcctgctgagtagctgtgcttcctttcactaggagctgggggtactttcatgtcacttatgaattgttcttcattttggtttgggagagggctgggagtatcagttagggttccatgtgtagccacacagggcgaagctctggccactggatctgtgtgatgttccatctgatctgtgaagccccaccatctgttaatgtgtatttgaggagtggttggttctttccagagtataaagctggaagcagagtctggaacacttccagtctgttgtctttgaacatttgacaaagggaccgtacgatcttactgttcagagtatcttttttttttttttttttttcttttgagacggaggcttgctctgtcgctagctaggctggagtgcagtggcacgatctgggctcactgcaacctccgggttcaagagtttctcttgcctcagcctcccaagtagctgggactacaagcgcgtgccaccacgcccagctaatttttgtatttttagtagagatggggtttcaccatgttggccagaatggtctcgatctcttgacctcatgatctgcccgcccttggcctcctgaagtgctgggattacaggcataagccatcgcgcccggcctgttcagagtatcttttgcagaatggctgaagctcgaggttttcttcttcaccattatgtactgctgctgtacaaccttttcataattatccttagtcccattcctctaccaaggtgaaagcaacatcttatcagacccgaattatgaatttctcaagcccctatgattttctgttttgggtgccaagtatttatctcttctgttagactatagtctttcttcacatagggttcatgtctatattggttttatccatgggtggtttttattctccagagtgactgacctgttcgtaattccgttcttgagaaggattgttgattatgttgaagggaaggcttcttaccaagattttcagattttgctttcaatgtttatctttttggggttttgcaggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatatt

SEQ ID NO: 35749 - DNA, 37885 bp, Homo sapiens
gggtctctcggtcccgcagccgtgaggaggacggtctgcatactcgctgcccgccggctccctcccccgcgtccctgcgaccgccgcggcgaagatggtgagtaggagggaggccgaggcgtgggccgaggcggccgggagcagtgtgtctctggggcgccgcggagtcggggctaagggggtgagccgtgcctcagcccggggagggacccggtccggctgcagtgtccgggctgcgggtgagggggggtctctgggcctccgtctcccgccgtcctggctgggcccccgcgccccggggtggatccgcggctgttgcgcagctcccagctggggcgaggccgccgccctgagcgtggcctctgcgggtgtctccagacccggccttgcaacaactggctggggtcgagcgcccccacccgctctgtgaaatccatccgggggtctgcacaccgaggccggggagtggggggcggggggcgtcggaatccggccaccgtccttgttggcgtgggtttccccagagctggcgctgaggcgcttggtgacttgtgcgcgttccagcccttgaggtctgtccatctcaataaggaagataaagcctttatggaacagtcctagagcacggaatgatcgctaacgagcaggatcctggcatgatttagaacggggtggccttgcagctcctttgtttttttctttttatctggcaatcggcttccagcagcactctcgtcgtgcttgtcaagcttggcagtgtctgttttaacccttccctgcccgatctgtccgtgtatggttagaattttttttctgacctgtagacagttggactctgccagaacttggtgcgcaaggtgtgggcatgatgctgggatgctgatacaaccaaatttaagagctttaaaaaccattaaaatactggagtcaccagaaagtaaacaggtgctcattagtatattctatatgatggacattttgcttaatttacatattttccccctttacactgtcactctaattagctatttaaaaacgtattctcaactgaactatcagttggaacattttgtcgttttcgttagtgtgcacacactgttaccatttttggtcagtgatttgcaggcgtagccttaccagactttgctagaaatattacactgtaattgcatctgtctagaagcagttggtaccagcttatctgcatacaaactgttttcactgtataacagttttggttttcttaagttactacaacttccgtgaacatgcaggcggccccttagtgaaagaaaagataaaccggtagtttcttgatgactgtagatatgtatgtaatagggatttgatactgttcagtttttggttcttctttggtttaatgctgtaagctacaaagtatcagcatcttgagtctttttaatatctaattattagaaatttaataacattttaaatgtatatgctactttatactgaaagacttaatctaggggctttgagttatggtacgcttaagaccattcactctgtgaaagtgctttgaagctgactagggtctgctctagagacttctgatttgacattatgcttttttattgagtggctaatacagactttatttttctgtttgaaaataagagaccaaacattttacctttagttaaatgcttagttttagttaaagcttaactaaattcaaggaaggaagggtctgttatatttcctggttcttgtgaggagtgggagaaataaaaattagaaatgagcgatttccaaatacgcttcaaaattgttggctttagggagatcaagaagaccttacaagttactcttagagttcagattatagaccccccatttttaaaggttatttttgtttttagccttatgagcgcaggagcatctttgtttagttcagtgattagagaatattgtgggtattatcccagagtctagcactttgcttttagctcttttggttagatgcttggttccaagtttcttttaagattaaattttaactaccgatgggtttgttctaaattagcagaatcacttccttgtactcaccaagtcttttagaagcacctgaaataaagcagtttgaaaccagctgggcgcttcaggatgagattagatgttttcagatgtctcctccaacaaaaaacaaacaacgtctgcctccacgtgaaccacaattacagaccccaaacaaaacgtgtgtgtgtgtgtactgggtgtgccagcctccttatacagagattgtttagtagcccatcatcaagttactaaggttatttgctcagtagttctactggatatggattgagacatcacacctagacttgcctagctcctcttgtaaccagagtatcttttatgcttcttggaaagtaagagtgtagtcttgcccctgaagtagagttaaaaggtttgcacgataatctaacccttaaccttatcctaatctggactgtggtctcacagactgaactaattggcgcagtattcaagtattctaatacttggtgattagcaaaaacactacaacccagtgaaataggttgggcatgtattcacatgcctatttaacatatgagaaaacagattgtaaaggattaattgacttgagacaaatcaccttttccaactccaagttttaaaataataattttgaaacattttaagcagaaaagtacacagaataacagatccttttgtacaggaaaaacagggctatcttattgccatatttcaggtttttatgttatcattacagctaaatatgcatcatcttcctcatcccactcccttccctccctagagttataaccattcctgtgtcaaagacataatatcctggctggttaaggagatgattttattcaggctattgcaattaggagagcattcctgattgccttatttgaaaatatgcaacaggccagttctttgcagttacctgtttcccagaacacaaaacggtggggtggattaaccatcactgctttctgagaacacagagctcaggtaaagttcacagtagtcacctgaaattgatattcattgatagttccatacttttagctacttaatcattcatatgtattgccttgatgtgcttttaaaacttacgtaaatactgtgcttcatgtatccttttgcagctctgtgagaaaaaattaaactttgtgggggtggttttttttttcccaggggagggcagcttttggatttatttgtagctttggttcttcaactgctgaattgtgttcttttgtatgattgtgcaagtttatccattcccctgttgatagacattcagccatttcctaattttttgcctttttttggtctatttaaagtttttataataggcaatttccatgtcatatattgctatatattacttctctagccccagtgtgtatctctccatggtgtatatctagaagcggaagccctggattggagcatacatattttctactctactactggttcgttctggttgtatctcatcattaacagcttgtttctacattgcctttcaccacttaataagagacttgaaacctttgccagtctgatggttgtgaaatggtttctcattattttattttgcatttctttgattactagtgagctgactcttttcatatgtttattgcatcttaggtttttacacgcatgctgcatcctgcaaacctggccattctgtaaatacttaccatcttcacctaagcttatttgcagagccataaagtaaatgtagcagtaaaaaaaaaaaaaaaaaaatcagctggatacagtggcctatacctgtcatcccagcacgttgggaggttgaggcaggaggattgcttgaagccaggagttggagaccagcctggacaatatagtgagaccttgtctgaacaaaaaaattaaataaaaattaactgggcatgctggcatgtgcctatactcctagctatttgggggactgaggtgggagtattgcttgagcctgggtgttagaggcttctgtgagctatgattgtactactgcactccagcctggccacagcgggagaccctgtctcaaaaaacaagaacatgattatcaataccagaacctcatactgaggagtaatatttctcttttctggcacataaatttctttccaggccccttagccagctaattaccagaagttcaatactctctgttaattctatccacctgccatttttaggcccctggtagtggtagaatgtagagtgacttaggacagagttctttccttctttgccaagggctgtggagattaatgtccttcactttacacttacccctctctttcctggcagttcttctagccaaaatgtaaaagcacacacagtagatatatgggaacaatgcacttctgctaaaatttgctgtgtacctaaaacttctctaaaaaattaaaagtctatagctgggcgtggtggcacgtgcctgtaatcccagctactcaggaggctgaggcaggagaatcgcttaaacccaggaggcggaggttgtagtgagctaagatcgcaccattgcactccagcctgggtgacagagcgagactcagtctcaaaaaaaaaaaaaaaaaaaaaattaaaagtctaaaaaacaaacatgcaaaacaagtaaacatgactgactttcttttctttctcctttcctttcctttttttcctttcttttttctttcttttctttttcttttcttttcttttgttttttttttttttttttttttgagacagactctcttgcagccacccaggctggagctcaactgcagccttgatctcctgggctcaaatgatcctcccacctcagcctgcggagtagctgggactacagatgtgcaccaccacacccagctaactttttaaaattttttgtagaaatgagattttgctacattgcccagactggtctcaaacaatcttcccgctttggcctcccaaagtgttgggattacaggcatgagccattgtgcctagtgactatttttcataaatagaatttgtttaaatcaaaattgtgtttaacttagtatacaggaagacttcaaatttttgagtttttatgttaatgtaactttatattttctttcagtaatatttgagatgaagcacactacatttgaaatttgaaaaaaaacttgcaagtcttgaaaaactgaatttaacatacaaatgcgttgattttgtccacagaacaacactctagtctctgagtaactagagctagtctctttgttgtactgtcatttgcatatgtaaaccacagagcataataaataagtagaatattgtgaaagcatttttttttttttttggagacagggtctcattctgttaacctaggctggagtgcaggggcgtgaacacaactcactgcatcgtccaccctcaggctcagtcagtcctctacctcagcctcctgagtagctgggactatatataggcaggcacaaccactcccagctaagctttgtattttaaaagctttacatatataaagatgggatttataaatataaatttatatataaagacggggtttataaagatggggtttcaccatgtttgcacaggctggtcttgaactcctgggctcaagtgatccacccactttggcctctcaaagtgctgggattacaggcatgagccactgcgcccagccgtgaaagtatcttgagtttacttctcttgtggcataacatttctgtctagattgtccatgaaagtcatacacaaagatttacacctaacacttcagcaatattgtaaccacaacttttcttctgttcatgcctcctttcattgatgttggaagtgagaagttttcacttggaattgtgcttctgaattacctcctgctcatttttcttgaaattttacaattgggagaggcatagacttagacaaataaacatcggttttattcatctcagtaatactttgggccaaaatgttatattcatcattgaatctgctgtactaagacccccattgagttgaatatttagagtgattcttagctccaagattagtcttctagaagctgatactgtaatacttacatgctgccaacactattccatgttttgctttgttatgttttacgtagattttttgtttggaggttctagcaggggagcgcagctgctcatataaccttgaccaaagaccggttctcctctatcaggaatggtcatcctctttgaccgagtgcatagctttgagagggatgcacatggagtggtgagggaggaaggggacacctgcctagccagccagatcagccgaatcaaccctggtgatcaatggggtgacagatgttgcagccagatcgccctcacatcatacgtagattttttaaaagcaattgatttcagtaaaaaatgcaattaaagttttaaaattaacaaagtaatctctaattgaaggtgtgaaaagactgagaacgtctgttgcagcacggcatagatgagtgcttgaaagatagaaacttaagttcattctacacctggaaggtcatttgtcattgtgtttgtgcttttggatcacatcaaaggaagattgtttactcctttgaacatttttacattacttcataggttgttatttctgtttgccttctcacaggaaagcaaggatgaatttcctacccttgtttctatcttggcttgctttcagaaaatagcttgtaaatgtaattagtgtttattttaaaatggtttcacaacttttctgttgctattttcatgtacaggtggagcatccctaatctaaaaatccaaaattctctaaaatcccaaactttttgaacaccaacatatggaaaattctacatctcacctcatgcgacaagtcaaaatgcagacaaaactttcacacatagaattatttaaaatatcatataaaataattttcaggctatgggtataaagtgtatatgaaacacaaatgaattttgtgtttggacttgggtcctattcccaagctatctcattatgtatatgcaaatattccaaaatttgaaaatatctgaaatcaaatgcttggtaccggaaggtacttaacctgtagtaatagaactaacactaaagcacagcacaggcaaatacaggtaaggcttctccaacttgccctggagcaatctttgaagtcagttgttgaagctcaggagttttgaggaattctcaaatcattgtaagaatctgcagcctgaccaacatggagaaaccccatctctactaaaaatacaaaattagccaggcatggtggcaggtgcatgtagtcccagctacttgagaggttgaggcgggagaattgcttgaacctgggaggcggaggttgtggtgaaccgagatcacgccactgcactccagcctgggcaacaaagcaagaccctgtctcaaaaaaaaaaaatctttagaggaatactctagttataagaatatttcatctttaggccagtgttgtcaaatggaaagaaaatacaagctatgtatatacttttaacttttctagtaatattttaatatacttttaacttttctagtaatatttttaaaaattgagaaattttacatataaattgtttgaaatccagtatatattttacactgaaagcacgtgtcaattcaggtgctaaattttcattggaaatacttgatctgtatttagatatgataaaatttacatttgaaaaagtagattcatatactcaagttgctccagacctacttacaagttttccagtaatggataagaataaatttttagaatttaagttaattaaaattaaatgaaaatacagttcctcagtcacactagccacatttaaaggactcgttaagtcacatgtggctagtggccactttattggaccaacctaagactttgtgagttggcctacttaatttgtaatgggaagttggtgtgtgtaccaactaaattctctgcatttctgcacatgtccaagaaacgatgctgagatagcatatgaatttctttataggacttaagatgttttatgaaactagactattgagctcttttaagatggggatcgtacattccagtagcaagataccactctcatagtaggcccacatagatgttactgaatgaacatgaatgagtgaatgggagagggtattcttaattatgacaaaggacaggttcccatggaggtggagtcctttaatttttataccttctattcccacataccttttttaatgtaatggaaattgggttttaagtattgaattaattgaatagtacctcccctttgtatactgcatgataatttactttgagtcttacaagtaaaaatccttcaagatagttaaggcagttattagagtaatacctttaaagtgattgtggcatattgaaagtcctcaataaatgccagtttcctttctttccttaaaaatgaaaccgtggaatttcatgctcattgaggcatcctgaaccatagaaaagcgctcaaaagcctaacaaatgaaagagcaagaagtggccgggcgtggtggctcacgcctgttatcccagcacttcgggaggccaaggtgggtgggtcgcttgaggtcgggagttcgaaaccagcctgaccaatgtgctgaaaccccctcctctgctaaaaatacaaaattagccgggtgtggtggctcatgcctgtaatcccagctacttgggaggctgaggcaggagaatcacttggacttgggaggtgcaggtggcagtgagccaagatcccaccattgcactccagcctggacaacaagagcgaaattccatctcaaaaaaaaaaaaaaaaaaaagcaagaagtaatgctgtcttacattaacttataagtatttaccttatctcattcaacccttatagcagttcattgagatagatattatttgtgttaaactgtactgccacattaaaagcatgtgctcagtgtctggctgctgggtttttttaaatcttgactctgccacttgcactaactgtatgacctttggtaagttcctgacacattctgtgcctcaatttcaccattcttccaagtgggaataataatagtacctaccaccacaacagtatgaatgatgcatgtaactagtttaaagcagtggcacaggccaggtgtggaggctcatgcctgtaatcctagcacattgggaggccaaagcaggcagatcgcttgagcttacgagttcgagaccggcctgagcaacatgacaaaacccagtctctacataaaataccaaaaaaaaaaggaaagctaggtgtggcagcgcatgcctgtggtcccagctacttgggaggctgaggtgagaggattgcttgagcccaggagcttcaggctgcagtgaaccaaggttgcaccactgcacctcagcctggacgacagagcaagaccctgatccccccaaaaaaagcagtggcaggtagtaaagtgcttatcagtttatcagtgttagctaaaataaatggtggcaagcttagatctaattaggtaaatagtcttttgttattacttgctatccaagtggaagaagccagaatcatttatttaactcattaaaaagggattcctgcctgactaatcaaaaggcagtttatccttcaagggccagctctaggaagacctgcctgacatgacacctcccttttgtcatcatgtctcatacagaatcactcatttcctgggctgtcaatgcatggagagcttgctgctggtgcagcattaatcatatataggattctttcttatatctgttatctctacccaactggatatatctttagaatagttcaaagttttgttcatctttatatcctgtattcatctttatattctgatgacaccagtgtgtgcctcagtagttgtagagcaaatgaaaagagttggaggagtgcattagaatgtgtttcaatagttttattctttctttaatattattttacttggaatcattgtatataatcaactttttaatttgaattttcaagtgacttgattcttgatgtaaaaatatcattttacactcttagttatatttttcctggagtaattaatggagaactagacagttttgcattgccctcaatgtttagaataacaatcatttattcaacaaatatttgagagatttttgtatgtcaagaactggtccaagcactagggaaacaagttctttcctcatggaagttgcaatctgatatggaggaagagacaaaaaagacaagatcatttcagctggtgataagtagtatgaagaaaataaggtaatcaatagggagtactaaggccaggcgtggtgactcatgcttgtaatccagcactttgtgaggctgaggtgggtggatcacctgaggtcaggagtttgagaccagcctggccaacatggtgaaaccctgtctctactaaaaatacaaaaattatccaggtgtgatggcacgcgcctgtaatcccagctactctgggaggctgaggcaggagaatcacttgaacccgggaggcggaggttgcagtgagccgagatcgtgccattgcactccagcctgggggacaagagtgaaactccgtctcaaaaaaaaaaaaaaatgggaagtactggaagagttgggctactttagctagaatttagagaaggcctcttttgaggtaggacttacatggcaataaagagctagctatgtgaagagcatttagggcagaaggaactcttaagtagaagggcctgtagaagagaatgagcttgacatttgccagggacagaaaaaaggcttgtgtggttagcattcagtcaacaagggggaaataagtagaaaatagattataggcaagaactagaccagaaagggccattaggtcaaaggtgaggaatttgaattttattctgatgacaccaggaagccattgggtgtgtgatggtggggaggtgttaagtagtgtagtggagcgagatatgatttatccctgtggttgatgtgtagagacatacaaatggggacaaagaccaattaagaaactattgctggctgtgtgtggtgacccatgcttgtaatcccaatgctttgggaggccgaggtgagaggatcacttgaggccaggagttaaagactaccctgggcaacatagagagaacccgtctctaccaaaaaataaaacataaataaccaggcatggtggcacgtacctgtagtcctagctacttaggaagctgaagcaggagattacttgaccccaggaggtcgaggctatggtgagccaagttcacgccattgccctccagcctgagtgacaaagcgagaccctgtccctaaacaaacaaacaacaacacaaccaactattgctttattcagatggtagatggtggtagcttgaattaagatttgttaataatgagaggtggtaagattggatatatattttgggggtagagctggaaggacttaatgataatttggatgtgtggcataagggaaagaagactatcaaagatggctcgtaaggcttagacctgatctaccagatatttgatggtgtcactatgcttgaggtcctataaaagaactaaaacaaaatagtttagcataaattgaggttcttagaattttgaggaataaaaaaattgattcaaaagttttataaatctttaaaataccataatttcatagttgattatataaaagtagtatatattcattgtagaacattaagaaaaatttagctgtaatgacagttccaaccaaagtattaacatttgggacattttcttttaagccatttaatatatattctcattttttcaagaagtaattattaactaccttctaggaacctggcactgttgttgtaggctctagagattcaataatatacaagaaaaagtccctgtctctatgaaatatacatttttttttttttttttttgagactgagtctcaccctgttgcccaggctggagtgcaatagcgtgatcttggctcactgcaacctccgcctcctaggttcaagcgattctcctgcctcagtcttctgactactgggattaacaggtgcgcgccaccacgcctcgctaattttttatatctttagtagagatgggttttcaaccatgttggccaggctggtctcaaactcctgacctcatgatctgcctgcctcagcctcccaaagtgctgggattacaggtgtgaaccaccacacccggccccgaagtatacattctaatgggagagacagttaagaaataagtaaacaaataagataattgcagattttatacgtattatgatgaaaataagggaatgagagagtgactatctggagactgccaatatagatttttctcacacacttgagttaatctataaaggataaaactgtatttcccatttcccagtgtgacgtgagtgccaggataattcagttggggggagaatagtgttttcaacaaatggtgctggcacaattggatatccgcatgcaaaagaacgtatttggatccctgcttcatactgtatgttgtatttaacttaaaatggatcataaatctaaatgtgagcactaaagctatgaacttctagaacacataggtataaatctctgtgaacttgtgttaggcaatttttgttggtagttttcctggcctttctaggcaatgacaccaagagcacaagtgacaaaaatagataaattggacttcattgtattcaaaaatgttcatcaaagaacaccatcaaggaaatgaaaacacaacccacagaataggaaaagatgtttgcaaatcatatacctgacaaggagcttgtgtgtagaatatattaaaggacttacaactcaacaatcaaaaacccacttgtttgggcaaaggatttgaatagctgtttctctaaagatgtgcaaatgactaataagccaatggaaaaaaatgcagaacatcattagccattagggaaatgcagatcaaaaccgcaaatactgctttgtacctgctaagacagctataatgaaaagattattgtagcaaatgttggccaggctatgaagttggagcacccatacattgctggtgagaatgtaaaatggcgcagtaattttggaaaatagtttggcagtgcctgaaaaaattaaacttgggagctaccgtatgactcagcagtttactcctacctacatatccaagcaaaatgaaaatgtatgtccacacaaaaacttgtacacaaatgtgcatagcattattattcatagttgccaaaagtgataataacccagtgttcatcagttgatggatagatggataaatgtagtatatccatgcaagggaagggaatattatttggcaataaaaagaaatgaaatactgatacatgctacaacgtggatgaacattgaaaatatgctaagtgaaagaaaccagtcccaaaagatgacatattgtgtgattccatttatacaaaatgtccagaatacacagatccatagagacagaaagtacattagtggttagtaagggctggggtgggtgggagtgggaatgaggaatgactgctaatgggtttggagtttctttttttttttttttttttttttgagacaaggtctctgtcacccaggttggagtgcagtggcatgagcatagctcactgcagcctctaccacgctgactcaagtgatcctcccacctcagcctcctgaatagctggaactacaggcccataccaccatccctggcaattttaaaaagtttttttgtcaagatgaggtctcactattttgccgaggttggtcttgaactcctggactcaagtgatcttcctgcctcaacttcccaaagtgctgagattataggcatgagccattacacccagcccagggtttctttttgtggtgttcaaaatggtctaagattaggaagtggtggtgatggatgcacaactttgtgactatactgaaaacccactgaatttactacactttaaacgggtaaatttcatggtatatagaatatatctgtaaaaactacttaaattgtttaataatatcatgcatgtacatcaccctcatgttaaatttatttttataagaaatactctgtcatcttgtgcataaatcttgcatttcttcaaaagagagtcctaggtatgaaatcactgaatcaaaaaggtgtgtgtatttctaatataaaaaaatatgcttacctgcagggcacagtggctcacgcctgtaatccctgcactttgggaggctgaggcaggcggatcacctgaggttgggagttcgagaccagcctgaccaacatggagaaaccccatctctactaaaaatacaaaaaaattagccgggcgtgttggcgcatgcctgtaatcccagctactcgggaggctgaggcaggagagtcgcttgaacccaggaggcggaagttgcagtgagccgaggtcacgccattgcactccagcctgggcaacaagaacgaaactccgtctcaaaaaaaaaaaaaaaaggcttaccagagaaaacttagaaaatatagaaaactagagagaagataaaaatcagttatagcctcacttttagagataaaattgtggaacttctttttcttctgtactgtttttcataattgagattatactgtacatgtaactttatatccagcttcttcattcactgaaagtaagtcataagtatttcccacatgcttttcaaaacttggcataaacatgattttaacagctgcatcaggaactatcctgtggatatactatcatttactttgcagttctcctgtttttatttctttgggctgtctgtttttttagtattatgtagattattttcctagaataaattcctagaagtgaggttactgggttaaagggtcaatgggtatggattattataaggctctatgatataaatggccaaattgctttctaaaagatattaatgagtaataaatagggttgcctgtggtggaagacaaatctggaaaagtaggttggtttacacaataaagtgctttttatggtctgttaataaataaggactttatcttgtgggtgcttgggaattgttaaagacttaatcttgggagtgataggagattttgagagtaaatgagagggaatagatttgaaatacacattgaaggaggaattggcagggcttagaaaactaggtgtgactgggaaacaggtagattagttaaccagcaatatcaaatctgtttcatatttattgatttgctagttaaccatccagagagaactaagacagcttgttaaaccaaggagaaatttttcacatttagcttactgtttggttaatatgctgtttctcaaagagtagaatactgaaagtattattcaccttgaaataaaaattatatatctaatttagtataatttacataaagtgaaattcaccctttctgctgtaagttctggaagttttgacacatatatatgtacacacacatatatacacacacacacatatatatacatacacatatatagttgtgtaactacagccacagtcaaaatatagaataattccttcacacacaaaaaattcctcattaatccctcctcctatccccaacaaccactgatctgttttttgtctctatagttttacctttgccatgtaaatggaactgtacattgatacactttgagtctagcttcttttcactcagcataaagcatttgtgcctcagcagttctattttattgctgaattttattccattccccagtggagaggtatattttattttattatttatttatgtatttatttttctgggttaaggagcagaaagtttaatagacaaaaaagaagagagagagagagaaagcttccttatgctgagaaaacaggtcgcccgagagagggtctccctggagagatatattttaattttttcttgtctcagttaaggatggggcagaatattagaatgattttttcctctttctaatgctcataaatccttgaaacagtcattttctctaccttagataaaactaatagaacttactattgcacacttgatagactacaacctttatatgcacagggaaaccaaaaaatttgtgtgacttgctttattgctatggtctagaattgaacttgcagcgtctccaaggtatgcctgtatatactaggaaaagggacatattttaggacaaaaccaatggcttgcctcataggacccagtttcatcattgcagattttgatttatagctgcaggtgatggttgtgcctaggagaatggtaggaggtattgtaattgaatcttactgtgttgagagaactattcccttctctttgctgttgatatggctttgctgtttaaccacttaatagtcatgtggagaaagaagagatgcacattaaattcttaggtttgtttttaattcgtagttttgattatcagagaacaaatggaaattactgtttcaaatcagtcttaagctgtttggtttctttatccataacattctgttacccaaagatttcaataaaaattggctgcattgttaactagaaagagtcgaagaagctctaactagattttctggttaatgtaagagtctttgcttagtgcatggaaggccttatgtgtgttgttttaatcagtccttttgagttagcagtatgataattcacattttacagatgatgaagctgaggattaaagaagttagctgacttgcccaagttacaggattttagtaagtctgattcaaccctgtggtacactttctcctctggttaaaaaggtcttcaaaggttaaatgttccaaattctgtttttgagaataacacagccagtttaaaaatatatatatattcagtatttgacttgctcaattttcccagttaattgtaaaatcagaaatagccctgtgtgtagtattgttacatacaatgaagttatctttattgctgttacataaaccttatattttaaatccattatttcacttcttccccaataactaggcttttgtttctcaaggaataaaaaaaaaaaaaaaaaattcttgttatggcatctgtaagaattaaggtctttgcttaaagtcaagtccttattatttttttgagacagggtcttgctctgttgcccaggctggagtgcagtggtgtgatcttggctcactgcattctccacctcctgggcccaagtgatcctccctcatcacctgagtagctgggactacaggcatgtgccaccacacctggttaagtcaggccctcttgtatgaaactttatgatgatccttcattttggttgttttgactctttccaaattaacactcggaataggtactttaaaaaaaaagagtttatctgaatttctcccaagatttcttccttgccctcagaaatagttaaccatagttaattgtagtaaactagaattgaagtctttacccttggaggcattattcttttttttttctttttttctctttgagtgactttgatattagaggcattagtctgtcattgtgtacatgataactgagtttcctgatgacagcaggcatcaatcaagctaaataatatattgttttctgaggcagaaaactatgaaatatggtcaataaatttgtttactccagacatactactttggtattaacagagttaattttatgtgttactttatatcaaactatttaaaatttaaaatttcttcagctttattagccacacatcaagtattcagtagccacacttggtagtgattaccatattagacagtgcagaaaagggacatcttcaccttatgtaaaatgctgatttactgagcacgagaccagtacataatgtactgttccctacttgctttttttctcttgcacagtgtatgaccataccctccttctttcccctccaggcacgtttcccctttaaatattgaagacctcaaaatcatctttgcagaaaggcataggccacagactgtttccgtgcttctgggttcttttcttctaggcatgtcctaaaccttggcaaaataaatttctaacttgattgagacctcaggtacttttggtttacagaattcacctatgtcctggaatcccctgtttgagttatcccacctttccagacttaaccaatgtacactttacctctattgattgatgcctgcttgtaacttctgccccacctaaaatgtgtaaaatcagtctgtcacacaaccaccttgggcacatgttctcaggaccgcctaaggctatgtcatcagcatgtccttaaccttggcaaaataaactctaaattgaggggaataaaaaggaacatttggctgggcacggttgctcacgcctgtaatcccagcactttgggaggccgaggcgggcggatcacaaggtcaggagatcgagaccatcctggctaacatggtgaaaccccgtctctactaaaaatacaaaaaaaaattagccgggtatggtggcgggcgcctgtagtcccagctacttgggaggctgaggcaggagaatggcgtgaacccaggaggcagagcttgcagtgagctgagattgcgccactgcactccagcctgggcaacagagcgagactctgtctcaaaaagaaggaacctttgtatcatcacagaaagttctgttggacagcacggctctctagaacagtgggacaaaggatttagtaaggcatgacttcaagatggtggtggtggtggggagagtgtttcagcactcatttacatatggtcacctgtatcctctgactactccagaactactgtttaccttctccagagaataaactccagaattccaggggtaaggggctggcagcaggatggcgttcaggagggagtctagggatctttgcttctcagacccatttcactcattcttccttatttgaacttccatatttcttctcttcttgtcgtggtggacttatgttctttttctttttaatcccatttttatactttaagtagagttttggtagggagatgtatatattcaacccctaaccctccctccccctactttttttttttgaggcagtcttgctgtgtcgcccaggctggagtgcagtggtgtgatctctgctcactgcaaccttcgcctcccaggttcaagtgattctcctgcctcagcctcttgagtagctgggattacaggcacacaccaccatgcctggctaatttttgtatttttagtagacacggggtttcaccatgttaaccaggctgctctgctgacctcaggtgatctgcctatctcaggctcccaaaattttgggattacaggcgtgagccgcagcgcccagccaagttccgcatcttaatataggacctgtgaggccctgaacacttctgtgaagcagaaatgtgctgaagaacttgtcactctcattttatttattgtctcagcatgattgttcagaagcatcaattatagcagccaaaagcccaaatattttgtcattagtcattctgtttctattggcccttgtgcaaggcatggtataaataaagtagaatcgtgaacccagtttttaactccctaactcctttgagaagttggtagaagtaggtagattaagatgctgatgacatttttgccagtttgaaaatttgctattgaaaatttgagtatttgtctgcagtatcctacattcaaatatttcagactttaccttagaaaaaaattttttaattaataattttctgaggtagttaaaatagctttcatcctgttttctctattaataataaggatcatgtgaagtttagttgtcattaattatgtagccaaggtcaggtgtctgtcttgagtttagtagtacggaaaaagaccaccgtttctgatttattttggtttaggagggactgctgtaagctatcattgcatttagcttttggactggttcagttatttacaaaaatcaaattagaaaaatttaatgctcacgtttcaaaggttactatccttatgctagaattgagagaattgttattttaagttgtgttctgtcctttgcaactgtaaaatacccagtgttccatattctttgtaacatttacttccctctgtgagtgagtagtaacatttttaaagaagcttacacagtgattcttaagtatgcatgcagggcctcagatgtattgatttaatctctgaaacattatttcacaaaagctgtgccagaggagactcagacaggtttgagaacaagttaaaaactggtagtcaagcgagataaaatgcagtgaagtatatttttaacagctattttttgacatgggggtggagctctaagagcaactgttctccagtggtcactggtacatggagaaactgaagttgtggataacatatctttttaaggtaatcacaaagctcttgttatgatagcagtctatttttgctctcaagattttccttcccatttgtgcagcaaacttggtgctatgttcagagtatcctttaatggtctttattgttaaaactgtgtacttgaatatcagtaactcttagaaaattttttaagtaaaaacaatttgattttgcttttttaaaaataaagtttaggtttcttgacaaatgagcaattaaatctaataacctaacattttagagaaatactagggctgggcatggtggctcacacctgtaatcccagcactttgggaagctgaggcaggaggatcacttgaggccaggagttcgagaccagcctgggcaacataacaagaccctgtttctacaaaaaagttaaaaaattagccaggtgtggtggtgtttgcctgtagtcccagctactctggatgctgaggtaagaggatcgcttgagcccgggagattgaggctgcagtgagccatgattgtgcctctgcactccagctagggcaacagagcaagaccctgtcccccttcccccccagaaaaaccacggaaatactgaaagaatgggactgatgggaaaggctcttttaggtaaaaagataataaatatctgtaaaacagataattctgtatattggtgttacagccacttttgttttaatattcaccatgatgttgttttgtgataacaaatcatccaaaattaatacaagaactctcaactattattatagataaactattatttagtataattgggtttttttttttttgggcaatcctgtatattttattttatttgaaacactatttccagaaagggcccataggctttgccaggagtccgtggcacacacaaaaaatgctttgactttggacctactaatattggtaaaataaagtactcttaccactactgcttcattataaaaattttgcctgtaggcaaagaagcccctatagcaatgagctacgattttattctctttcatgaaatttcagagcaatcttagtgatcatcacctgaagcttagtgtaaatacaaactctcagactctaccccagatattctgaatcagaatctttaaaatctgcaggtgattcctgtgcacattagagttagataataactgatctagtccactcccctaagtacagttaaaggaacaaatttaattcagagataatgacttgcctaaggtgacatagctagttagtagaggaatggggatggattgttactctcatgattttagtgctttaagatatctccttttggtctctgagatgttaataaattgcagttactttaatcattgtcttctttccatctgctaatctttaccccagattttcagttcacccactagaggcaaagacgtaagagagctaccagcgtattgagaggagatacacaggcactacgagaatggagtttagaagaaggtcagagccctgggcagtgttgggccaggctttagggttagtattccgtgctttctgtctgcctcatggttttagttttactgtataaaaatcattatcaagaacctagggactacagccaggcatggtggctcatgcctgtaatcccagcattttgggaggccaaggcaggcagatgacttgagcccaggagttcgagaccagtctgggcaacatggcaaaaccccatctttataaaaaaatacaaaaattagctgggtgtggtggcatgcacctctagtcccagctactcaggaggctgaggtgggaggatcgcttgagcccaggaggtcagggctcctgcagtgagccatgatcacatcactgcactccagcctggatgacacagagagaccttgtctcaaaaaaaaaaaaaaaaaaatctcggaaccggttatttaatctttatttcttttatctcggttttaatattcaccatatctcaaggatgtggtaagtaaaccatggtataataaatttaagtatattcattaaatctaacatatactataccttgtgggttttttattatttttgcaggcaaaatttagtatatagtgttactagtcatgaagagccatactactagttactagtcatgaagagccatactactctaatatcaaagccaccacagtggggaaattaaggaaagtgagcatttggcattattaattagcctcctgatcaccatacagactccttcctttccacctcccctctcccagtccagtgattgtcaactacaattgattgcacctatgcagttcccatcacttcctccttagtaatgctgccactaccctagtgaaggccttttgcacctcttgccttggttgctgaattagccttttagctggagtgcctactataattttcttcctcttcttgttctcttacgcatggcttcatgtattttcccaaagcacaactctgttcctcttactctttttaaaaatatccagtctccaaacccctgaaccttctgttggaggccttttccatctcaacctggtgcgagtctccagtttccttctcccttatcctcatctcctgttgtatttgctgggttctctttgtcaggagcagtcttttcatcctttcagtccccttgttttagagtgcttttaagtcagcatgaaactacctgatgaactgtctttctgtttaagctactttctttaaattcccttccactggagtttatcaaggaataatgtatattctaccaagtattgaagctttgtatgtgctgtccttatcttctccataagtcaaactaatgattcatctgactgatctttgatttttttttcagggtaacacaataatgaataagacagacaccgtttatcttaaggaacttacagtctttaagaacttgtggccttaaggagatgatattaagtaattttaaagatagagcattgaagtggtaggaggtggtgtgtggtggagatacatgatcttatgggagcatgtgatactggttttgatgcagaagacttttctgcgtagtgagaattgatctgacatctaaagagtattagccaaagaactgtagggaagtgctatctaggcagggtgtatagtatgagcaaaggccctgaagtgggccagagtatggcaagtacaaatgactgaaagaaagccagggtagtgaaattgcagtgtgtggtctataagataaggctaaagaggtaggtatagccaaatggagcccattattgggctgggggtggtggctcatacctgtagtctcagcactttgggaggccaaggcaggacaatagcttgaggccagaagtttgagaccagcttggacaacatagtgggaccttgtctctacaaaaaaaattttaaaaattagctgggcatggtggcacgtgcttatagtcccagtactcaggaagctgaggtgggaggatcacttgagcccaggagtgcgaggctgcagtttgctatgatcatgccactgcagtccagcctgggtgacgaagtgacaccgtatctcaaaaataaataaataaataaataaataaataaataaatagctattttttaccttcagatcaatggaaagccactggactgttctaagtatggtgatcagattcatgtttatgtagaggatgaattggagggtaaaggtgatgggcagttggtatgggcagtcttgttgtattagaactgcaataacaaattaaattcaaaatctcagtgacttaacacagtaaagatttgtctctgtcacgcagagtccagaagggttgggcagccttctcctatcatgaagtatgcttaccaaggtcatcttggtgggagaaaacagagctttaagatcacttttatttaacttttatttaatttttgatgttttaaaaatcattttattgtggtaggattcacatctaaaaagctgtatttagtgtatttaaagatcacttttaaagggccaggactggaagtagtttacataactgggcccagcttggctgttcagaactcaaatggctgttcagaactcagtcatacagccaactcagcttgccaggaaggctggggaatgcagtctttcctgttcagccaagaagagaaaacagtatgatgtatacatatcctaatctccctcctctgcagccacttgaggagttactgcagtccaagtaagaggcaatggaagcttggactgagggtgaaatgagatgaatgtatcagagaaagatgaaaatccaaagagtaagataatggaggagttgctaagaacatctcttaggcttggagccttatgtgactaggagggtggtgatagctactgagaaaggaagactggttagaaatggaccagcttgttttttattttagacatgttgtgcatcacatgcctttgagacacacaactggagatgtgagataggaagttgaatgtaaagactagaagctcagaagagcagaagtctgaactaagttttggcttagatgattgaaagcttgagcttgggtaaactctctgaggaagaatgcagagttcgtcctttccttccacactgccatcagcctctgctttccactgcattgtcctaccaccctcaccccttgacctcagctgaccttttggaggtccccagagccctttttcttgtccttaggtagttccttttggaactccccgtcatagctgttctgaattgttagtagtagtagattggaggagtgccctcaaacccatcctactcctcctgccttatacttcacagagaaaatagaatctttcagacacaatttttggcagtgtatcttccttccacctcaaaactgtcattttcccttcctccctgtttcagagaaaaaaatgtgtatctttttcttaggctaactctcccatctgtgctgtggatcttacccatttctttagatctctgatattgttaattttatgagtgattaagattatctcctctggaattgcttgaacccaggaggcagaggttgcagtgagccgagatggtgccattgcactccagcctggatgacaagagcgaacgtccatctggaaaaaaaaaaaaaatctcctctggagccaaattgccagagttcaaatcccaattcctctattgtttactctgtgaccctgggcaaattatttaattttgctatgcatctttaagatgcaaatagtgatagtagctgtctcatagaattgttgtgatttagaagtgtctagcaatagtaagtactcagtgtatgttttaatttttttttaatgttttggctcttcctctttattccttcaagttcttaaatatctagaacagttacatctccccaatcataagacaacttgcatgaagtaccattcaatcttcccttttttcttcattgttaaccatcttatgttttctgtctttacctcttcaattccccatgggtccccagtccattatggttgacttctgtcccatttctcccatctgttgaaatgttcagaggcccaattgccaagcccagcgatctgttttcattctctgaaatactgcagaattggctgttgatgactttcctcctcaaaatattctcccttgcttctaagatgctgctttcttccttctttttcttcttagttttctgattacctctttttagtgtccttgatgggtttctctttttaatttttacgtactcagtggtgagaaactagattggtttttcttttgctgcttaatgttggtgaccccatggtgtgggctagtccaaaatatggattaggtgaagccttccaacgagatccgtgctcatatttctgccactgtctggtcatctccacctagatgtcttgcacagtcttcagagtggatgtgtcgtactgtgccatatttccttttctgttcatatattgcagtctagtcactaatcgagagaatcctggggcttctctgataccactcttttgtgtctcattcagctatattggtttgactttgacatgtccttgaatttttctgtttttaacctcactgctgtagttcagagctttcttctctgaatatttgtaattgtgtcaaaattggttttctgcttccagtttctgtgccagtttctccttcaagtattcagtgttaatttcctcaagcacaagtgtctaatggtataagaaacctccacagacatcacttctgatagaaaaaaagacaaaattcttccttactgaggcttttaaggagcttgtaagttacagccagatttggctgagatttatctgttttataattgcagaatgcacatttactttgtttttgattactagtacatcattgatttaatttacaaatcagaatttagaatgtttgagatgcttagatattgattgatgtatttaaagattggttgattgaatataaggctttagatgttgccttcctgcttttagaaattgcttgttgggtcaaatgtgacttcaacattatggactagggagttagagggattgggatctgtttctagttcttcaatttttgttgctttgaacattttattcatctgttgcaaaatggagattcttaacttgcttaacataagatacgttgtaaagatcagaaatatgctactcctaaagcagtaaaaggtttaagaaaagtgctttttaaaattaggaatgtggtaatattgtgtacttatgagttttctagtcctaattttctgtttctgccactttattagagtgaatgttcatttatgaacagaaaatgtggagtagatggcattggagtgtgttatttagagatctttaatgaatgagatgatgaaatagcccagttaccttaatattaagtaaatgctaggatcttagtgtatctttctcccaggattcttgcatgtgttttaaagtgacaactttatttttatttgtttgtataaatgtatgggggtacaagtgtaattttgctacatgcatggatggtagcagtgaagccagatcttttagggtatccatcacccgaataacatacattctacccattaattaattcctcatcctcccctggctctccattgtcttttatttcacactgtgtccaggtgtacacattatttagttcctaagtgcgaacacatggtatttgttgtaataactttattgaggtataattcacataccacaaagtacagttcaattcagtggtttttcagtatattcacagttgtgtatgcatcactcctgtcaacttccagaacattttcattacttcagaaaggaacccatactcattagcagtcactccccattccccttttttctcaacctctggaaaccactaatctacctactgtctgttgattttacccaatttgaacattgcatataaatagaatcatgcaataggtgcccttttctgtctggcttctttcacttagcacagtgtttgtcaaggttcatccttgtagcatgtatcagtacctcatttttttaatggccaagaaatattccattgtgtggatatactacatcttaaaaatctattcatcactaaatggactttaggattgttttcacttttggtctattttgaataatgttactatgaacatttgtgtacaggtgttggtatggacacattttcatttctcttgagtatatatacctaagagtggaattcctaggtcaggtgttaactttatgtttaactttttgaggaactgccaaactgtttgccaaagcagctgtacccttttacagttctacagtagcatatcagggttccaagttctccatggccccacaaacatttgttattgtccatcttttttattttagccctcctagtgggtgactcattatggttttgaagtgaagaggtatctcattatggttttgatttgcttttccctaatcactattgatgttgagcattttttccacgtccttattaaccatttatacatctttggagaactgtctatttaaatcctttaaaactgttttttaattgaagtatttgcctttttttataattgagttgtaagggttctttattctgacaagttccttgtaggatttttggatgttttctctcattctgttggttatcttcatcttatatgcatttttatttcttaaatgatttgacatttgggtatcattaatatttttccattgtttagtatttaaattctattgcttatgattcatttttccctttttattaaaaaaattttagaggcacggtctccctatgttgcccacactggtctcaaacgcctgaactcaagtgatcttcctgccctctccctctaaagtgctgagactacaggcatagctactacccagcctaaagataccattcttgactcaaagcatggttttacataaattgaccatatgacccaacaattccactcctagttttctacccaagagaattaaaaacatgcccacacaaaaccttgtacacgagtgtttatagcagtgttaatagtcaaaaagtggaaacaacccaaatgtctatcaactgatgaatagataaggaaaatgtgggatatccaaacaatggaacattattcaacagtaaaaagaatgaagtaaccagccgctttgtcatgcacctgcagccctggctatctgggaggccaaggcaggaggactgcccaattttaggagttcaaggctgtagtgtgctatgatcattcctgttaatagccactaggctgcagcctgggcaacataacgagaccccatctctcatgcaccccatcctgcatcatggctgaacattccagatacttcacagctcccacctgcttagccagggaagggccttgctgaggagtcattggcacttggctctgctccttcagcttcttcactgtctcatggtcactccacaggtcccttttggtgcctaccagcataacagatacattgaggcaatgatgggagacctctgggtaccacttatgcctcacattggcctaagaggatgagttgccaatggaaaaacaaatgacagagatattggtcttggggataggagaacagtcgcagttggtcatattcctcctcttggccagtggtgtcccacaggttcaggctgatgatttggccatccacagatgtctgggtgctgtagttgtcaaagacattgggcatatactccttaggaaaggcatttgttgtataactgatggggaggcaggctttgtctacagccacatctcctgcaatcacacatttgattgtctacattcttcccttagtctgatcatcctccagtgctgttcaaccatgactggcagagcctcctgggcatctcttgttgggctttataattcttgctttagaaaagctaacatgcaaaacaaagtagttaatgaggcattaacaattatggatataataaagttaatgtaaatagcacattcctcaagatgaaaaaattaaaaactggtttaagatcttgtgctatcaagattttgtttaactgtccttcagcccagaatagcaagtataacatagcgaaaggtaatttttctggtcagtataatccctaattaagctaccctctttattatagcagtagacattttcttatttattctaatcttagtttaaaatttggaatttttaagtgaaattttaatggcaagtgtgactaatactgaatattgatcacataattttgaaatgtgagtagagcaaagacctcttaataaatctttttttttattagagaaagagatgctgtagggatggaaatttcccagtctagcagctatgaccagctactgtgtattacaaaaggaattttaggtatcatgaatatacacactgggaagatgatctgcctgtagtcaaggctctaagcaacctgtataagaagaaaataacccagcaccttaggaaacacttcttttaaggttctagggtaggagaggctgctatagttgaatgtttccttacccctgtgcagtagtgaggaatggcatatatttgtgatcttttaaaaagtttgatgtctaaaattagtagtgattacagctcaaatttctagttttttaattagatgatatacctttaaaatgttaaatatatgccaatctataagcagaatttattattttatgtttggcacaataaaaattgtaagtctttttctcatgtattttctcatcataggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtggtaagcatgttagaaatattgagcctctgtaaaactcattttgttagcactcgggaagaccagttccagcaccaaagtaatttttattcaaactatttgcagttgttgtcatttaatttttatttacaggtttcataatgttaccagggctgatgtttatgggacccaaactaaattttgactattttctatctacttgttatgtgactctccgtttttgttttttttttcaatggggaaaggacaggaggcatcctctgaatgtactgcttttataggctaaaatttcctactacttttaactttcttacttataagccaaaaccctacttttccaacgagccatgccaggaaccagccttctatctactcttttaaattacaccccttccttgtgcctctgtggtctactacttttgaagaaattggtaccattccctccctgctataatttgctctacagttgcactgtttagtagtgtagtcactagccacatgtggctatttaaattatttaaaattaaaaattcagtttgttagctgaatgaattaccacatttcaaatgctcagtagccacatctgactagtggccaccttattgagtagcacagatacagaacatttccatcattgcagaaaactctgttgggcagtgttactcttagatagtgaaacagggctataaagttatttttatggcctttttcttgaaatgttgtttagttattctggtcttttcaggcaagtcggtatttgagatgaagctttagaaaaaagttacacctggatccctcatttattgaatattatactgcattccttgatatggccaggagtagaattctttagtttctaaggggagggagaaatggtaacactacctgatttttttcttttttttttttttagaggggcaaggattctcttgatactttggcctgagtcagggcaaggcagggagggacttagcttttagctatgtgccatcaatagcttggagtgtaaaagggatatgggagtaggagatgcagaggattgtggtttaaaaaggaagataactcgaggtcacacctcacttgtatttcagtaagcttttactgcacttgattaaaccaagttgctgtgaggaatgcaaatatgaggtcagggtgcacgtattcaggcagcttagagtccattgaagctggtacataagactgaaaattaacaaggatttgaatgaaggtgcatttactgaactttatttctactacacgccagctattgtgcgagggcctgggaaaacagctgtgaataaaacaggttaagtccttcctcttctggcattcacagctgagtggcagacaggccagctaatggtttaggcttttaaattggtcggtatttccttaatttgcaggtattttttctgctttttatgtattttgtaattatgaaaagtatgcattcttatttttttaaatgtggaaaataatagaagaaaaggaaatttagtgttagtgcagtggtttattttgcactgttacactgttacttaagaaaaggtagaaccttattaaaggcattttctataacaagctccgcccatggcccagggagcagctcttaaagtagtttaacaatttggttagaataaaagcagaacagctgatgcttttttatgtttctgacctattttcataacaaaagtacccactctgctgggcgcagtgactcatgcctgtaatctcagcactttgggaggtggaggtgggcagatcacgaggtcaagagatcgagaccatcctggccaaccaacatggtgcaaccccatctctactaaaattaactgggcatagtggcacacgcctgcagttccagctactcgggaggctgaggcaggagaatcgcttgaatctgggaggcagaggttgcagtgagctgagatcacgccactgcactccagcctgggtgacagagcgagactccgcctcaaaaaaataaaaaataaaaagtacccaccctgtagctcaaacatctgccagtcctgaggttgtgatggctctgcctccttccctggaccttaggattgggaggaataagcctctgagagacagactgccctttttcccaagaatggaatctctgctcactagggtaaggggtacactaggtgaggtccacatgccagtgctcatggctgttgaatgtcctggaaatatggcagctaaatggaattattaaatgctcagaagtatttagctataccgtaatatcttaatgacctccagtaggctcttggaaactacagctttaagcaaaacaacatacaccaggtcctcaaataacgtcatttctttcaatgtagttttgttataacattgagaaaaaaaaatactggttttggtatatgtcattttgttttaagtcacaggctccaagaactgattgacaatgttaagtgtggacttactgtactgcatcttctctgtgatattttagcagtgtggcatggaggtgggcctatgggttggcgtacagaggaaagaaggacctccgtgcaagcagtctgagtgggagggtttctgtccgttactaatcatccttattcttcagtgttgctgctgaaggtgctgtgacacatatgctgtgcttctaacacgcttcccttcaagagggagaacgtgctccaatgttataaatataaaaagatagtaataatattgacagttaagacataattattggtgagttgccatttagaaatctttagaatcatgagattatacaagtggatttaatatttttttccagagaattattgaaacgtggatgcccagatctgtaattaaacatgtattgttatgttagactaagaaaacaagtacctgtgggatcaaaacctgctattggaatagatgaagggactggggaagtctaagaaaaggacttttatttgtaatttattcttttttgtccttttttttaagtttttgatttattcttttttagaaaacaatctgaagcaaaggtgccaaaatattagcatttaattctgggtcacacgtacttacggattattctctgtacttttatgtattttaaaacttttttccaactagaaaaactgtcaaaaaccttgtgtaaatattagcctgaatccaatcccttattaataataatgaaaaatattctgaagaaaaagaattgggttatacagtgaagtactcagtgttggttctttcattatggcgactgtaatctgatttttaattggtgattgtcttttgccaccagtggttctcttcttttttcccaccctggtcaacctgagtgattctgcatatgcctatctgtagcatttcctctctgagctgctggggaggtagaaaaaatgtgcagttaagaaaaaatatctcaggagagtctgaggattctcagcaaatgtttacacaagcaaatgtttaacaagttgcaagttatactttctctaaaccacttttttcatttttggcatctttctatctagggcaccagaactagcacctctgaaaagtaaaatgatctatgcaagctccaaggatgcaattaaaaagaaatttcaaggtatgttctagatgacctctgaatatgtagaggtatggtgaacactcagaatggggcagcaccttttctgagaagcaccttatttttttgcagagcttcgggcacaagggagaagtgttacttgttttgagaaaagcagaagactgaatttgactttccatgtatcttctgctttgtgctggttgctctgggtctgcccagcctgtgtttaataactatacccttgacattgtctatatatatcgtttattcaggctggttttaaactagtttgaggtgctaccagttttctcatgtaggaggtggagactgattgtttaacattggacataatagtaaatttgctcttgcctttgaatgtagttgttataataaagttgcaaaaaggaaatgtacctaaatgagaaaggatgctcttttctccagctttactgttgaatggcatgattttaggtaattaattcatctgtgtcccaaggaaagtgcacccactcctgagctggtcagttgtatttgacttgccactgggtgattgggatcctgatgagatggcctggccagacttcagccaggagaaaatgttggtatgatggaaagaacgtgcatggggcaagtgcccaaaggcctgcactgagggcgaagcctgtctaactgctgtgtggccttggccagaactgcttaacctccatgggccttgattctctcagctgtagaaggggagacttggtctcatgtgtgagttttagtttaagagtttgccctgccaccttcctgccatggctgtttccaaacagctgagtgagccaaggtcacaagggcttggcctgatgttgattttgttttgtttgttttactgtcactggtttttatattttcatggtagaacaggtttgccctagcctgttttacttagttcggaaaaaaaaattcttgcttcctttcccgagccttgctgctgcatagtttattgctgggtcaggttcttcgtgcatttggtttgatgtttggcaacccccagaagtgtgtcactgggttgctaactgacacttttaaatcctttagcttcaacactttcccagcccaaccaaaaggttcacagtggattccttattatctttattctgcattgcctttcagtaaagggaattgctttgcacacttgatttggtgatactaaaagatagtggccggctgggtgtggtggctcatgcctgtaatcccagcactttgggaggctaagacaggtggatcacctgaggtcaggagttcgagaccagcctgaccaacatggtgaaaccctgtctctactaaaaatacaaaaaaaaaattagccgggcgtggtggcacatgcctgtaatcccagctacttgggaggctgaagcaggaagaatgcttgaacccaagaggcagaggttgcagtgagctgagatcgcaccattgcactccagccagggcaataagagcaaaactctgtctcaaaaaaaaaaaaaagatagtgaccatgctgccttttttctaatgaaagcatccactgtctttctcagatcagtcctgagtagttcaaaagctgacctgctgtgctttcagcagcttgagaaataatggtctttaaatgatgggaataaccatgcagctatttaaaagacagtggccatttacagagaagctactgtatgtaatccataattgagctcgtttttgcattgtggtagtgtaattgttctaagaaagcaatcagtaacatatttcacatagttttcattgtgatcgatttcataaatgtgtagtgtaataccattgaagagccagctgtttacttttcaatacagttgacaaaatcaactgtgcaatcaaaaatcatttgtatttttatgttttaaaaaccaagaaaattttcttactagacctgccttttagctttttagcaaagtacaacatatctttagaaaagtgtatgtcacaaattattgtagaatgtgttgaatttttcagagtgaacataatggttatttcttaatctaatgaccagcaccccagaagcctccctggtgctgttcccttcaattcatagcacttctgcctgccccttcctcctcaaagtagccagcaccctggcttctaacagcgtaagttagcgtgggctgattttgtatgctatacctatatatataatagaatatatgcattttaaatctggattctttcagtgaatgctgtttgtgaggcccatctatcttgatgcatgtagttacaattattttttctcgttactgtgtagtattccgtgtttgtatataccccagtttatccagattagaactggtcttttaaaagtttggttatcttagagaaagaggtaaactgctgccataattgtaaatagaagtgttgttttttctctctaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaaagtctaaagttttattgatgtgaaattaaattcttattggccaaatgcctgttttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtccaaattctttattcttccttgagctaagcagaataatggaatataatatgtcttcataatataacaacactaatacactaatagtaagattaagttaggcagtcttctaccaaatgtgtaatggagattgcctcaaaattgtgtccacataatccacgctcatcttgcaaagcgctatttcaggcacatcattggaatacaggaagtagccctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaat

SEQ ID NO: 35750 - DNA, 37885 bp, Homo sapiens; identical to SEQ ID NO: 35749

SEQ ID NO: 35751 - DNA, 4512 bp, Homo sapiens
gtctgacgggcgatggcgcagccaatagacaggagcgctatccgcggtttctgattggctactttgttcgcattataaaaggcacgcgcgggcgcgaggcccttctctcgccaggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatcgtaagtgcagggtgggtcgcctctgctcttcatgttgccccagcgcaaatagggacagtcagctgctatgtgctgagggtctactcacaccggctactgaattaggccatttttgggaaaatactgtttagttaacaatttcctgagataggtcccttctgttgcagataaacgggctcaggcaagttaagtgggtcctaagatgacagcattcgtatccaggtctgtctggcttctaaaagagcgcgctttatacttttttttttttaaacggagtctcgctctgttgtccaggctggagtgcagtggcttgatcttggcttactgcaacctccgcttcccaggttcaagcgattctcctgcttcagcctcccgagtagctgggattacaggggcgcgacaccacacccagctaatttttgtattttcaatagagacagggattcaccatgttggccaggatggtctcgatctcttgacttcatgatccaccttcctcggcctccctaagtgctaggattacaggtgtgagccaccgcgcccggccgcacattacagttttactccatttttgagaaggtctgaggtcaggaatgactcattgtaaggaagcaagctgttgcatatttaggacctgtcagccaagaaacttaagtgtccaatgacttttggatggcctttgaggtgggtctcccttgcccagaaatgctgactgtactgcgcttaagcaattaggcagcattgtagagcatagcttgtattacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggaggtatatgctgtcagccttgccccctcttacactgatggttgagagcatgacaaggttcagactgagtccctgtaaccaaggactgtgttttcatctgtctacctacctcatctgtaaaatgtcagtaacaacataagattgttgaaggattttttttttttttttttggagacagagtcttgctgtgtcgcccaggctggagtgcagtggcacaatctcccggctcactgcaagctccgcctccgggttcacaccattctcctgcctcagcctcctgagtagctgggactacaggcacccgccactacgcccggctaatttttttgtatttttaggtttcaccgcgttagccaggatggtgtcgatctcctgacctcgtgatccgcccaactcggcctcccaaagtgctgggattacaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtaaaaggatcccaccaggaccacagtgggcctgactgtgacaaattagcagggtgatgtggccttctaccttactgcttttatagttgtattttatatagcagataattttgtgaggggatatttgagaggttgggaggcagggaaggcgtttctcacttgagaaatgacaagagacccaaagagggggttaatgggcaagagctgggccttaggaaccctgcctcactaggccatacccaagctgtcctgcttgggctgcttctgacaggaaaggcttcacacggactttgatattgttggtccttaaactctaccaaggcaggagggtggtgggtaatagaggagtgtggatgaccattttgaccacttcccccctcctttcaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagt

SEQ ID NO: 35752 - DNA, 45412 bp, Homo sapiens
atgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggtgagcggccctccctgcagcgtgcccacgcgcttggccgcccaccctgaggtggaagctctggcgcgaccggccgcgaggggcctgcacccgcccgacaccagggagttttcaccccgcgcctcccgggtgtagttgaaatatctcgcgtctgggcctgtgagggcccaagtctcactcccctcaaaattcagggttctgggccgatcctcagcttcctcgtttggaaaattctggctgcccccagggcccgctgaaggttccatggagagtggcggtgaatgcattttggaagcgggccgtgcaagagaagaaagaattgtatgtgcacaaggttcaggcataacgcgtttgttcctgctcggctcaaacgggagtttgctgccaaagacatgaactgcgatcagttttaattctatcagttatttttgatttttattctgtaattgtgcagtctttgtcaaagtagttttctctcctaaacggcctcccggctctccccggtctttccttcgcttgctaggttgtaaagaatagtagtagtcatgacttttgtagcactttgtaaagtcacctaatggaagattgctgaggtcctggttttgacctttgaaatagtgccgtctgtgcagagttctgagcttgcgattttggcgctgcagcggaataagtctctctctttttttttttttttttttttttgagtcggagtctctttgacccaggctggagtggagtgcaatggcgcgatctcggttcactgcaacctccgcctcccgggttcaagcgattctcctgcctcagcctcccgagtagctgggattacaggcgccccgcccggctaattttatatttttagtagagacagggtttcaccttgtgggtcaggctgatctcgaactcctgaccaaaggtgatccgcccgcctggcctcccgaagtgctgggattacaggcgttagccactgcacccagccggaacaagtcttttatccattgtacatcttcagggcttttccattgttctgctgagctgtggttcaggctcagttgtgcgagtgattgattacctggctactgtaatgcttgtactttttttttttaaaaattattccatttcagctcacattggagaaccatggttttcgtatcctagctgattatattcttagcatttcagtcctttgcaacttggtttgttggggaaggcggttatagtcatctaatttttcttggggacagtactactgtggctacagtcatgagagagtttactttttcaatgtcttgtttccaaccaagtccacgctttcatgcttgctttttaaaaacaaaaacaaaaaaaccttttactattaggtattatatatctcaattttcttctccttggcaagttttttacaacgtttttatttgattgcattttcttctaaaagctatatccctgtaatgttttatttatatgacttcttacagtctcccatttcctctgagaccataattttggacatacattgccctttttattgtgtggatcccctggctgctaggttatagtatccccataatctatgttgtatgtggactgggaggagtaactccctttaacctaaaagttccacaggttatactcaagagaaagtttagtttgagtacgtttgtattcccaggctccacccaaatctcccaaggctgtgagagtgagatttgttgtgagcaggaatagaacaatgtgttttttagaaacattttaacaacatcttagtaacaaaatattagggccttaagcagcctccaggaacattatgggaaatggatccagaaacttgtggctggtgtccttgaagacagcagtggaaaaagattagaaactaagtagaaagcgtcacttcaacttttgtagaaaatcagagtgcttagttctttgaatgctgcatccatcattggccaaaaatggatgttgtgttgcattaaaaggcagaggggcaatacctaaaattacaggtatggtgttggagctttcacctgacaaaggagtaaggagaaatgattgacattaatggagaacacaggcttgtgcttgtcaatcaaactcttaaataggtggaccagggagtgccttttgaaacttaagggaaaaaaaagctatttatgccataggctggacacataatggaactgtcattctgaaaggttataaagaccagaaatctataaagtggacgaccataagaaacagttccatccttatgtaacacagtttggaaaaacctcagttactttagttgacagctccaatcctctaaaacatttgtgagcaatgctttgcagtggtttagcttatctgcttttgcaccctaccctgtagcatgcagttctaggcagtattgcttcattctttatgctccttgaccaacagcttttggcatagggtaaatctgttttgcttattgagtgccagagacgaattagttgatgtgttttgagtacagatgggctacagttcaatataagaagttggatggtctgcatgctagctctgcctcatgcagtattaacatgggactttacctctgtgtctcggttttctcatctctaaagtagactaatgctagtactggcctcgtagggagagaattgaataaattcaatgaattcatgcatatgtcaagcagttacatatatcaagcatatgtcaagcacttacacagtgtctggcatgtaataagagttcacagaaagttagctgcctttataataattatcttcggcccggcatggtggctcaagcctgtaatcccagcactttgggaggctgaggggggcagatcatctgaggtcaggagttcaagaccagcctggccaatatggtgaaaccctgtctctactaaaaatacaaaaaaattagccagcatggtggcatgtgcctgtggtcccacctacttggaaggctgtggcagaatagtctcttgaacctgagaggtggaggttgcagtgagccgagatcgcaccactgcactgtagcctgggcaacagagcgagactccgtctcaaaaagataaataaaaagaataatcatcatcttcattgcagttgtcctgtccttttgcccttttcccctcatatccactcccatcctgatcacagctgctgaggtaggcctgtaaggtttagatggagaatattggtcatgattccctgtttcatcttgcttaatcttgaatgcatatacccgctgatgctgcagcgggtatgttttttcagggacctctgaaaggagggagaacactttttagttaccccccattttattgttaaactttagtaaagccataaaagtacaatcacaaactagtattgaggttatgttactgattttcattagcttaattttcttgaactttctgacgtggttttaatgttagtcaaggtgcagttctgcttataattttaatagttttgtcattttaaacacgtcagtttgtgctcagaaggatgaaaaaatatttaaatagattttgtgggagcctgatgcatttctcaagcaattaagcaatttaagacaagttcagtgcttaattacatttgatcagagcacaggccatttgtacatgtgtattttccgagagtatctactttgcctgtcatttcttttgtttgttttaaattaaaaaaacaaaaaatcccttagactgcaggttaatatttgaagttaacttgtttcatgtgtttgcttattacacacttctgacttggttttgattgctaatttatcttcactggatacttaggccaataaagaagcttataggattaaatgagccttgagtgggggacaggttgtttttttgctttataaagaggaaaacaagaaaggaagaaagctggtagctgtgtgcatttctccagtattgaatcctttctaggctttgcttcatacattgggttttttcatatgaggagcccagagagaatgcatagctttcattagattacttgtgaggagccagtgggctccctgggaacggggcacttcagatgtcccccttgagacactttacatgctctccgggtgcaaccttctttttagtgcactactcttctttgaggaagtgagaaagtttgcatcttaaagggggttggggataggttcttctctcccaaagcttgctttttttttttcctcctttttaaaaagcagaaagtgcatattttttctagagagagcttctttggctattaaaaacaaagtaagggcagggagagcctgctacgttgcagggattttgtgtgactctaccatgcttgataaggattcaggtagacctgaaagcttctccccagccactggatttgttctctcatctcttcttcttgcccccaaatctgcattttctgatgctgaaaaagagaatgatcagagttgtttcatatttttttagctttattctcttctactgtgagtacagctctgttgagctgtacagtacagtactgctttgcttgcaaagcagtacagatgcctaggagaagtttcaggatcacaggagaccagcagttacctggctgtaagctctccttttgactgttccttatggagggaatatttgtactcccagttgttaccttcctgctgaaggacatgagatgtgtctgtttgttatgaagttttccccctacttcccgagttgttgcttatctttgttgggctgttctctgctcttggttgaggtactgggatgtagaaccaccctctattagcatattagttattggactctgggtgaggttggagatactgtcattcctagagggtagaagaggtagggctcacaggcaacagaaaataatgctatgggatatgtttggacattttttagagcagaaatggcacttcagtcagtcaggttttggcattttcctgccatgttctgcctccagctttaatcacttgccccttgcttgagtttcttctttcttcccctctcccttctctcttatctgtggtaggcacacacacctcactctctagttctcctgggaccacaggaagataatgtggatgttctctgtggctccccctgttatattcatgatgttattatttctggtagtggtattctaatctcaaaagtacaggctatgaggtccctgccagggtttagatgctagccttcctatcctgcctttaggaaccttgggcaaatcacttaactcctctctgcctctttacttacctgggaataatgagactcacctgacagctgtgaaagttaaatgaactaatatacaagctcctagaatagcattagtgtgtttgatagtaactgtctgataaatattagctgctttcacatagacccatcagacctgatctagtgaggatttctcttagattgtcttcactgtcggaagagttttgatatagggagttccagcaattctaaagatgttaagacttatttatgtgggttgttgagaaagatagtgtaccatttactggtttttgtagagctaaaaccactctacaaaatatgacactttattctgttcaaagaattttgatttatttaatttcatgtgaccattacaataatcacccctgcagagatggttcctggggtcaatggtcagaggcagagctggggttagaacttgagttctcttctgttctgctgcctgtaaatccccaagcctgaattcagttctgcctgcacctctggcaagtgctgtattgtggggagaagtgtggcatccatggcaggggatcctctgtggctctctggaatcagtacatcccaggttgacgtctccttggctctggactcaaagttagtctacctgctggtcgtctacatcagggtgctgtgctgccatccttctgcccatggtagactcaaactcacctgccaagatctaattcattatttcccctccagctttttccagagagcttgcccctcctgttgctgcagttgttcttccagccacatgtactctgaagatgggatcacaatcagtgtctccataccagaaaaggctctgtaactttttggtcatgggagagctctttcctctgccctctcctttgcagttcctagaccaggtgtgttaacctgaattgtcatgggagcctcttaattggtcctttcagcaaaaactaaaagaaaaaacccactcatcatggcaaacattgtcatattagtcttcctggagaggcatttggatttataactctcctctacccggaaagtgtccatcatagcaacatcttccagggattcttaaatataacgatgctgttgacatgtctggttatccctttaccttttcagaatttgtgggaggtgagaagtctgggagaggttatctgggttattatgaaacctacacacttactgaattaaaaaaaaactatgtaacacaattctagtctaaaaatgggcgcacactttctttgccttttagaaatactttttgaaatgtaaaattcgaagtctaataaaggagtctgtccaattaatttaactgtttgaagaaaaaaaccagtccaggcatggtggcttacgcctgtaatcccatcactttgggaggctgaggcgagcagatcacttgaagtcaggagttcgagactagcctggccaacaaagttaaaccctgtctctactaaaaatacaaaaattagctgagcatggtgacacatgcctgcagtcccagctattcaggagactgaggtggaagaattgcttgaacccaggaggcggaggatgcagtgagccaagatcacaccactacactgcagcctggccaacagagcaagactccttctcaaaaaaaaaaaaaaaaagaacaaaccagctggttgtggtggtggtggttgacatcctcaacagaacagcttttgctaattgttgaagtcagggaagacaacttgtgctgatggcagagttcaagacattacacaaccagagacaatcataaacccagaaatgccagccctgagagatgcaactgatgtatgacttttttcctctctggatcaaaccatgacaaccgtaaaaggcaggccttgctgttaaggcgctgcagcctctgaagcacagttggcctcagggagctctgactcagtctacttattctggggatctgaagaaagtcagaaatcatgtgtggtagatagtttgcataactttgggattttccagagagaggatgaaaacggtggccctccttgtaatgtctaggcacatgggacatccagtggaactgttgagggaggagatgggagggagaccagtcaccagaccagttgatgtaggtctcatagactcaccactcaagttgtgcttcggagaaagctgcttcaaatcttcttgatacatttacaaagataaataaatccagtgtgcttctgcttggcatgtttacttggtcctgtggtcagagtgctctggggctttgacaaatgtgctagtcacttagcctatttttacaactctgaagcagccgtgtctaaaaatatttcctctctggctgagcctgccttccaccaggcctagaaaagtcatggagctgaggacatagccttcaaatatttttttttccattgcagactgcttgtcctcaaggtcttaccagcatgtaggtcactgtaatataaaacatgagttctcaatggattgatttaaattgtggtcactcaaactgccaggaagagtcctcctcatttgttgtaaaaataacagatgtctatgaaaggagaagaagaaggcctttctttttttgcagttcatttctccactgccttctccatcccagaaagttggcggtaacttgggtgttactgaattactcaggagaatgaattgtacttgtttctctgtagttattttctaaataagaggttacgttatcaggagaggccatcagctacagcagtggaaagagccaccaggtctcatcttgactttaccaacaaatgtctttattcagtcaacattccctgagggccagccacagccaggcagggtctaggttctcagtgtacaaagatgaatgacatttggtcaggagcctacagtagaggagttcagattactataacacagtttggtaggtgctgtggtacacagatgcagggatgttacagggcatatgggggacatctagcttagggctgagaggatcttggggagtaggcttactaactggaaatgattgttttgttttgttttgagacagagtctctctctatcacccaggctagagtgcagaggcgtgatcttggctcactgcagtgtccacctcccaggttcaagcaattcttctgcctcagcctcctgaggagctggcattgcaggcgtgcaccaccatgcctggctaatttttgtatttttagtagagacagggtttcaccatgttggtcaggctggtctctaactcccgacctcatgatctgcccgccttagcctcccaaagtcctgggattgcaagtgtgagctaccgcgcccggctgatttttaggcttagttaataggtgaagttggggagaaggtgaggccaagagaagggctggagttgagaggcagatgtagggagctactggccttgtggtggtgttaagactgtcatgcatgaggcaatagttgtgttctttttgtttttttgtttttttttcttagtaatagccatcctaatgggtatgagatcagaggtttttaacattatactgtgatggacattagagatttcatgaatctccttcatggttcccgaaaggttggtaaagattccttctctgacctttgttgtacatattggtcttcaatatgcattcttatggaaaaaggtgttcatggctaaaacatttgagagccgccacactgaatgatctctgggttgtcttcctcctctcaaaattgatgatcctgattatctgtagctaataagcctgaacaataaatgctttcgccaatctcttaaagtagttgagaagctaggtgtgttagtttcccttctgtgatagagaagaaacctgtgttggagagcagtgagcttatgtgtctgtggccatctctgacctgattcacacatgtgcccctcacagacaggcacagacacagggttggcatgcctctagccttacagcctcttggatgaaaggtataagacacattcacatgttggagtgaattaagcacacatccattttgaaatcacagggctggataccacttaaagaatattgatcttgcattgggcaacgcatagcaactgccctacatttccccttttacctagcgtcacaaccaccagtactagaaagcagttaatctgctcaccaaaataacagagagagactttagtggcattttttccacttggtaattgactagactctggctattagctccttttttttccttactatccttttcaaactaataacgtgacttctcataattttaaagtaacttgatgcttacacaaagtttatcataaaggtttctagcaacaaaaccagtcatgacttcttgagaacttatttctaaaataatttacaaattgagacttatgaaaaaatagctctgtcattcaagtgttcatttcatgagtatgaaatatctcccttgtgctagacatcaggccaggtaaaaagtaagatgtgattgctgctcttgagaaacctactgtctagtggaagaaatacaggtatgaacaactaattgtaatgaaggcacagacagcctacctgtcatatctgggatttgatctgaaacagatgaaagttataatagtttacataccttaccttaaagtatggtttttaaatacttaagatgtgatatgacatatagtgtgtatatatatcttatgctaaggaaaaagggacattaaaaaagcttatgttaaaagatatatgtatacattgtactgcctgtatgtttgtgaaatttgtatttactggaaattctcattggcctgtagataggagtgttcctaagcaccctatattgggatttgtggtaacagcagcttgacaacctgaagtggatgatgcaacagcacttttgaaaggtctctccgtactatcttgatttcatcatctaaagttggtgttggcaaagagaagataagtgtttagggtgttggatatcccagttaccctgatttgatcattacacattttaggcaggtatcaaaatgtcacatgtaccccaaaagtatgtacagctattacatatcagttttttaaagaagaaaaggttggtatggttagcttttctatttcaagtgtatcattcatctttcacatctgggatttctcctatgctctggttggttaataacttttattctgaaatcggtgagattcttatgacatgaaatagtctataaccagttaagtttttatttctctgttctgttcacatcctggggactgggctgccattacataactgagcagccattggtggttcacaccagcgccacacccagttattttctttcagtatttgaattcctgcacaaaagatctgctgtatctgcaaatcactagaggcacaaaagaagtgattacctctactaagggttgggagaagtttcactaaaggagagatggtgtccatgttagattatgaagggtaagttgaagtccatgaagcagcaatgagggagccggacatgtatggcagaggaaaccacatgaacaagggcacagagccatgagatagcacagaggagggagacgtgtggtgtggctggggaagactacagaatcgggttactaccgtccaaagcatttgttatttagcagttattgaccagctatcatattcaaggcatgtgataagtactaagggctacaaagaccaaatcaatttctgccattaagggattttaaatctaagagcagagattagacagagatctaaatgacacagtttactttggtgtaaagtagtacaataagagcagtaaaaatctagttctgaggtttcaaaatagaaagtacattcatttggaaaaaggcttcatggagagggtagcatttgaaatgggcctgaataatggatagaacatttctggacagcagttaatggttgggattaaggaaaaagtgttgtccagaaaatggtgacctacagaatagtggtaccagtaatgaaggccaaggagaattgattttagggtcaaggtgataactgcagcttagatagattattttggtttcaggcacagttggaagtatgagaacgattggaatttcagaaggaaattatattggaaacagaaccttgaaggaagtccttgtttataggcttagaagatcaagagaggtcaattaatatggctaaaaggaacagacagataagaaactgaagagtttcaaaaatgaaacttttattggcaatgtacagagctgttgtagaagatgaagccaaagaacaggcattgactttagcaatttagtagaccattgataagttacagtagtccccccttacgaggggagggagtacattcctagaccctcagtggatgcgtgaaactgcagatagtaccaaatcctatacatactatgtctttttgatctgataacccagtcaactaccaagtgactaatggattgggtagtatacagtgtggatatgctggaccaagggatgagtctcctcccagacaggacaattcaagattgcatcacactactcagaatgacatgcaatttaaaacatgcatcatttatttctataatttcccatttaatatttttggaccatagttgactgttggtaactgaaactacagaaagtaaaaccacagataaaggggggaccaactgtatctaatttcatgcagcagtggtggtggaagaagctactctgataggaatgtttgtgttccctccaaaatttatgtcgaagctgaatccccagtgcagcagtattaagagataaggcctttaggaggtgattaggtcatgagggttctgtattcatgaacagcttagtgccatttaaaggggcttgagagaccaactttgcctcttctcccttctgccatatgaggacacagtgctcgtcccctccagagcaggggtccccaacttctggtccgtggcccattaggaaccgggccacatagaaggatgtgagcagctagcaagacttcatttgtatttacagctgctccccatcacttgcattgctacctgagctctgcctcctgttggatcaagagttgcattagattctcataggagcatgaatcctattgtgaactgtgcatgtgagggatctaggtttcgtgtccttgtgagaatctaatgcctgatgatctgtcactgtctcccattatccccacatggcaccatctagatgcagcagaacaagctcagagctcccactaattctgtattgtggtgagatgtataattatttcattatatattacaatgtaataataatagaaataaagtgcacaatcaatgtaatgcacttgaatcatccctaaaccatcccctcttccctgcaagacggtagaaaaattgtcttccgtgaaattgtctcccatgtcttcctggtgccaaaaaaggttggggacctttgctccagagcatgcagcagcaaggcaccatcttggaagcagagaacagccctcaccagacactgaacatgctgatgatcttgatctctgttgtttatacattacccagtctttggtattttgttatagcagcactaacagactgaaataagccatattactagagtttaggaatttaatggctcaggagaaagtagaagcaccaagtgtagtgaataaaatagcagctaacaagctttgtgcaccttcacatgcctggcactggtctaagcatgttaaacacattaacttctttaatcctcacaacagttttatgaggtgggtacctttgttactaacctttatgacagatcaggaaaccaagacatagaggcttcgtagctcacccaaagtcacacagtgagtgagtggctaaatcagtgtcttagtctttttttttttttttttttgctgctattaacagaatacctgagactgggtaatttataaagaacagaaatttattttctcatagttctggaggctgggaagtccaagatcaaggtaccagctttggtgtctggtgcagacctactcgttgtgtcttgctgggggaagaaggctgtctgcacatggcagaaggtggaagaaagctagacgaactttctccgtcaagtccttttataaaaacctttaatcccattcatgagggaggagccctcatggcctaatctcctcttaaaggccgcacctctcaatactatcatattggcagtgcctgacttttgaagaggacacattcaaatcatagccaggttttaaacccaggaactccaactataggcttgtttctccacatatcaccatgccaccaagtaatttaaagactttggtggtaaagcaaaggccagcctcaggtgattaaggaggatccttttcttcctccctttttatatggagcaggatcccagcccgtttgtaaaaaaatagaaggacacagaagggaaaacttgaaaatgaaaactgaaaaacaagtcatgaaatcagaagatgtgagatcaaaagcaaaataaaatagtttaccttagaaggctgtgcctggatccaacaataggcctcagacccttgcagaaagaagaagggggcagcccagaattaaaaaaaaaaaaaaacaaaaaaaaaacccgcaagctattgtgatgtgccaggcaccactgcaggtttttgacttgtattaacccatttaaccctcccaacaaccctgttgcccctgttttatagatgaggagacagcctgctgaggttaaggaatgttttccatccccaacttggcacacaggctctggagtctggcccttgcctgtctcagtactgtttcaggctgttgccctcagaccccgccatgccttccagggtcaagaaaggcatgtgagcaggcagcttgagctccctgtcacgtgtagacagtgagaataatgtgccttccccaaaggcagttatgaagatcagaggagataatttatgaaaagtgcaagctctcttgagagtaggggattttgtttgttcaccttacaaggcaggtgttgagtcaataggctgcagtcagtgaaggaatgaatgcagtggcatgcgcagcgtggtggtctaagtggtagttttggtccatccctaggggagcacaagtcttgggcagaggatcaaaagcacacacctctgagaagccaagtgtttttgtctgtaacctttgatcattcaaaaggaagcattttctaacctctgcatttttttacccaaactgtacaaaggcttccttgctgtccaagttgtggtatactccagtgcagctgcctggcttccaagagaaacttagcacttcttgttctgtttgtagcctcaaatcaacatgtaaccaaaagctgtgaatgaataatccaaacttgaagaaccccagattttattcaggaggagtaactggaagccataaccatgaacttccatatctgtcataggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggtaagatgaccctaaactagtattcaggatgttatgtggtactaaaaggaatgttaaacgaagtgataatactgtattcagtttaaatgtttattttatactgtaactcaccatatataccttctttttttctttctttctttattttctgtattggaaactcctaatcaagataccttctttcttaatatttgatcttatggttaccaaaaagattaaatcaagccattgtttttcaaactagggtctttggggatctaaaacttacattaaacaatcttaaaatttgcctttttttggatgatcctagaattaatacaagtgtattctggatgatttgaatgtttcatcactaacgagatctgagatatccatccccttatgtgcatttgtgttcatattattatttgtgccaagtgaagccacagtgtctcctccaaggacattttgccgtaagttgaagaaagaaaaatggtgggagaatggagcaattacaggcacttgataatgttggtgttaggacttcgaatgctaaagaatggggcctcacaatggtcagtacagtatttatgttgtaaatgtgtgtgttgcccggattcattctttggaagaataattagttataggcataatggtaactgtgaatgaattttcctcttccaaatatcaaatacagtcatatgctcatttaatccagattttaatatcataattatcttgtttcgaaagaacaaactgcataactaaagtgatgcttcattaaaattgacatttgaccttggagaactgattaaataaaattaaatgagataggataggcctggtgtctggcatttggaacgcactctgtatgggagctgttattagggctggcaaacctcaatgggctctggtttcagttggttgtggagtctttcacggaatttcttctctaggagattcaagattttctcccagcattgtagcctgtggagaagaaaggaggatcaaagctcaaaggtggtggttagtcagccaggagcaggcaggtgaccatcaaggaatctgtacaggggatggtagatgcaagtgtggccagaggtcaaggctagaaaagtgctattgcagagaaaggggctagaacaaacatagtcaaggaagcaagtgcagggcctgaccttcaagaaaggaattaagcaagctttatgtaggactgatggagcaagaccctgatgtgaagagtcccaggcaggaggcctggtggggcttgacctttccttagggagtgtgtgggggaggagtcttcccaaaagtgtcttcagcatagcgtctggaactttcagagagcaacaggaagactttggaactcaattggtttagagcttctcagtggtttgaggagatagatggcaacctaggagtggctggtgtagacagggatagggatcagagccgacaggttattttagggcagtgctcagtatctgggggtgtttttaaaaatagcaatgactaggcaccaccccagactagaggaattagaatatctgtaggtggggcctggggtttgggctttttaaatattcccagttgtttctaatctgtgccagatcagagcacagatcttagagcagtggttctgaaaccttggtgagcatcagagtcacttggaaggcttgctaaaccacagctcactgagccctacccagagtttgattcattgggtctggagtggagtctgagaatttgtatttctaacaagtccccaggtgattgttgctgctggtcaatgacccacactttgagaacccttgtcctagaaccacaaaagggttagggtgttctgtgttgcttttgagtctgtaatgctgacatggaaactgtcatttgtctggataggtgcacttgtttatcaggtaatttttgctattactgtgactttaatttgattgaagctgaaggattcttgttgagggtggtatgtgttagtttcacttactagccctggggccttaggcacattatttaacctctctaagcctcagttttcctcatctataaaatggattagggttgttggattaatcagaaatagtcttggaaaacgcagattatgaacccggcacatagtagatgctcagtatgtggcacctcttatttttgctgcatttggcttttttctttttaaaggcttaagtttttgtttgtttgtttgtttgtttgtttttgagacagagtctcgctctgtccctcaggctggagtgcagtggtgcgatctcggctcactgcaagctccgcctcccacattcacaccattctcctgcctcagcctcccgagtagctgggactacaggcgcccgccaccacgcccggctaattttttgtattttttaatagagatggggtttcaccgtgttagccaggatggtcttgatctcctgatcttgtgatccgcctgcctcggcctcccaaagtactgggattacaggcatgagccactgtgcctggcaaggcttaagttctttctgagggtaggtagagattgacttctgttggctctctcagcccttggagatctcatagaagaaataagacaagtgtactaataattcagaaataaacaatgtggccttcaggtggcctatggctgctcacccatgcttaagagtaccatagcctgtcgaaccagtctggggataaaagttgtgcagtttttaatggtccaaatgagagaaaggaatagcctgcctaatatcttgagtccatctctgttatggcccatttagactaacgcaccagtaggagatgaacaccaactccatgtggatagattaatcaaagaacattggacctataatcctgtggatatcttattaagcatctaatatgtaccaggcatcaggttatatgtttttcatgcattgattgctcactgtgggtcatgggttgggcactggggtttgtaaagatgattaagacttgaagctgcccttagaagttgctaaccttgtgtctctagggtatgactgtaagaaatgatggcaaggaaccttgcacttttagattgggttgatctctgcacatgggtaaaatgaaaatgctactataatttgaaatcacttgaagttatgctatagtggtagtttattgcaacacaataaattgtgacctgcatcactgacttgaatcattggctagatgggccttggtccgttgccacttaggggaaaaccttggtttggattgatgagggttttgcttttgggacgttgttttactttgctgcctgcccgcagcctgtggaatgtttctgctgatgggctggtttcctgcttgcctctgtccttgtatcaagataattcattccacgttgccccggttgcccagtcctggttgtcagactttttggtcctgggagcgttttcatgccttggttcccagacggtgctgatgcagcctgcaggtccacaggctcagacatgagcccactgtgtgctgctttctcagggagccatgagtgcagttgaaataaccttgcacttaaaacctgtcttaccattttgaaaactgttctttggaaatcttgccttgggatttgaacgtctttgcctttaggttttgctcttttgtttctgtttcttttactcattggttttctgcttttgagttttggttgccttgcttcaaaaatcttatatcacgaccatggtttgggactatttctgtcatctccttgttcttctctgggcaagttcattccagataacttgcccctctcctgcacactgttggtgtcatcgaggttccaaagcaatggttttgcagggggcttctcagatcctgagggatatctcagttctgctgtcctcttgcatcatttatgattatattaggtcatgcctgtcctcttgcttctggcctgaactaattcacttacacgtgcctataaggtgatcgaggtgacccaatgatcttcttttagccacaatacctattccatgatccttgctgaagctattgccagacagtgatgaaatagggattgatttgtcactcactgtgactaagctaagctggctgtgtgtgagcttgggcagtttcactaaacattccccttaccctaggattcctccctcagccagggtggcatggtgaaggcagggaattgcccatcctaaattagctgatcccaaagacttcattttcttgggagtcttgtcaccaaatagcccttggggacaggagtctttttgccaccattattagagtttaaattcttacctattactgatttaagggctgtagaagagagaagggccaagaggccaagctgtacaaggggctccagctccaaggagaaaaggatggtggctggggagtgggtgctctgggaacagcctgctgagcactttgaaatatggctagtgccactgaggaactgaatatttaattttacttaattccaattaatttaaatagccacatgtagctagtggcccctgaatggaacagtgcagtgttaaaatcagtacagagaagtatttagagcttggccttcagggctttgattcagattccggctctgctgtctacccattgagtgaccatagggacacttcttaaccttctacagttgtttcaagaatttgttgtattcaatataaagggtttagaacagtgcctggcaagaagtgtgtgtttagttaatgttgacttatcatatgttcactcggtattttgaatggaatggtagtagaattcatgtggaatatgaaatgccactgttttttggggtggggtgtgtgcgcgtgcgtgttatgttttctttcttttaaaaagaaattgttcttttgttgctctaggttgctgcagcaactggtcacacagtagtgttggtagaccagacagaggacatcctggcaaaatccaaaaagggaattgaggaaagccttaggaaagtggcaaagaagaagtttgcagaaaaccttaaggtaatttcttattatcgatgtcttcaagacaagtcctctgactgctttacatttgcagggcaatgggggatttctggctttctttctttctttttttttttttttttcagtttgttagtgtaaaactcatttttccataactttaaaccaatataataacataattactaaacattcagggggtactgattacaaaacaggagaagtaaataaccattttgttgggtgggatttgaggttgagaagaaagcttgtacatacaggtggtgaactcattctagaagaacatgagaatttggaattgaagaacacttgttttgctaaaaggatggaagaagaagaaacaggaagataatttttatactacaagttaagaagagaatgatataataaatatggtatttatagaaactaagagtgaatcattctacttgccaggagcagaagagatagaagaatttgaggaactctgtggaggctgggaatacaacagcatggtgggatgagaaggagttggtgactaagggccatgctgtttttcagcgcactttcacttaggagtttgcatttaattagaaatacagcacaaatcacccaaacaaattttaatttaccttttgtcatcttgttaaagttgcttaagattgatttccttggggcttggatagaatttctcgctgtatgcagccagagaaaagtacacataaggcatttgttgtttctcacttcaagtatccaaggtggtatatctagatgcttttaaaaatttttttattatggtagaatatataacataaaatttgccattttaaactatacaattcagtagcattaattacactcgcacattcatacttcatgtaagtggaatcatacaatatttgtcctgtgtctagcttatttcacttagcataaagttttcaaggttcatctatgttgtaacatgtgtcacaacttcattctttttttttttttttttttctgagacagagtctcactctgtcaccaggctggagtgcagtggcacaatctcagctcaccgcaacctccacctcctgggttcaagcagttctccttcagcctcccaagtagctgggattacaggcgcacgccaccacgtccagctaatttttgtagttttagtagagatggggtttcaccatgttggccaggatggtttcaatctcttgaccttgttatccacccacctcggtctcccaaagtgctgggattacaggtgtgagccaccactcccggccaacttcattcctttttatggcttaatattccactggattattatcatattccaatttaatattccattggatttataccacttttttttaacccattgtattagtctgttctcatgacattgctaatgaagacatgcctgagactgggtaatttataaaggaaagaggtttaattgactcatagctccacatggctgggaaggccttacaatcatggtagaaggcgaaggaagaacaaagtcatgtcttacatggcagcaggcaagagggagagcatgtgcaggggaactgtcctttataaattaccccccactgggcccctcccacaacacgtggggattattacaattcagggtgagatctgggtggggacacagagccaaaccatatcactcattcatctgttaatggaattgggttgttttcaccttttggctattttgaataatgctgcagtgaacattggtatgctattggtttggagtctctgttttcaattctttgggttatatacctacaagtagaattgctgggttgtatggtaatcctatatttagctttctgaggaaccaccaaattgttttctgtagtgactgcactattttacattcccaccagcaatgtacgaaggttccaatttccccacatcctggccaacacttgctattttccatgtttgttttgttttgtttcttattgtagccatcttaggtgtgaagtagtatctcattgtggtgtttttgttttttgtttttttgttttggaaatgaggtcttgctctgctacccaggctggagagcagtggcatgatcatagttcactatagccttgaactcctaggctcaagccattctctcacctcagcctcccgagtagctaggactatagatgtgagccaccacacccagctaattaaaaaaaaaatttttttttagagacagagttgtactgtgttgcccaggctgctctcaaactcctggcctcaagtgatcctcccaccttggccactcaaagtgctgggattacaagcataagccaccgagtcctgctatcattgtggttttgatatgcattttttccccaatgtctaggtggcctttagatgatggtggagataattttaccttctctaggatgaaattcaaataataaatgtcacaggcagattaatgttagaaatgcttgttctttggtgctgtaaagaaatagcacttgaaataaatttaatttcctcagcaagaccatttttactttctgcagaaagggtacactcgccagcatttttgccacaagagtacaccgaacaaaggagacagggtcatttataacctgacacgtccatcttactgctgtgtccggtttctattggctgggacgggacttcacattcaaatgtatttgtcttgattggctagcaacttagaactttttgaaagaggcaaaggcagatgagaacaaaggaaggaggaagtaacttgtggaatgctgagaaaggtaaaaacacctctaaataaggaagaggaacaggctatgacctaatgcccacttggaccagtataagcatgccagggcaaatatttaggctaaattgtgggagctaagaacataaagtacattgatttctttattacagctagcagatattgaagaatgttaacaggtcttagaataaattttgcttctaagaaaagttactatttattcttaattagatggggaggagagtctctttgaagaggaacttctactttactttttacattaagatattcttcacctgtcccttatattcttttttgttgagacggaggagtcttgctctgtagccaaggctggagtgcagttgcgcgatgtcggctcactgcaagctccacctcccgggttcacgccattctcctgcctcagccttttgagtagctgggactgcaggcgcccgctaccacgcccagcaaatttttgtatttttagtggagacggggtttcaccatgttatcccggatggtctcgatctcctaacctcgtgatccgcctgcctcggcctcccgaagtgctgggattacaggtgtgagccactgcgcccggaccatctgtcccttatattcttaattgtagtgggaccccatgcaggggatgttatgaggagggtccagacagatgagattataagagccctgggctgagggttggagtctaggacagagtgagtttgacccagatagcctgcattttctgcttgtttacagactttcagctaattgtctccttgggctgagtttctgagccacaccctaaagataaaaggatggcccctatgctcaagttgctcagctctggctagctactcctcagaagtctatactcctgaggtttctctcctctgccagggacaccactgaggagggaggtgtcagtttctctgcctagttgacatactatgcttatctagctctatactgaccaccaatataatagctactcacaagtggctactgagtgcttgaaatgtggctagtctagatagaaatgtgctctgagtgtaaaatagacactagattttaaagctataataggggaaaaatatataaaacatctcaatatttttaaatattgagtacctgttaaagtgatggcatcttagatatattgggttaaataacattaatttcacctgcgaatgtcttttccctttttttaatgtggctagtagaatatttctgtataacagctgagatctagctgcttattccatgatgattttggatgcctttgctgattatgactattttgatgccctgtggacaaattacactatgaaataaaatggcggcttatagaggcaccatctccaattctgtccttattgaggtctgtggaaacctggagtcacaggagaaaaatgaggaaacgatgaaaactacaggctctttggcagcagaggctgtgtctagcttgtttcggaaacaacagtttcaggcatatgacagacaataattatttgataaatgctaagtcggctttcttaccctggctcttgcccttgctctaataggagctagtctctgcttttattagagaggaatagtcagcaccacctcaagactaatggatggcagggagctatggaaggataaattacaggcttcgtggacactttgagaacagatagggtaggccaatacaggtgctctgaacacccagtttgctaactggagcagagctaagaacttgaaagataatttccagtgagcccggtgaatgttctcttcttcctcccactgcattaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgagtatgtaacctctggacaatcttctttttttttttttttaaccttatttttgtttttcatttttattttttgtttttatagatttgtgagtacaagtgcagttttgttccatgcctatattgtgtagtggtgaagtctgggcttttagtatacccatcacccacatagtgaacactgtacccaataggtaatttttcaaccctcgccaccctcccaccttttgaactctccagtgtctgttatttccctctgtacatccatgggtacctgttatttagctatcacttatatgtgagaacatatggtatttgactgagttgtttcacttaagataatggccttcactcctgttcatgttgcttcaaaagacatgattttattcttttttatagctgagtagtattccatggtgtatatatgccacattttctttaatcagccattgatggacacttaggttgatttcgtgtctttgctattgtgaatagtgctgcaataaacatatgagtgcaggtatctttttgatagaatgagtttttttcctttgaatatatacccaatagtggggctgctggatcgcatggtagttctgtttttagttttttgagaaatctccatactgttttccttaaaggttgtactaatttacattgccaccaccagcatgcaggggttccctttctccagattctcaccaacatctgttggttttgactttttaataaaagccattctgactggtatcaggtgctaaactcattgtggttttaatttccatttctctgttgattagtgatgctgagcattttctcatatgtttattgaccactagtgtgtctttttttgaaaaatatctgttcatgacccctggacattcttgacagattctgaggggtccctccctgggccttgaactttcctccttgtttattgccttctcccaggaagggatcctttgaccaagtttatccacctccctctctcctaccccacagctatttcaagaaaagccaatatggtttccgttgttctccatcctcccactcccagtttgcttctgaagcttgggctgctgtgatctgatccttgtcccagatgcgtgtagaattacccatggtaacatggaggggtccatccagggacaggcctatgtttcttgaagtgtgtaggtcatggatactcctatgccagaagctgctctgacgttccttggttcatttcacactggcatctagaggctgcagagacatctgacagcagacagttaaggacatgtagggtacttctgtgctccactctcgggcataggagtaccctacgtgtccttaactgtctgccaaggaccctcagagcagttctgtgtttcctccttttttggatggagcaaacagaatggtgtaattgaagggaatgcctatagacagagaggactttcctgttttgagcttcatctgggttcaatcgaagtactcttgggagtgttaaaggagcattgacttcttagctggctggcttcctggtggaattcttcctggcagaatgtaccttgggatccagagccttcgagtgtgtgacacctgacccactgatcagtgctcttctagtgacttgtttgactatattttcatgcttcttggttggaattgaatggcagaataagattatatgacaaaagcaattctcagggcacttccggtgggcagtggctaaagagagtcacttgcataccagcttgtcggaatgttaaccttcagagatgggtggccttgtggccagagaggccctgcccctgacaaagagaagagacttgcctttctgtcatctgtccatcactgccaatcagtgtcctcgtgcatttcacactggcatctagaggctacagagacatctgacaaaaacagaatatacttgtggtaccgggactggctcccaggccagcagggagccctctgggataataaacagccaccccaaaaaagggagttttgtcaagcagtttgatctttattgaaaagattggtcgctcttggtgacagtgaaaggcctgactgccctccattgtccatgtctggtacagaagaaggatcactggagaaagtcaggaggcctgggcctggtgctgaccccctcaccacctccagccttggaaaggtcctcagtttcgtcatctgtaatgcaagttgaggtgattggggtaaataatttcctagacctttctggctctaactctctaagactagcttcccccatttgtaaaataggagcagcagcactggtacctattgtacagagttgtttaggaaactcatttcatttagctcacatttcctgagtgcctgctgtgtatcaggcactacactaggctctttaacctgaattgatgcaaaacagatatgaggtgtgaaaagaaggcatgacccatagtcataccaaagatgtgactttgctgctgaccttctccacctttcttggcactgtttgtttttgttttagatcaccaccattattgaatgcttgctacaatttttaagcagccgtattgagaggtactttactgacaaattttacagttcgatcctataatgggagaagaaaatatagtcaagtgatacatttcgggttggaagccctgatgaaacagttgcatcctggagagaacatgacttctctagcagcagcctaagacacacaaatgaaaagtatgaccagacgcacaggcagccagatcgaagtcctgactttcccctttagacaaagtacagactcttgaatcctttgccatccccaccaaccctcttgtcttctttatactagggtctggggccattgctaataatcactgtgcttgtgttgtcgattttcttttagaacatttaagagaaaagtagtttttttggtacctgagtgtccgaatgaaaaaaacaaaagatggttcaagacaagtgtttccaggaacatgtaagagtactttttttttttttttgagacggagtctcgctctgtcgcccaggctggagtgcagtggcatgatcttaagctcactgaaacctctgccccccaggttcaagcaattctcctgcctcagcctccctagtggctgggattacaggcatgcgctaccatgcccagctaatttttgtatttttagtagagacggggcatgttggccaggctcgtctcgaactcctgacttcaagtgatccacctgcctcggcctcctaaagtgctggtattacaagtgtgagccaccgtgcccagcccagagtacattttgtttgtggatgaaaagactgtcctatgtgtttagtattctctgaagacagtgtgagacttttaggaacaaagtcagcctgaccctgttgggagaggcagaagcagaggtctgctggggagagatcatttcctccttctgataaaatgtgccagagtgccctggactggtgatacctggaactgggctctgatgtcactttattttaccaaatgtgcccaagtttcccctttttgcaggtgaatggcccttcaaacattctacaaaaaggggtattacgattgtaatactaatctttaaaataacactttcttttcttaacgggagtgtggagccacagctggcacagccttgggcccaggctgtccctgctctgtttttgtggttccaggtgcttgtggtgcaggttgtgtggttgaacagtgcttgtgttggccacacacattgttattggaagaggatctttttttcattaccttctgtaatggggaatagtttatattattttccccaatgaccaaaagcaagaaactttgaaaactgaaattttaagaccttaaaacaatgtcattttttttttaaaaaggaaaccctggcatttaaatggcctaccttggaagctgttggagaaggtggatgtgctcatacctggaaagagaaggctctccgctgcctacccacactggtctcgccttttacctcttttccctcctttccaaataactggtttcttctcccttctcttcctcctctcctcccacccgcccctgatttgagcagattatagtattgcctgttaggtaagcagaaacccccaagcctggtcagtaagggatcctttcctttcctgccctgttacagtccatcttggttggaatcagcaccaggcctgtttgtatgtttttatccgcaaggtggcgctgcaggaaagcctggaagtcaacctgtttaaagcttttcctctcatgcttttggcacgccactttactgtggccttaaagaactaaatttggtttaagtcagtatggattttttttaatgaataagttaatgtcttatatatgcatatgcctatatcctcttttccccatatctacccatgtaaccttaaaatttttttgaaccatgttggtgttcttgttttcattttaattcccattcaattgaaaaataaagcttttcacttcagggaaaatatcttaattcacgtttattatcatatgtttctgattgaggatttatgtgttcatttagaattttgttgcttttaggtgtctttctttcattattttttgatcactgagtttcgtttgtgactggggttggttaagtagcttgatcaattagccacctcttgttatctcacataccttggaagttaactaatacaagtaggtaggggaaattttgttctggaaaatcaaggaaggattggtgaaggttaaatacctcttcggaacaggaaattccaattttatttcaaatttaaaaatttttaaaaagctgaagtcacttgatttcagcctcttatatgaagatgtgtcttctccctcattcccccaatgggtcaggacaacagatgtggcagtaagcagtcaccttgtgcattgcatccaagagtcatgctgttttgaaagaagagattcactctgatactcccactatattttctcttcacagacatacaatctttgccagcaacacttcctccttgcagattacaagcatagctaatgccaccaccagacaagaccgattcgctggcctccatttcttcaacccagtgcctgtcatgaaacttgtggaggtcagtgggtgtcagcttgtgtgtgtctgcccgctctgccagctctctcagtcctgcttttctgtgttacaccagccctgccaccagttgcctaggatgggttttaacctgagggtagaaggttgtccctgagcctcatatctaggagggcttctatgctttgtttcttcacagccctgtgtcttgcttagtgatatccagaaaggctgttaactttgtggaatgtcatttacttatttgtgccagagctgatgggcagtgctgagaggcatcagaatgggaaggcagcactagaaaccgtgggctggatgggaccacacagagggcagctacatgtgttcatattatctcgtcgaggtcagcttgcccatgctgtaaatgcagttctcattagatacactatactagcttgtccacagttcctggggttaattctgaccccatgtaatggtgccttagcgttgtccccagatgaggtacatctcctgtgcattgtgatcagagctattaaaaccagctcccattgggtgcggcggctcatgcctgtaatcctagaacttttggaggtggaagttagtggattgcttgagacccaggggttcaagaacagcctaggcaacatggcaagaccccatttctacaaaaaataaaaaatcagccaggggttttggtgcacgcatgtagtctccagtacttggaaggctgaagtgggaggattgattgagcctgggaggttgaggctgcagtgagctgtgattgcaccactgcactccagcctggatgacagagcaagatcctatatcgaataaaaaaaccctaaaagtaaaaaaataaaaccagcttctgatagccttgagcctcctgaccataaacctggaaggtggagcggggaggcagggagggcttccccagcatcctgtttggaatgcttggagactccaatatgttggagttggagtcacagtaggcaatttgcacctgaaatgggacaacttgccttttacagggtcctaattacagggtctgaggagcagccgctattaaagtagcatttgttctgaggttgaggagttattgccctgcgaagtgtgggggacgctgatgctgccatgtgggtgatgtggggccaggcaaacctacacacactggctgtggcctctctgggagtgtgtatcgtctgttttcttcattattgccttttccaactaccttttccttcctttatcctcctcattccctcaccactactcagcataagcatttttaataagtcataataatgaccattttttttagcattttctctcaagtgacaactttgaccatcttgcaatgggactttttctgtcttactaacattgcttctcagcttcctcctattttctcctatcccctaaggctgattttttgaagaaattgaagaatgaaggggagggatttggggaacagaagaaacagcatttaacagctcttatctcatgcagattaagagcaaagaagtggcatgcatttccaacatttcagtacttagggactagttgatttctttagttattatattgtatatataagtgttttggagataggcacattctgtagatttactttaataatgttttcaactgcatttatctggtaatgtatgcttttgtctttggaaatgtagtgtgttggttgttaacagctgatgtttagcaaatgctactattttttagaaagtattttgtaaaagtgttcttctctattcagtttttattgtttaactttagctcttccttgtgttgctggtggtgtacaccaaaataacttgtataataagctaagtggctcctttacttaggactgggctcatttaaatgtatatatatatgtattttttttcagactctgttggaactaggagcagcgtatctgtacaaattactgttcgttgaatgaatgaatgagtgaataaacatccatctctcctgtttaaaaagaaacaaaccttcactattattaactcccttaaaccaaaaacttaatttgaaaactccatagtcagcagtgtttgtcccccagctcagtctgtggttttgatggagactttttagacctcctttcaaacagctctgggattctgtttgatttgtggtacccgcagggtggcttctggtctttctcgtcctgctcctcttctccatcttcactgtgtcttttcctgtttccatccattcacttctcttgatgtcacgacatgacaccatggcccaggctgtgatcacacgaaaacaggagtgagaactcttctttgtttatatagcacctttcatccctgcacagacactagctcattagttcaccgagtcagacggccctcttgcacagggaagacatgcccatgatccccattccagagaagagaggtgaggcagttgcctaagatcccatgaagggtctaaagtaaaccctttgactccgattgaagttctttactggcctttacattttacatatatatatgtgtgtgtgtgtgtgtgtgtatgtgtgtgtgtatgtgtgtgtgtgtgtgtgtgtgtatagttgaatgaatgagtgaataaacacgcatctctcctgtttaaaaatatatatatatatacttcatctggttctttccatttaccattacacatgagttctctaactgcttactgagggctgactgtgccgggcatcgtgcttggtgccatcccctacagatgccagtagggcagcccttgtgcccttgcctgtacctcacagaggtcaggagggctgctggagcaggtggcaggccccgcttgctgtaaatgaaagccttccccagaaggatgagtctgttctgaagccaaggggccgctggcctctagagcatctgtgtggcagagggtggagtcatgggagaaatactcaggaatccaggagaactgtcacttgggcaaattactcactttcctggggctcctcctcctctataatagaagatcaggtcccacgtagaagactttaagggcaaccatcatatacttccagacttctaataattaaataatggaagtcagcatttattgagcatttgtgcttaggctttgtgctttactcccaatgtaatttcattctcacctcaacttcctgaggtgaacagagtgatttcagtgtcatttcagtttcaagaaacatactcagggtcacacagccagtaagtggtgcaactgaacccaggcttgtctcaacaacaaagcctgtaaaactgtcctatacacacacgtacacacatacacttgtattttaagccgtgattttgtacattctacagtacactgttgtctttttttttttttttttgagacggtgtcttgctctgtcacccaggctggagtgcagtggcatgatctcggctcactgcaacctccacctcccaggttcaagcaattcttctgcctgggcctcccaagtagctgggactacaggcacatgccaccatgcccaactaatttttgtatttttagtagagatagggtttcaccatgttagccaggatggtctcgatctcttgacttcatgatctgcccgcttcagcctcccaaagtgctgggattacaggcatgagccaccacatttggcctctgttttaaaatagtcattttgggaaatacattgtttctggcttgagattcctacttctatgctgaaactcaaactatttttgttgcctatatggagccttttgatcaatcattccttgaaccattctaccgaagttgcttgctgacactctggtcataattctctgctttgcatttccaggtcattaaaacaccaatgaccagccagaagacatttgaatctttggtagactttagcaaagccctaggaaagcatcctgtttcttgcaaggtaagagtatgggtagcttgggaaggaggtagttcttttcttcttggaccctgacttgttcctggtagaattcttctcatagaatgatgtgaaagaaggagcattgtatactgcaagcttgtccacatgctgtaaagagcaatccgtgcctcctgttctagtttgtagacagggaaactggactcctaagccatgcctaaggccattatgtggatagtctgagacctgaatggagctcaggacaccagctgagtagaagacacgggactgctctctgtcctggcttttgtctcctgatgaatggctgcattttcataaatgattttaggtacagcttggtaaacacatacctccctaacagaaaatgagggctttacttttgcaagaaatactacagatggtgaaataaatgataagacagtgagagagcaacctgccaaaatagcaataaggaacctgtttctcaccgggaagttgcattatgtttttattgtttgttgttttgtttttcaagaagcagcatggtttagtgggaagcctgcttgacctccatcttttttttcccctttcttaagctgcccagttattgtatataaaataatcccagttgctgaaatgataacctacctgaaggtaattattttgattaccttcagtttctccatttgctttagttcctctttagttcccccaaaactcggggactatacttatgcatgactttgcagtttttcttaaggggtagttgtgtcacaaaatgctacaccattacaaagatttacatataagtcatctactttttttttaactgtaatcctttgtatcattatagttctcatagcaaacttttgctttctaaaatattctcgagtttgaacttacagtactgtactaacccatgaaaaatcatgttgttcatgaatcacctgaagaagccatctgttgaggtggactccagcagccaaagagagcaggcttgtgtgtcctgctcctccccgtccatgggtaaagtgttgttagggagtctcatgctttaacacccattttttgtttgtttggttctgtagttttaagtcatctagatttctaaactcatattaataattggatgttatgattgtactttcttacgcagttatgctttgttagtggaagaaagtagtaatggtattgaaaagaacatctgtgcaagacaaaaagatatggaaacagaagtacagggaaaagctaatgattatcttcagcagcataataattaatctacaaagtaatgattcagtcttccatcagagtggccacggcagctgcagagatgggaactctttgttctcattaaattatcttgttaggtcattccagaactctctctgtgtggtattctaagggctttcagagggtctttctgggtcagttattgaagctctttatgaggcatctggacaatatatggcaactacataggacaagggtcagcaaacttctgtaaaggaccagatagtgaatattttcagccatacagtctctgttgcaagtagtcagttctattgttgtagcatgaaaacagccatagacagtatatgcaatatgagtgtggctgtgctccagtaaaacttgacttacaaaaacaggctgtgggctacagtattgtactttaccaatacttgacatagaagaggggcattaatgtgcctggaatgtgccttcctagtgagacttcatgaggggattgtggtatataggttaagggtatgaactagcccaactgggtttaaatcctggtgccggcacttattagctgtgtaaccttaggcaagctacttaacctcgctgtgcctcagtgtcctcatgcttcacataaggataattatagtacctctgtcacagggttattatgaggaatgaataaattaatatttttaaagtatttagaacagtacctggcacacagtaagtacagtaaataaaatgtgtttaataaataatctgaaaaatatgaatttgattacataaaataaaattactttatttaaagattgtgtctcctgctaggcacggtgcctcacgcctataatcccagcacttcgggaggccaaggctggtggatcacttgagcccaggagttcgagaccagcctaggcaacatggcaaaaaccctctctacagaaaaatagctgggcatggtggtgtgcacctgtggtcccagctacttgggaggctgaggtgggagggtcgcttgagcccaggatgtggaggctgcagtgagctgagatcatgccactgcactccagcctgggcaacagagcaagaccctgccaagagaaaaaaaagactgtgtcttttcacattccaccaatatactgatagcatctgtctctctgcattctcaatagcatcaaatattattacagtgggggaaaaacctttgataatcttgttggcaaaaatgcgtatttttttgattactagtgagtttatttatttatttttttatttttcgagatggagtcttgcagtgtctcccaggttggattgcagtggcgcaatctcagctcactgcaacctccatctcccgggttcaagcgattctcctgcctcagccttctgagtagctgggaccacaggcgcgtgccaccacacccggctaattttgtatttttagtagagacagggtttcactgtgttggccaggctggtcttgaactcctgacctcatgatcctcccgccttggcctcccaaagtgctgggattacaggtgtgagccactgcgactggccagtgagtttaaatatttaatgagtcttggcactttttccttattgagctctatgagctttttctgtagaagatattaactgttggagcttcatgttctcaggtaccctatcttgagtctatagtgaaccttttgaagttgaaaagagtatttttgcctcaattataaaatctgtattgttccataatcttaattaagctgataaaacttgtttgtgcatctttgtgctcatgtggcaatagatggggttagggcttggtttcagtttgcctagggttaaaggaggttcacatcctttgtgttactgtccagtttccccgcatgcagtcaggttagctctgtgaggagtgcctggtcatctgtaattcagacattaaggaagtacctggtgtgtgctagaaacagaatgcagagttcaggccagggtgaggatttctgccctcaggaagatcacagccttttgacaaaagaggaggcaccatttgcctagtggaaatcagcttcaacaaaaaaatcacctgcttttctctacaagtccccggaagagatcagtagataaaatccaaatcccacacctgtcctccagagagatgattattgttagttactgagaagggaaatggatgaaaggcatatgtggcacaggggtcaccgcaggatgcagaggtcttagggggtgtgccgtgaaaggccagctctctgtcagaggctctgctcctttgtcggagcacgtgccctcaagtcagctccactgcagtgtgcgctggaacctgagaagttgctgagtagccgaggagtggctccaaggagcctggaaagcagtcctcctttgaggaccattcaaggtggagtgtgacgttttgtcgattcttgaaagggaattgggaggaaagaggaggaataaagggatgggtgtagggctgtgtgtacagcattttatgtgttttctgatttatcttcacaactttgagacaaactgtcacccccagttcacagatgatgaaacagattcagagtgacagaaggaccaagagagtattcaagattgaacccaaatctgtctctcccaaagccatgctcttccaggtcacacctgtgccttgatctgtctttatgtcaggatctgtgcagtggggcatctgggtttgaatgtttttttaagtactatgattgttggataaattgtcatatgagatagaaataaggccatgctgcaaattttgaaaatgtacagcttgataaatgggggcaaacatgatccagggtaagaaggggcaatttggtgacttcacaaaagataccatttaatgaaaatttactagttttttgtttttctgtctcccaaaacaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcgggccgtgcacaatggaggaagcagtgtctgttttctagctttgtgagctcagctgcaccctgagccctggtacctttttcactgttttcccagggcctcctggcttccctgtgggcctctgagaaaggtttctggaactcccaccacccccactacagtcccagccagagcaattgcatggccggcccagattgatatcctggatctctgcttttgattaaaaggtttactgcttttaaaaataatcataatgtaaaaatcactaggctaggagatcttgaaagttccttaaggttctaaaacttgtgactgacaggtgattagaaatatgtgacaaggccgatatgtggtaaggacagtttttagtagtctgtccttactgagtgatgtcatgatgtactttttgtaaccttaagaatggtgtaaacagttttcctcagtacttgattgacaaagaatgcttttctctgctgtagaaatatcagatttgggacagggtccaggcctctaaattgatctgcattctcctgcctgctttccctccctggtttctggaaaggtagctctcatgtctgcttcaaaggcaaacaagccttaataggactggataaaaagcaagtgtaattgttttcaattacttcattcataaatgctcactcctgagagtgtcattttttaaacaaaacatttacaccagctcttccagagagatgaaagcacatttgcttcctcaaaatctgctttaaatattaaaacttttctctatggtttatggaagcaattgcctcacttttgctccaagatcaaaccaacagttctggtttatctatcaacaaatatgcctaattacacctcaaagaaagcacagagcattttaccctaccttgaaaggcagttgtatgtcttttttttttttttaacaaaatgtaatgttttagaatgtagcatgtgagagatccaccttttaatggtgttttcctcactgtccatttgatgcattctccaatgcaccaagtatcagatggtaagttgaaagccctcttcttgtctgtggtccctttctgcataggtgcatgccctttagccctcaccatccctggccgcctgtgggctgaagctggaagagcaggacctggcctcaggacatgctcttagcttgctctgggcatgggcttcaacagcctatcattgctggtccctctgcttctttttccaccaccttctcagaatctgcttctgaagttgctgggtgtcctgcctggggtgggtgctgcttccctactgcacactacagtcacaccctaggcctcttaccatgtccccccgcccaccacctgctccctcctctcagccaacacagaggagtgctcagagcatgcccaccgtgccatctccgttcatacagttccaccttgaagcttcaagcatctggaggctccttctcgtctgccacatctgttcatcacttttgattccttcctgtcatgcctgttccacctcttcatcccaccttttccccatcccagtcaggctgccttcatgaggttccttaggtagcagagtaattcacgctactcatgtcttttcctgactggtccccgctactgcacttactgagaaagtatcatattgtccaggaagttgagacaccgcctactgcatctgcccacacaccccctgcacagcctcggcaggagctctgtgactgtttctgaactcatgcaaggagaaattttctgtaccccactgttgatacacctggggttccaggcacatggtttggccaatgctgccttgagtggtgcaggctctctggaaggatgtgtgtgctgttgtaggtcaggcctcctggatgaccgggcctctgccactaacacttcttgccagtccccatgggatctcgtggaggctcacgcccttttgctctgctgtttgtccactcattttggcttccatgttgggccttctttcccagtatcccagctccgtcctcactcttcctattgctcttgttcgttcacactgtgactgaggcctgatgcatgccccagtcactgtcactcctgtgagtcagagggacagaggctggataggctgtgtctgacagtggactgctgcccttgccaggcacccactcctaatggccagtgtgggcaggatggtggggccaaatggtcagctcttctcaggagggctctgctggcaacaggcctgggagcaccatgagcctgccccccagtcaccatgtgacatcttgctcacattgtcgcccctgctcaagacaggctcagtggttctctggtttcctgccatctacaagctctgccagagagccttccttctggccaacctctgcccctgctgttatcaccgccaactactcctgccattcccacgttgccccacctgagtgtctgcagagctcccagctggacatcatctctgtcatcacaactcttcttgctttggctctcccttgggtcacttgtcactgtcttccctgtggcatggcaggtgttttctttcccttactatactctcttttctggggcactctggctcctcctcatcttcatatgtcccaaggtgctgtgtagggcgggcacataggcagctgctgatgagtaaaaatgctgtttctgagttgttgctaagtgcctctgttgttcatgctaagaatggttggcaggtggtgctgctgagccagacaaagaagcagatgttgggcaagtcccagcccctcagctgtgctgatctggagttcactgaggaagctttcctttgctgtcttgtctggagttaggggctcttaactggagggaggtaggagagggtgtccaatgaacctcctaaagttgacgcagaatttgggttatatgtgcattttttatggaaagggtgtctgattgtcagaagtacttgattctaaagaagtttaagaattattagtttaaaacatgattccacatctaactgtcacttggcacaccaatctctgtattttgtttctctgtttctgaaagtttgcctcttttgctctgcattattgagaacacgatctttagagttgggctgactttgtagagttatttagatatttttctatcatgtgctgtatcttcatattatttcttgaaataaaacagtcctcaagtgagtctctgaatatggaattacagcgttgcttctagggttaattgtcctgtccttgaatatagatttcattaaatggctttagctgagttgcaaccattatgctgtcagatttctgtcccagggagactgccagtaacaaatgaaccagtacataagcatgttaggttgtgatgagtaattgtggagaagaagatagtaaggggtggcaagagtcttgtcctagtgtcctggccttttctttagtgcagggagttgctttttttatatatgcagggaggagaagaggctgtcagaagtatgacacctgagcagaggcctggaggaagtgagagactgagctccgaagctgtctgagggcagcacctaggcacagggagcatatcccaagcctgaggagcctgtgaggccggcacttccagcattccagggctctaccagcacagaagctgcggggcttcctaatgaaatcctctgagtagaacccacttttaagcttcatagccacaccccaaatatgctgtgttccttcccattcctgcctctgcatgtgctgttctctctacctagaatgcccttcctggtctgctcatctcaggattatcttcaccttccaggacccaggcatgggggtggttttggtgaagccctggcagtgtgagtaaatctctccatctttactcacacagagctgtgtgagtcatgaatcttcaggtcttattatgttgaagtttttggcttacacatctgagttctcccattatgtcatgagtaccttgagtgcttgtctggtttatctttgtctcattctacatctctggtgcctgctacataatgaatagaagttgaatgaatgaatgaatgaatgacgctgcctatatgattatttttgtttctttgctttcttatggcctaacactcaaatcatgatttctcaggcgtctctaatcctaattagtgtagttattagtaatgtcaaccataataaataattgtggtgtattttagtcaccttaaaatgccttgaaatcctttggaattactttagtaatttatttgcttttaaaaatatatcttctttatcgatgtttaagtagtttctctctgagtgtcttaacatttttccctcttttctttagctttgatctgattgacttcttaatgctttggaacaaaattctagatagccacctgttgcagactattctacttttctgatttcaaagaaagggaacagattgttctccataaaggcctcttggggccaaaggacatagtaaatttccaagggaaaagcacattgatccttgtcgtagtctactcaacagacttccaaacgtgtggtgattctaactcgggtttgggcttttctttaaaaggtatcttgactaaaaggtttgtgtgaaatgtgatgccaggggaatactccttacttgtaaaacccaaaaaactgggggaaagaatacatacaataactatacatacaaaagcagaaagcttagttttctttttaagaaagtttatttataaatcaaaaatatgctgtagcattaaattatactttaataaatgattccagagttggaaaatcccaatgtatttgaaagtagctgaagtttcaggcatggagacttctgtctccatgaacagggtatcagtactccaaaattcacctcagtggtgcgtagctttgaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacctgtagtctcagccactagggaggctgaggcaggagaatcacttgaacccaggaggcggaggttgcagcgagccaagattgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatggtaggaattggaattttttgttgtctttaattgaggtagtttttctgaactgtaaattataatgcctttttaaaaaaagttagcaggggtcttaataaagaccttccaaaatcctgcctcaccaggttgagaattcatgaacagatgtcaggagaaggaagaatgtgactgtctagtgtctctttaacagggtgaccttgaagaaaaaaaaacctttatggattcacaggaagttacaaatatagcacagacaggtcttgtgtgtgtgcccttcacccagtttccaccagtggttatatagccatagtacaatattaaatcccaggaaattgacactggtacactgtgttatcacatcaatagatttgtgtaacctccattgcaagcaagatacacatccattttaaaaaatatatccattgtaatgtaaaagctctgaagacagggtaaaaataataattaaaactggactactgaagttgaatgtagctatctgttcccaagtttcacagaatgctagttgaagaattaaattttgaatcttatgtggatgcaaaataccaatggcaggaatgcagattttttaacgtgtattctgaaagttaactgtgccagtgatgaatccaaccagcaaattaatggcttctgtcagtgtacttgggcctttggccgtagtgatttctgagaagacactggataagcaggaggaccatagtagggccaggcttcaggcagcacaggtgggtggcagtgcagcagctttggggctgatgtggctgcaccagcacagccttccttggtgcctctgcagtggtggccggaggggcgccatgcctggggggctctcccacatcagaggcaggcctccagacttgtccttggaaatgccaagatgtaaaaataaacccagcacttcatcctgagttctcttccctccgctcaatagggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggc

SEQ ID NO: 35753 - DNA, 69284 bp, Homo sapiens
gagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtgcgcgcccccctcccggcggcgagggagggacggacggacggagctggggagaaccgggcgaaggcgatggggtgaccggagagaagaggggggaagcgatgggggggacccggggaaaggtggcgaagcgatggggagaaccggggagaagagcggggaagcgatggggagaaccgggaagaagcccgcgcccggaagcggcaggggtacctgcggggcggcatgagccggcgaggcagccccggggtccttgcccggtggggcgggggaggaagggacatggcggtaggaacctccatccggaagatcagtgagttttccaccttcggttttgttttaaatggaacctggcagagggagtcgcctgaagcgccctcgggggtcgttctgcctctgagctgtaggacggggccgggcgtcccctccgaagcgtgggtacagcgcgatcacttcctaagtgcccccccgccccccaactccgccgcacgccaccccctagaatgtcgaggaagaaacggctgggtccccgcgcgcctcctgtcgcctcgtgccctgcgcggcgtgggcggggtcctggctgctgcaatgcgggacgcggcgggggtgcgcggggttcccgcctggcgtctccagggcggtccggcagcccctcgcgtttccgctgggagatttttaaaaagggtttcctgcgctcgcatgtgctgtcgccttccggctcgtgacaaaaacgaaaaccaaaatgggtcccaggccctccccgccagcctccgcagacgggaaggatcaggaagcggggactccgggatgtcagcggcgccgcggcgcgggctccgggcttccctgccctgcaatgtggaagctgctctctaggaggggcccgaggctgggcccacggacgcgggcgcgccgggaggatatttaacattgaagagcggaaggtggcggagactcggcgcgccccaggccccgggtgcacgtgggggcgccggtgcccggatgatggagtgtcccgatccgtgcaatccctggcgggtagatcggcgcttcccaggcgaacgcaacctgggagccttagcgatcgcgcaggctggagacgcggcgcgccccgagctgggttttgatttttgttttcccggttcctcctgccgcagatgcgtggaaaggcccggatggcggatttcctcccgtttcggggccgcgcactgcacagggttggagcggggatgcaccccctgcccactgcgcgggtgaccttcccttcgcccttgagcgcgcggggcgggcgcgggtgccgcaggttgaggcgctgtgggcgccgccccgcccgccacgagcgcctacgtgatgcccggcccgtcgtctccacgagccccggccccgacacccgtgcgccgcgcgctccccaggcccgcagcgcagcctccccaggcccagcgccccccgcgggagacccgggtggcagcgccaggccccgccccgcagcccgccctgcagcgcccccgggaagtgctctggcgttagcattccagtaaaaggaccccagcatcaacgttcttcctgcagggctgggttctcagagaaagaaaacgtgatgcagcagaggatgggattgaagaaacaggagagtgaagtggaaatagcctggcccgcgtgacttaaaccggcccggagatgtgcgggtacgaatggagccgccttggggtcgggataggacccagagtggcttctcagtcaaaggccttcagaagcagagggagcaccttgagtgaccttacctgggccgcgaaagacaagaaacctttggcacaggaagaggaactgatctctggaagccaccagggcgggtggaaagtcagggtttcaaggttattttggaatttaggtgctgtgggccttgtacggtggctcatgcttgtcatcccagtgctttgggaggccgaggcaggaggctcgcttgagccgaggagttccagagcatcctgggcaacatagtgagactctgtgtctacaaaaaaaaagaaagaaaaaaaattaagatactgcatgtattggaaaatatttatgggtcattcctttgagctccatgtccaaaagcttgctaaaatgcgcgggagtttgtgtacaggcatgtgagattaggatacattggcagaatcgcggtgttctctgttaccctggttttgccacctgggaggagttagacatattgaaggttagtaagtccacgcctcttcttttctggggaaaatgatactttggaaaccaatattatgtggggaacgcggcttggttgctgcaacctcgggttaataggagacagctgccctcagctctgcaggtggcatcaaatatggtggcctcgagcccacatgggtcacacctgggctgtccctggggaagcccgccatggcgggtcgcctgggcactctttccctggcagagctgaagtcacaatttttttgtagactctgtaaagagctttacccttcggtgatacgatcttgaacctgttggagcatttggacgcatttcttttaaggaagttcacctccagatgtactcagagggcctggtcttagctgccacagatttacaaacccttacagtaagtaggttattcctcgagaatatctcagtgtccccattcttttaccattttattctgattctatgttagtacttgattttccctgacatagaagactattgcttgtagctagagatgagagaacatattcacattcacgtattaatttcaggggaattttctgtcagatgtgaaattatggtaaaattccgtatattaagatgatcatagctaccatttgttgaaaacattttgtattctaagagctttacacttcttatctccaagcctaaatacatgatcccaagagaggcgtgtcctcattttggaagtggggagaaagactcagaaagaaaagtaagttaggtaagggcatgaggtgcatacgtgattgtgataggagcaaaacagatcttaattccaaatattgtactctcccgtagaccacgaagagtacttatgtctggctgtgtcacccaggccagagtgtagtggtgccatcatagctcactgcagcctcaaactcctgggctcaagtgatcctcctgcctcaaccttctgagtagctgggaagacaggaatgcaccatcatgaccagctaattattattattattattattattatttttgtagagacaggatctcactatgctgccgagactggccttgaactcctggcctcctgtagtgatcctcctgccttggcctcccaaagagctgggactacagacatgagccattgtgtcaggcctccaccatctccaccatgtttttcagggacctttcttggtgaagctgctttatctagttaatgctcaaaagtgagcaaaacccgatttgcccaaaattacacagatattctttgggtggctttgttaggggaacggaaaatgcctttttatagtgataggagtccaggtggcaagaacgatattatgtgatgggctgctttttcttctctcagtagagtgtatattatttaattataagatacaattgaaaatctctttctcttttctatattcccgactccccgggccttgaatgaagaaagtatttctcaggctgtttttgtttgtttgtttgtttgttttttctacttgcttggatatcttctgtctcaggctgttttttttttttttttttttttctttctcttcttctgcctctttatgtatcttctgttgtcccaagacatgtctggaaacttaaattgattttcactcaatctgaaataagctccataactctgaatggcggacttaccatgactaagtccccactgccacagaacactgtgccacacaccaagagtgactcattgtcttagtcacaggttgtggcttctgaaggtcctggtgcctggtggagctgagtgtactgggaagtccaggtgcatccttagggtaggctgcatgtgaaagctgcgtcctttttgcctgtggtgaggtgaatatcaatacagtatttatagaaagtccacataaattgagtaagtacaaacctttccaatcctagtgagaataactagcattaatgactctttgttatgtggcagggcctcagtgatcctgggcaatgacttatccctattttacacatgagcaaggggcgcctgagttgcaccaccttccctgagttcacagagctccgtggtggggccgggccctgtggctgcagcagggatgttcagggctgcgcgtacctgcgtcttcactggtgtctttcccgcgcccagcaccatgcctggcgcttcgcaggaatgcaagtgtttgctgcctgcctcctgcctggaatctccactgaggagcaggaaaccaggggttctagctgtcttcttcgtccatgaagtcctttagaggaattcaaccctctctaattaaaagtatccaatatcctcaggtcaatatgtgtaaactgttaagacttcaagattagaaccttaaaaccgaagtcagaagtgtgaggtttccattggctggacgtgcattaggtcaatgacacacatatttattggacaccaggcttgagccccacatgggcacctttggtgtctgaagcaatgctggcttcggagcccagtagggtggaaggggaaactgagaacagcgccattttgcctcccacggctctgggcccgttaccttcctgtgtacatacattatttgatgggatcttttcagtgtaaagtgcagtaattaattttgcaaaaattactgggtctgggaggcagtgtgttggaatgatggtgtcaccatgtggcacagtgggagatttgtgtaatggcatcattttctgtgaatgcagaccgttttgtgtgccatactcgaatgacccttcgaagctagacattttgtcatctttcgaaagaagcatgttttcccccttggttacagaaagctaaaagcttttgatacaggactccaaccttttatcagggagaattaggctctttaaataattagggctctaccaatctgatgggccatcagaagcaattaaaattagaaaggtgaagatacggtaacgtagtcaggacaaacatcaggataccagattgcacgttcacaatggcatttcggctaagaaagtgcgggtgaatatagaacagagggccgtatgtcagtaattgggttccgttttgtgtttcttttccacaagccctttctggtgttgtgtttttgtttattagagagtagctgcccaaaggctacagtttccctccccactcctcggttctctccgtcttcacccccaactcccagtcctgtgtttggaattacagtcattgtgcttgtcaggatgtaagaggcagccagacacatggcagaccagagcactgagaggcagagacatttataggtcctagccctggtcctgctgtctgggtcagcagggtgctgagtgctgagtgctgagatagggtcttgatgttttcctctgcagaatggaggcatcactcagtctctgtctcctctccctgtctctgtcttccctcccctcttccctaacacatatccacagtgaaagtgttcaggaggaaaagagaataggctggactgtgctgggacccccaaccccagggcccgtgtgctattttcccagcctccgtgtgcccagagatgcctaggggagcctgcggaggtgtagatcctgactgtgtgggtctgagtgaggctccgactctcacggggagggcaccggtgctgctggaccccctggggccagtggagcggtttgcaaatcgggcagatcagcttctccacttctccaggtttccccaatgtgagatgctcccaggagtcccatgggattgttttctgactttgaccaggattttgacagagaagattcattaatataggaccccttgtctaaacgtacatatgtaaatgatctgatccgaagtttcctgaatggaaaatgattgaaagggtggcatgcagtagcctcggggagtcagtccttcatatcttttcagctgtgtcttactacgattaagattttatttctgtgtgtgtgtgtgttttttttgtttgtttgtttgtttgtttttgagacgggatcttgccctcttgcccagcctggagtgcagtggcttgatgtcggctcactgcaacctccgcctcctgagttcaagcgattttcctgtcccagcctcccaagtagctgggattacaggcatgcgccaccatgctcacctgatcttttttgtatcgttagtagagatgggtttcaccgtgttggtcaggctggtctcgaactcctgacctcaagtgatccacctgccttggcctcccaaagtgctggtattacaggctggagccactgcacccagccttatttctgtgtttctgtaatcattgtgcatgttaacagactgccttgggtgagtcaggacaggattttggcaaaagaaccaggccctttctgcctggagctgtcactcctgtggtgaggtgcgggtacgacgtgcctgtagcctgacctgagaggaaaagctcctgtcttatgaaagggcccaggggaacctctggttggggccctttgacctgacctgacagtgagggaggagtccgtagaggagagtggcccagtggaggactttggctttgccttgggtgaactgggaagcaggtggagggaagcagactgactgtctccgataagggtggctttgtggagaggagaggaggggaggggaggccacaagtttagggtatcacaaggagcaggccacagatggaaggttatggggtggggcacgtggcagggcagccctgtgtccacagacacatcccgccaaggggacccagagacttgagtgtgtcagggcttggggtgaatgggcactcagctgttacagctggaaggtagagcatgtgagctccaacagacacaggcaggtgggggttaaaggagaatcttcatagcagtgcttagaatagcaaaaagtgggaaaaccagcaaaaaactatcaataggagattaattaattccattatggcacctggaatgtgccgagaccagctcagtcggggagaccgtaacccagcggcgctagaggaattaaagacacacacacacaaatagaggtgtgaagtgggaaatccgtggtctcacagccttcagagccgagagcccagaacagagatttacccacgtgtttattaacagcaagccagtcatcagcattgtttctacagatatcaaattaactaaaagtatcccttatgggaaatgaagggatgggccaaattaaaggaataggttgggctagttaactgcagcaggagcatgtccttaaggcacatatctcatgctactgcttgtggcttaagaatgcctttaagcagttttccaccctgggtgggccaggtgctccttgccctcattcccataaacccacaaccttccagcctgggcgttagggccgttatgaacgtgtcacagtgctgcagagattttgtttatggccagttttagggtcagtttatggccagatttgggggggcctgctcccaacagaatggaaggaatttttgtcagcgtttaataaggagctttgtgctggtcgaaagtcaagaggtacacagtatactcaagggcagtattgaagagccgattccagagcggcttccctctggagccagtggggcagtttgcaaatccaggcagatcagcttcttggaggtttctccaacgggagaatctcccaagagtgaggcttgcatgtgggtggcctgtgttatatatgcaattttaaatgatctagttgccgcattaaagaaaggcggggcagggggccgggagtgggggactctgggtgccaagactcaacatctgtaatcccagcccttcaggagcccaaggcaggtggatcacttgagcccaggagtttgaggccagcctgggcaacatggcaagacctagtctctacaaaaaatacaaaacaattagtcaggcgtggcggtgcacacctacagtcccagccccgtgggagattgaggtgggaggattgcctgagcccaggagttggaggccgcagtgagctgtgactgcaccagttcactccagcctgggcaacagagtgagaccctatcgcaaaaaaaaaaaaaaaaaaaagtagtgaacccgggaagcggagcttgcagtgagccgagatcgcgccactgcagtccgcagtccggcctgggcgacagagcgagactccgtctcaaaaaaaaaaaaaaaaaaaaaaagtaaaaaccggtaaaagcaaaaaactatgttttatattcaatccactattttgataacaatcaattattgtagattattcatattttacactgttttccgtagtaagtctttgaaacccagtgtgtaaagaagcttaaagcacatctccatgtggacgggacgcacgtggccagcggctcctctgagggacagtgtggtcacgcaatgggtggcgtgtgctgcctgtatttagaaggtccccatgtgggtgtttttgcgaaggctctgagggatgtgcaggggagggccgacactgtcccagccacgcagaggaccctggaatgcagcatgctgccgccgcgcccccgccccagcccctctgctacctgagctctttcccagatgtccatttggctaaactccctcaacttcttccctttccttctttctccaaacgtcactctcaggcaggtctgcaggctctccgattgtcaatggcagcccctccctgtcctccacaccctcaacaccccccaccccgcttgttatttttctccttagcacttacggccatccatccatgggcatcatgcatttgttcactgtgtttcttgctttcgggtctctcctgatcggaacaagctcttccagggccagaggcttcccatcttgtcactgatgcatccacacagagcccagcagaggtggcacttggggcacccgagctggacagtgggttggtggttgagtgaagagccctacagatttatctcaagccctcccctgaccctactagaagacacggtggtctgcacagtccaggaggtcagagaggccccccagttcgatgactttgaactggcaggggtggggagggaacagcaccttgacagaatctgcctttggcatcccacctccccatgcctacataatccctacattatcaaaggaaagacccctagaaggaactttggcagcagtagtgagatcagcgcggtgtaagctcattttctaacaaagcagcgggaggagtcggcaaactgactttatttctcaaaaagaatttatgcattgaaattaacaagtgagtgatcaggagtgtgggaaaattcaggaaaagtggctcagtgctgtgagagagggcgaggcagggagctttattactccagacaatggaggaggtaaaagatagacccagattatttcattagagttcatctattctttactttttttttttctttttttttttttttttttgagatggaatctcactctgtcaccaggctggagtgtagtggcgcaatctcggctcactgcaacctccacctcccgggttcaagcgattctcctgcctcagcctcccaagtagctgggactgcaggcgctcaccaccatgcccggctaatttttttttttgtatttttagtagagatggggtttcaccctgttagccaggatggtctcgatctcctgacctcgtgatccgcccaccttggcctcccaaagtgctgggattacaggcatgaggcatcgtgcctggcctattccttactttttaaaaaaaaaatgcaatttagattttatcagagcagaatcccaggaaactgagatttgtaaactgggaaatccagctcctccaagtagccaggaaataagggtgacttaagtcatgcttgctaggccctggtgtaggccaaggatgactctgactcaaggaagaaaccgtcctgtgactctcttacctgcattgtggtttagtaagaagctgttaaaaagtacggcatatgaagaaagcgatttaataattggtcagagtaatgaccagatctttcctatgaaaccgctccctcattatctccaactttatttttggttctcatgacaagatattcacttccctgaaaactgggatttttgcaaattacgaagcggtgtttttccaaatgttaaggttcttctttggtaggaagatgttattttctcctggaaatccttgggttgggctcccaaaaccaaaacaaaaccagatggattagccccaggatgcctgagctatttggacaatctgtggcttgagtgttgagtgaaagactctgaaactgccctttgtcccttaatggctgtgtgccagggcccacggacagccctaaggaaatggtgaaacaggtgacttttacctgtgacgccaaaagcccacgttgcgggctgtgaaagccctcattgcaggtgtgcacgtctgcctgcattgcaggtgtgcacgtcttcgtccctgtcctgtgggtgacagcccgccagtaaatgctggtatatttcccccttgcttttcatccaccagtgttcttctccctccaaacccctcactgaatgttcctggggcttcctcaggtttcatcttgcagggcccagcaggaggcagctgacttgcagtcctcactgttcagaagttcagagggagggcttagaactaaacagtctccactcccaggcaattaaatgagcatctggcctcagcaggtattattttccttcaagttcccattggtgactctgaggcacaggcattgtaatagaggaaattaggaaggcttgaaagttaaaatgaaataagactagggtttacactacagcttcaccgcttactaatgttgttaccttccagtaatcagtttatccccctaagagcctcagctttctcatccctccagggaggtgtcaggagctctgcaggcttcctgtgagaaacatccaggccagggctctggctgtgggtctgcagtcagcaagggacgtcctactgggccccaccgagtgctgccagtccctgagctcaaggaggacacatgaataaaagccctttgcaatgcatggctccatcctaccaatgcataaattaatagaagtcctttcaggacctagaattgtgtctctttaaaagtgtggtgcccccatcacctggaaattgctagaaatgcaagttcccaggctccctctccacctgtgaaacccgggggcagcccagctacatgggggtgctgcggccgctgatggtgagctcctgctgtggggtggtgtcactgttctttccaggtgggtgcaggtgaacccggagtgggggtggggagaatccagcagggacttcagcgattgagtttagtgctggggtgcatttttactctgcacaggagtctcctggggtcaccttgtgtatcatgtccagctttttttttctgagacagagtctcgctctgtcgcccaggctggagtgcagtggcatgatctcagctcactgcaagctccacctcccgggttcacgccattctcctgcctcagcctcccgagtagctgggactacaggtgcccgccaccacgcctggctaattttttgtatttttagtagagacggggtttcaccatgttagccaggatggtctcgatctcctgacctcgtgatctgcccacctaggcctcccaaagcactgggattacaggcgtgagccaccgtgcccagcctcatgtccagcttttaagaattttattccttcttctatgtctttccacttaacatttcctaaaatccccgagttcttcatcattcctttatgaaagaccggtgggaacgaggtcttcagagagcggggtggggggggggggaagaggagcaggggtgaggggccgccattgggtcttagttgtgctcctgcatcacctgcttcctagtgttggcacgggctgtgtttgatgggtaattcatccattagagtgaccatagcgtaaggtcctggaaccagagctgtgcgtccacccttcgagttgaagagtccaggcactgctgagcccagccatgggagagatgagcgaggaccttccacaggtgtgaggccaagggggcgggaggctctgtcctgccaggaataaatggaatcaggtgggaggctctgtcctgccacgaataaatggaatcaggtgggaggcaagccaggcccttttcctgggaggtgccagagccgaggaggagttggaggaggaagagcgtccgagcaagagcactggtgggactgctaccaaggttcaggaacaggagcctccgagtgctgccagacaggtgggaggtccctggggcatggccgggagctcaggggaacttgggttttcttccagtagccctgggaacctggaggaacgcggtcatattcgtgctttagaagagaacattgccgggtgcagtggctcaagcctgtaatctcagcactttgggaggctgaggcggatggatcacaaggtcaggagatggagaccatcctggctaacacggtgaaaccccgtctctactaaaaatacaaaaaattagccaggcgtggtggcgggcgcctgtagtcccagctgctcaggaggctgaggcaggagaatggcgtgaacctgggaggcggagcttgcagtgagccgagattgcaccactgcactccagcctgggagacagagcgagactccgtctcaaaaaaaaaaaaaaaaaaaaaaaagagaatattgaaactggtatggaaaacatctcggacgtagtgtcaaagtgtagaaagaaataacaagtgtgaaactcgcacagcccaacagcaaggcaccgtccccatacccagctctccaacggggtggggctcttgtggctgttacttcatttgttttttttctaaacaagaagaatatattcataaattatttgcataaaagcaaatgaaagagaaaaagctgttgtaatccttctggccacagtgtggctcatgtcagagggagtcagggagtcgggggtaatgttgggagcaggtgttggttgtatgggcaggagccagcaagggtgttagcagcattcagcgccagagacagagaagaaagttgtgctgttcggcaagagagaggttacagcgggaggaggaaatgatcagggtgagatgacctgcattttgaaatgctgagtttgatgttcttgagagatggccactagttaatcagtaggtcattcgaattctttgtgttataagctaggtttgaatataaagtaaataagactatgtaatatatatatacacacatacatatacatacatgttagatacatagtaaacatgcatttacctctaaaatatgtatccccaaggtttttcagccaaatagatactctcattcagaattgtcaactttcagaggcaatggtgactccagcatcgctgacctggcccaatgtaattgaagatttttctaagcatcttctgagccggtcaccgtccaagtgcacatagcctgcctctgtcacagatgcccctgcaggaccacagtcctttcatttgtggtttattgactggaaacatcactggcttcatggcccacgaactgcagcatctttagttctgacagctgtttctgaaacttaactttgcagaggaggaagcttggtgctctcaggtgtgtttgggagcaaaggcactgaaggctcaggtgttcctcatccttaagcagcagcgctgcatggctgtgggtgcggccctcgtgccttttcactcctctcccgatgggcctgagcttgttagccacgacagcaagacagaccctccaggcccagaggtggttccgagacactagtggcttcagctcccccaaatccagcggcagtggagagctaggtggaggctaacagacttatgatacattgtaagcagacttatatgatgatacattgtaagcagacttatatgatacattgtaaatagacatgatacattgtaaacagacctacatgatgatacattgtaaacagacttatatgatgatacattgtataacactgttcttctcaaggggggcctccctttatcttcatgaggtatggttatttgtaatatgctggtttattttaactttactgataataaaattgcatgacttgttttctgttgaagcccattgccttttttttttttttttttttttttttttttttacagtggtagttggtgatgtgatactccatttttcatctccttctcaaatcacacacacacagaatttggctagctgcaaataaacccctattctgtacttcgttttgcagttgaatggagtggcctacaaattcgtaccaagtccaggcagtgatgttttgaacagaaagtagcctgggcatgggggtaccttgcgttacgttggctgtttcttttagtccttaccctaatcccagaggagtgtgtgtacccatttctcatattaggaaatgaggcattgagaggttaggaaacggacccatggtcatgggtagttagtggcagagccagaattaccccgggctcttcagtgactcttgctcctgtttccactgcaggtatgaacgctgccgtccgtgccgtggtgcgcatgggtatctacgtgggggccaaggtgtacttcatctacgaggtcagtgtctgcccctcaccccctgtcgcccttcttccacctgcccagagccctgcagtcaccggcgctcgctcacccctgcctcccccatgctgagcacagccgaagaggtgggcaggggagcaagatcctgccagccagggccgttcctcagcccacagaagcccctggtctgcagggacagatgcctggtctgcaagttttttgttaggcaagaggagaaaggagatgagagggagcccaaaaagccattttcttttttcttttttttcttttttagacagtcttgctctgttgtccaggctggagtgcagaggcacgatcttggctcactgcaacctgctgggttcaagcaattttctgcctcagtctcatgagtagatggaattacaggtgcccaccaccacacccagctaattttttgtatttttagtagagaaggggtctcaccatgttggccaggctggtctgagtcctgtcctcaagctatccacccgccttggcctcccaaagttttggtattacaggtgtgagccactgtgcccagccacaaaaggccatgttgatatcaacttcctggtgttgatttataggattagaaatcaaccaatgatctctaattggttgtattggttggttggttgtatttgtctgaggctcttactgctgtagaagtgatttattaatttccaatgtaggctgaatttgaatacacatttagggaaatgaggaaaacagccactttgagcttttcatcattcatgtaaggtggaaacgatgcctagtgtctgctgatgtgttaaatagcaggagtgactccctgtctgccacttttgaagtcctggcaacttaagactaaaaagtatttgaaaggaaggcaccaatagagtttggatcacagtattaatttcagaaattattaggaaaaatatttaatgtttaaatttataaaacatagctttaaaaatgagaagaaggtatttttgtaaatcacttaatgcctccaaaatggctattagtgttttagtctgatttccttcagtatgacgtatgtaaaacaccggaaagaaacacacacattaggaaaagtacagcaaacacgttctgtatactgtgttttttgtttacgattatgtcatgacttttcactacgtaggtttcacgactgttgctttaacttattttattttattttttttgagaaaaatctcacttttgtcccccaggcttgagtgcaatggcttgattttggctcactgcaacctccgcctcccagattcaaatgattctcctgcatctgcctcccacatagctgggattaaggtgcctgccaccatgcccagctaatttttgtgttttttagtagagatggggtttcaccatgttggccaggctggtctcgaactcctgacctcaggtgatctgcctgccttggcctcccaaaatgctgggattacaggtgtgagccgccgcgcccagccaactgttgctttaaatgtcaacatactgtcttgttgaattgatgtctcatcatttatgatggaccctgtattccaccattcctgtggtattgcactatttagctttctccccgttttttaagctattgtaacactgcaagatctatgttaatattcaaagcgatttgatgttttgtattatttaataccttggtcctaatatcaggcaccgactgagctaaaagggacagtcatcatgatggcttgggatgcctcttgcctaagtaattcctgaaacctgtccagcctcgtcccagccccgcgcagggaaggcggtgctctagctcccatgatgatgctgtgtgccgctgtgtgcggcggccttctgagcactggcaggtttcccctgtctgctttctaagccatgtttccctttggtgaaatggttgctactattattctttgctcatttatctgtgtatccatttgtttatcatttgctggaaagaggtttttttgttcgtgtcattgttgtttgcttttattcaattaaactggttacgtggttattgtttgtatttatgcgatttgggcaattttaacggagggtctagctgtagcattcccaggctgttgtttttatcattttatatttgggtgtttttaaggtcagattgccctcctgagtttccctgcctggaccctggccctggtggcagctgccccttgctcagggatgtggaatgagcacagtagacgcggtctccagcacagtcctccagcccctccccaggagagtcctccagcccctccccaggagagtcctccagcccctccccaggagagtcctccaccccctccccaggagagtcctccatctcctccccagtacagtcttccacctcgtcccaagcacagtcctccaccccctccccagcacggtcccccactccactctccagcacggtcccccactccactctccagcacggtcccccattccctccccagcacggtcccccattccctccccagcacggtcccccactccctccccagcacggtcccccactccctccccagcacggtcccccactccctccccagcacggtcccccactccctccccagcacggtcccccactccctccccagcacggtcccccactccctccccagcacggtccgccactccactctccagcacagtcccccactccctccccagcacagtcccccactccactctccagcacagtccctcacccgctcaccagcacagtccctcaccccctccccagcacagtcccccaccccctccccagcacagtcccccaccccctccccagcacagtcccccactccactctccagcacagtcccccactccactctccagcacagtcccccactccactctccagcacagtcccccactccactctccagcacagtcccccactccactctccagcacagtcccccaacccctccccagcacagtcccccaacccctccccagcacagtcccccaacccctccccagcacagtcccccaacccctccccagcacagtcccccactccactctccagcacagtcccccactccctccccagcacagtcccccactccctccccagcacagtcccccaccccttccccagcacagtcccccaccccttccccagcacagtcccccaccccttccccagcacagtcccccaccccttccccagcacagtcccccaccccttccccagcacagtcccccactccactctccagcacagtcccccactccactctccagcacagtcccccactccactctccagcacagtcctccaccccctcctcagcacagtcccccactccactccccagcacagtcctccgccccctccccagcattgtcctccaccctgcccccagcgctggaatttgcacacagacttccagaagtggcggtcacctgcacctgacgaagaccagcttagtttccgctgctgctggagcatatacatgtgcatactgaatttgttccctctgcctttttttgggtgggcgggggagagggtgggtgtgatctgccttggactttgggagacagtaccacacccgtcctgagagctgctcttagtacagaaatgtggttttaaaagctgtttggggatggagtatcctgggaggaggtttttctgttataattcgcaaaatgtttttaaattcatgaagacttgtagttcacagaatgtttcccaggatgccttgtgattttcacggctgctcctgttcccgcggccctgacgctgttgtgtgttgagtggaagttagttccctcacagaagtggcggcctgaacactcacagggactctgggtgcagaggaaaggaaggaaatcacttctcttatttcacagataaactgacttaccttagttcactttctccgcgtcaccactcagcatgttcagggccaggaacagagttcggtccccgacccctggcctctagccgggagtagggagtgatttacccccttaggacgtttaccagtgtttggaggcattttttgattgtgccattattgaaaggattgcccctggaatgtactggggagaggccagtgatgctaccgcacatcctacgatggacaggaccacaccccacaaagaatggtccagacccaaatgttggtagaaacaaggccgagggaccctgcactaaaccaagcgcacactgtgtttggtttgaatgttgttagctggggaggggtggggagtgaggccgaggggagtgtgagggcctaatcttggatgcagtccctggcccactttaatctctcttgatgtaagggttgtgtttttgtggcgattgtcgggtgtctgatttttattggtcactgtgtgctgtagtcgcccgtctgtttcctggtgggattcagatgtcctcagacctgtgcctgctgtctgtgtggtatgtaccagaattaaggagttggtatggaacacactgggaggcctaccccagaggccctgggctttctctgatgtttgtttgtttttgagacagagtcttgccctgtgtcgcccaggctggagtgcagtggtgtgatctcagctcactgcaacctccacctcccaggttcaagcgattctcctgcctcagcctcctgagtagctgggattacgtgcctggctaatttttgtatttttggtagagacggggtttcaacatgttggccaggctggtcttgaactgctgacctcaagtgattcacctgccttggcctcccaaagtgctgggattacaggtgtgaggcacctcacctggctcagaggccctgggctttcttgggaggtaaaacccatatgttctctctgtctcagctgggagggctggggctctgaggcccatccatgtgactccatggccgcaggtgctgtctggacgaggtctggacaaccttgtctggcggggacagcgcctcttcctgcccctgccctcggtggggaaggaggggttctgactctgagatctcatttcctttagggaaattcacggaatttctgcaattcttctgctgagatgtggccaaaataaatccttgtgtgcaaatggtgttttgggggaattctaatttttatgataacttttatagtaagtggcaccttcgaagctgtctaggagcagagctgaatggactgtttatgaattttggcacaaagaatgatcaggcttttggaattatcttactgaggaagataggagcagcctggggatcagctcatttgagcccaaatttcctctctggcaccctccccacctgccccagaaggtgggaaatcctagtgaacgggtccatttcttcaccttcctccagtgtagcccaggcacctacctctgggcgtcttgggaacataaattctcatggaccctcagaccgccaggactttgtatgagtggtgggttctataaccagctgtagcaataaatgttgaatccatttatggtatcatcattttgctgttacagatataaaaatcctgtatctttcattcttttttttttttttttttttttacattatactttaagttctagggtacatgtgcacaacgtgcaggtttgttacctatgtatacatgtgccatgttggtttgctgcacccattaactcgtcatttacattaggtatatctcctaatgctatccctcccccctccccccaccccacaacaggccccggtgtgtgatgttccccttcctgtgtccatgtgttctcattgttcaattcccacctatgagtgagaacatgtggtgtttggttttttgtccttgcgatagtttgctgagaataatggtttccagcttcatccatgtccctacaaaggacatgaactcatccttttttaatggctgcatggtattccatggtgtatatgtgccacattttcttaatccagtctatcactgatgggcatttggggtggttccaagtctttaattctaagatagaaaacacactaaaatctgtgagtgttttcctaactgggcagcaaagccccggctgacctggagcgcgttgcctgggggtgatcccgtcacccagccgaggtgacggctcccacctctctttgcaggggtgggtttgatgccgtgcactcccaagggcccagagtatgggtgcagtaacactcactgctttttaaaacattttttatttttaattattatggatacataatagttgtacctatttatggggtacatgtgatttttttaaaatttattttattgaagtaaaatatgcatatatcatttaccatctttactatttgtgggcatagagttcagaaatatagtcttcttcccttttatccttgcttttccccacccctccccttccatacctctgataattgcagttctcgtctctatgagatcaactctgttagctcccacgtatgagtgagaacaggcaatgtttctctttttatgcctggcttatttcttatttctttttccatacagagttttgctctgttgcccaggctggagtgcaatggcccagtcttcgctcactgcaacctctgcctcccgggttcaagcgattctcctgcctcagcctcctgagtagctgggattacaggcacccaccaccacgcctggctaaatttttttatttttagtagagatggggtttcaccatgttggccaggctggtctcaaactcctgacctcaggtgatcctgccctcctgggcctcccaaagtgccgggattacaagcatgaaccaccacgcccatatgcctggcttatttcacttaacagtaaagcactttcatccccattgccacaaatgatggggttttctcctttatgggtgaacggtgttgtgttgtgggcgtgcaccacgttttctttgtccatttatccgctgacgggcgctgattccacactgggctgttgtgatggggagtgaatgtaggagtgcggaggtctctttctgccgattccctttctcggggtatatgcccagcagtggggctgctggcttgtgggggagttctatgcatgtcatagtctcatacaagcatgcaatgcatcatgataaaatcagggtaagtagcatatccatcacctcaagaacaatcatctctttgtgttaggaacactccaattttactcttttagttattttgaaatattattttgaatatatattatgtatatattattatacattatgtataatatgaattatatatgtattatacatatcgtatacaatgttatacattatgtataacattattatatattattaaacattattatacattattaactgtagtcgctccatagtatcactcatccctggattttattccttctatctcaaactgttttttacccattaaccatccttctttacacccctgcttccttctacttttcccagcctctggtaaccatcattctgttctctgtctccacgagatcaatcctaactctgtcttcatgagatcaattttttatttaagcttaaatgtatgagtaagagattgcagtatttgtctttctgtgcctggcttatttcacctaatttctgcctgttccatccatgttgctcagaatgacaggattcattcttttttattggctgaataatattccattgtgtatcaagatgtggaatcagtctaagtggccatcagtgggtgcgtggataaaatgtggcgtatatacgcaatggaatatttttaagccattagaaaacctgctttttaaaatcccaagtcttctgagtcctggcctgcctctcagacctgggttttgggtgagccatcgtgggcctgcaggacgtactgcagtgactgtggatgcataaatcaacctttcatttctgtgtgctcatctgtgcagtagaaatggtgtttgccctcctgtctccctggtagaaaggacttggaaaagtctgagactaacggggcagaggagctgtttgactgcttttcagggatgagacgcgcatgcctttgactccatgggtgtgtggccaggtagggaaacggggtctgcacctgaacacatctattcacagatggctctgcactgaagaggctcagccccctccccggcctggtctctgcgtcatacccacaggctgggcttctctctgagtgtcagggcgatggcatctggggtgggcaattcttggtgggcggtcctttgactctcaggatgcggagcagcacccctgtgtccacctaccccatagtcatgacagtcaaagatgtccttacagtatctccaacatcggcgaacgtcctatggggggaaaatcactcttttgggggaccgctgttctagacctatttgggctcaaattgaggggatattatgttttatttttttaaggatgactcagtaatttatccaacagatttttttcacctatactctagtttctaacctagagctctctgggttaccaacagaccaggacagttaaacaggttactattaattaaaggggtttgttttttccttcagtagtgcatgtgtgaagaaagtattaacctgggaacagtggcgtttctgctgaaagcctggccttcatcgagggacctctgctgtctggccgctgcttgagctcctataaacctgggccaagcctacgtgtgaagcatgccaagccttgggctgcattccagggagactcggggagggtttgccagttaacccattcctttctacctggtgaaccaattgttgcttctttcttttttctcttaagctaaggtttttccttagaagcctacaaatggctttagcttcttggagatgatgatactaagtatatcagatgctttgacccaaaggccatgcccagggtaaactaccctggctctggtgggtccaaaccaagctggggcgagtcagttggttaatccagggctgccactgtgtctgcaggaaacagtcggctccttgcatttggtttcattcatgaatttcatatcctgttgttgaatattcttctgcagatttcagaaattgttcatattattatagctcttcaaatatgactcacttaagattcttgccgagcaccgtggctcatacttgtagtcccagtactttgggaggctgaggcggatggatcctttgaggtcaggagttaaagaccagcgcggccaacatgacgaaactccgtctctactaagaacacaacaggtagctgggcgtggtgtaatccttggaaggctgaggcttgaactcaggaggtggaggttgcagtgaacctagattgcgccactgcattccagcctgggtgacagagcgagactgtgtcaaaaaagaaaaagaaaaaagtcttttatcttaattttttgtttgttttaaagtttggttctgctctagacagctgtttgtaaacaatatcagagctgtctttgtcatagtccacaccctaaagaaaggctaggaataattctgatcattttatcgctagttttttccatgattaaaaataacacattcaaaaggtgtcagataagtgatgcctttttatgttgaaaggataaagggtgttggtacagcatcagcatccagcctctggtcttcccagatgtgctgccatggagcctgtgccacctgacccccgccaccggcccccaagcttagctcaggtgcccgagggtctccatctccccatggcccccggtcagcagccctgtccctgcacccagactggccaacccttctgagcttgaaatatcagcatgtgatcttagcttcccttgtttcagccctgagcattacagcttgacttactataccaataaacaaaccattaacttatcaatgaattgattggcatcatgcttcccttctttagttggtctcgtggaggtagagaggaggatgtagatagcagaggctgggaagggggtgtggacaggaggggatgcagagaggtggatgggtgcaaacatatgcttagataggagtaggttccagtgttgatagcggagtaggctggctgtgttagcaacagcgtattatattaatgtatttcagagcagctgggggagaggactggaaatgttctgaatgggttgaagttaaaaatacccagggtgacagacaccccagtaccctaatttggtcattacaggttctgtgcatgcaacagatactcacatgtaccccacaaatatgtaaaattatatgtgtcaataaaattgaaaaaatatgggggaaaaaaacctttcccttcctgatagaaacccttcattcttcattagccataggaaatatttcttttgggttaaaatgaagctcctgcttttacaatttttaaagtgagaaatctcacacttgtgacccaaaataaacaccttttccccagaagtgctggtgctcccctgtctgaggaaaggggtgtgggggacctctcctaatctggaggatgcctgagctgctgggatgtgtagatgggggtggccacggaagcctgagctcctgggatgtgtggatgggggtaggggggtggccatggaagcctgagctcctgctcctgggatgtgtggaagggggtggccacagaagcctgaactcctgggatgtgtggatgggggtgaccacggaagcctgagctcccgctcctgggatgtgtggaaggggctggccgtggaaactagttggcaagacaaagagcaggtgacagcattggccctgacttctgggactgtgtctgatttttttttttttaaatctctgtctcacccctcccatccctgactgtcacccccaccttcccccaacagtgttgaaagaccaagcaaggttgtccacatcccgttcagtcacatctctttgatgttttaaacataactatttctgcccattaacttccttgaagtgaaaactactcaaccactccacttctgtctaaaaataagtgatgcttgagcacagcactgtgcagtttcttacgtgtagctgttcccgacctgactctacagggtctttaccagagcccatgccttccactaacacgcgtgcgtgctcaccgagctggctgactcctagaagaccagttgaggtggcctggttctgctctgcactccctgcctatcgttggaacattgtccaacaaaattgacacatccagggtgacgataaccacaggaacaagcattatctttttttttttttttttttttttgagacagagtcttgctctgtcacccaggctggagtgcagtggcgcaatctcagctcactgcaagctccgcctcccaggttcacgccattctcccgcctcagcctcccgagcagctgggactacaggctcccgccaccacacccggctaattttttgtatttttagtagaggtggggtttcaccgtgttagccaggatggtctccatctcctgaccttgtgatccgcccgccttggcctcccaaagtgctgggattacaggcgtgagccaccgcatctgtcgtagcattatcttttattacatgtttatatgccagccaggtcccatgctgaattcttcatgtatgatctgccttcatcccaccaccatttacaccattgcctgtggcttcagacaatctagtttcagtgaacatttcaaactgcagaagagcaccatctcccttcaccaccacctccccaccactgtggtcagctgaatgagcctcaaggtggggtttgctgtaaggtcactgccaggccagtgcttgggaccctctctctacaggggaggaagggcgaccggcctcgctcctgctggggctgttggttgtacaacttaccggaattgtgcactcttagctttggcttaaagaaatctgtgatgccagagggctaaatacatcatgctgttgcattattggtcttccaaagaagcaagtgcaggaccacatgatggtgtgtcgtgtgctaacctattttagaattttacagttgactgagtctcccaagaagaaatcctgaggctgctctatagaaattttctatcaagtaatgaaatcagtgagggtgctttgctggggtgattggtagggtctctggacaagagcgttccttcagagtgttggtggggaggtgagcagggcttgggatgtgtgttggtgtggggctgtttaatctcaggctctgcctctgaatttcctagagacaggataaagccacgattcctggcctttgaaaaccattgacatagtgaaattcctgccgcctctctttctcgcacacctagtttggaacgctggtgtttcccaagtctaagcctagagagccgttcagagctgacctctgcatgcatgctctgaattctaaaagtgaaatgctttaatttattaaggaatgttgtagctttaggttctgtgggggagggaaaaggattaaactagggaaagcttgattctgtaggaaacaaaaaaaatagtatttactcagaagcagcaaagcccctacatctctggatgcagtaactatgtctgcaggaagctggtgataacactatctggaaggcacttttaaagtctgttatctctaggagcttgttttattctggtagttggaatgttcaccatttggagttagttgagtgaagaattcaggaaatcagattggaaaaaagcattatccagttgagaagacacatggacccatgcaacaagcattctgaaagaaaaagcctactgctgcaacacaacggtataatttccctttgtctgtaactttaaaaaaaaaaacttacatatgagacgtccgagaaagccacccataggtgaactacgcgcataggtgaactagcttactccatttatgatggattcggcgattgcctaaaaattctagtcaaaaccacctctacatatagaatgatctcctacatggttagaaggctggttattttgacacagctcaaaacaatttcgaataagttgaaatgacttcagagcctgtggcatgttcttagatgtgatcgaatgactcaacgtaaaaaattctgtccgacgatggatccgatacagccaacgaggagctctaaggttcatcttgtgagtcagagtcaacaagacagagaatgttactttggccaaaaaactgagataaggttaaaggttttatgctctgtttttcctatgtgagtcataaaactggcttggaaggcaaattccaaaagggtgttttaggaaacgtctgggctttggctgtagtaagataaatattcagccttctaagaagacttcaaaagagaaaactcatctgaatttctacgttgtagtacgtttgggcaaaatgagtcttcctaatttagtaatatcttccttgttggtgaaagacggcttagaactgcggctggtagttgcttttcacatgttccatgggcgtcgtgactttgcaaattaaagaatgagtcatttcctagcaacttagctcacgcatgcactagacagggagcattggaggtggcactcagaaagccctccctttctattttttaatggctttctttgccacatgcatctatgcaacacaaaataatgaaattactttcagagaacattttacttttcaaaatgttgtggtttgcagagcagttttcttactactccagaagcaagaggattcgttaacatgtttgattaaatccgtatttaaattctgtgaactcatgcagggaaaggaaattgtatggttcccactatggcatattaactagtaaaatgctgggtggcggttgacttggaagcagcgtccgggatagcgcgtgctccaggaatactctgaaagctgatgccgttaggggtgcatggttgactcctgggcctgagacggcctcaggatgctgcagcggccttggcatcctcttcagcagggtggcggccggaactggcaccttccccccggtctctttatttaccaaaaaactgcatgcacagaaatgaccgcaacagctctgggtgtgggaatgtaggaactgtctgtttcagttttgccggagccccaggtttacggccgctctacatcccagtcctctcagggaggtcccggtttctgctgcagttcaggccccatcatgggtcatcttttctctcctcctgagatgtgggcttggaggatgggaggtcgtgcctctaagaagggtccgtttcacggtggcccaggctacatgcctgcttccttgtttccttgcccccccgagcttcatggaagtcaatctggaaagtcaggatcactgcagatggcagtttgttcagtgttgctcccagacctgaagaatggagcgctctgttgtgcttgcagaatgaagcataattcttagcagaaacctgggaggccgggtgcggcggctcatgcctgtaatcccagcactttgggagtccgaggcgggcggatcacgaggtcaggagatcgagaccatcctggctaacacggtgaaaccccgtctctactaaaaatacaaaaaattagccgggcgtggtggcgggtgcctgtagtcccagctactaaggaggctgaggtgggagaatggcaggaacccgggaggcggagcttgcaatgagccaagatcacgccactgcactccagcctgggtgacacagcgagactccgtctcaaaaaaacaaaaaacaaaaaaacctgggagtttggggtggtagagatcactgaaactgcaaccccaaggctaggttatctctttatttatgtatccacccacccgcctacctacctattgtacttacaatattctgaggattatggcctccaagagtcattcatggctttgcacatgaccgtctgttaccagtgagtccttgtgtggacagagcatccgcagcaggacagaacataaacggtgcctcccagggtgccctgtgcagaggcgaggtctgcatccgacctcacacttgctcaccctcgccctccgggggacggctacactgggctcatctgcactgcaagggaaatctgttttcagagcaaggggagacaataataataataataatccctagagtgagactgggctgtgtttagaagatgttctgctgttttgccatggaggtagggggcctggtgatgggcagtccctgtaccagcctgtgagccagggcctgggtgcctggggggtctcgggaggtgcagacggggctgccagcgctgaaatgaaccagctctgttttgggttctgttccattccagactgttttctcctttcttgtttattacatgtatgacactaaattataaacacacatgtggccaggcatggtggctcacgcctgtaatcccagcactttgggaggcccaggcaggcagatcacttgaggtcaagagttggaaaccagcctggccaacatggtgaaaccctgtcactactttaaaacaaaaacaaaattagccagatgtggtagtgtgttcctgtaatcccaagtactctggaggctgaggcaggagaattgcttgaacctgggagatgtaagttgcagtgagccgagatcgtgccactgcactccagcctgggcaacagagcaagactctgtctcaaaaataaaataaaataaacacacatatatatataatatttctggtagaaatttataaatataagtatacaaattggccagctatcaaggtgcctgcactattgattaatttatatatagaactccataatctatgagtcatttcaattttaaaaacctttcttttttctgtcctccggaccttcactaaggtgggcttatggatccaacaataatctatcatgaacttttctaaatccttaatagttattccttcttaagattaaatgctgtggaaagtgagttatgtagatgaagttacccgtgggcattgctgcatttcctgatcttgtatattccgtggagaaaaagatggggatgcatttagcattgaaaggtaattgttggccaggcgcggtggctcacgcctgtaattccagcactttgggaggctgaggcaggcggatcatgaggtcaggagtttgagaccagcatggccaacaaggtgaagccccgtctctactaaaagctacaaaaattagccaggtgcagtggcaggcacctgtaatcccagctgctcaggaggctgaggcaggagaatcacttcaacccgggaggcaggttgcagtgagccgagatcgcgccactgcactccagcctgggtgacagagtgagactccgtctcaaaaaaaaaaaaaaaaaaggtaattgtccttgggcttcttctatcaatgtgtcctcacatattgatatctgattccctaatgcagcaccgtgtcattaatggagggtaaggcagacaattattattcagctgtgctgtttaataatattcaacatacatcccaagtggcgcagggtgccttggcaggcggagcccctgacaaaatgctcccatgtatgtcccgtgctcgacagtgctgtgtgcctgtgagtttgtgctgaagtatgataaacacgttgggtgaaagtgacccctttcaacctctagcgaaacacgaccctttcaacctctcgggaaacgctgggccataggagaatggcttgattcctcattgcactgtgaggctgagtctaggcagacgttcccattactagggactcaaggtgaggactttcccacaattcactgcttttatccagtgctggaactgccctgtcttctgaccagtggatgctgaggaactgacattcactgtcatttttcccgttttatataatttaaggatcacttcccatttagtgaagtttatctcatttttaaaagattctccctttctcccctagggctaccagggcatggtggacggaggctcaaacatcgcagaggccgactgggagagtgtctccagcatcctgcaagtggtaggtactgggctgcgtccacagggttctctgagttagagactcttttatgtctagtaaattcccagaacacttgagctcagatcagttgcgaaatagagattatgtggacagaacagactttgtgagcagctctttacttgtggtttgatttttagaaatgcatgtgttaatctgtgagtcactttgagtacttgttaatagaaataatccaaatcggtgcctccccgctgaagacgctcatggggcccacaccttcgtgctggtccaggctctctctgcattgggcgcctcctgagctccgacacatcagaagagaggtggagggaattttgacaaccacggaagttaggtggagcaacgtttgcaaaacatcaggagagtgtgggctgaattcacacaggggagcgtttccattctgcggtcgtgattgacggaggaagataagatgtgaacggagagttgaagtgcgtatgtgtatcagtgagtctgtgtttctgtgtgtggtgtatgtggtgtgtgaatctcggtgtgtgtgtaactgtgtgagtctggtgtgtgtctgtatgtaggtgtgtgagtctgagtgtgtatgtgtggtgtgcccgtgtgtatgtgttaactgtgtgaatttctggctagcgaatgtgtatctgtgtgtggggtgtgtgtatatgtggtgtccttgtatgtgtaggtgtgtggtgtgtgtgtgtgtgtgtgtgtgtgtgtgaaagagagtgagtgagagaatgggaatggcacccactcctctgcagcccagttatcctggtttcgttcctgagttgcggccacctcgtctctttggttggagtttctgggttgctggctctagctcccattgtgctggctctcgtgctgccccccaggtttttgtccaggcagagtccagagagcacccctgccctgctctgcgcccccaccctcacttgccttgggggttgggttgtaaatggtctcggtcacacttggtgccagtgacgtaggatcgtgtggagtgaatttcagtttttgtaaccttttcataatgttttgataaattaaatggtggtaggtttcatgtaaaaataggagcttttctgggatttggaatattagtgagtctctgtgtgtgaaaatgagctgtgtgcgtgcaccattggtgtatcgaaacacgcactcacgtcactgcaggggtctcctgggagctgcctgcagaccgaaggcagggagagcttcgcctccagtgcagagacaacccctgctgtgcttatgagcaccttgcttgacaaagtcagcacgcgcttagggatcccgtacggatggagttttttggtgcattcatggttttatttaaagaaatcttgcatttgtggatcccaccaacaattcttagtttttggaaaaccaagtgtgacgaatcatgatctatgtcccctggaagtttggatgaaagaatttaagatcctgaagatatagctctttaaaaggggcagcgagtatgtggtgcaaaaaaaaaaaaaaaaaaaatccccctggccccaggttcctgctggttttacttgcaggtgctgtaaggggtgactggagggagaagcctggctgctggtcacaccgcttcccttgtcctggccggcatgctctggtggtcagtgggcttgtctttggttccacgtgcacctggttgagctcgttggccggtgctgaggcggctgctgtgacaccgcaggctggttcctgctccatgtatttaactgctggctgccgtgtgtctggctctgcaccctccctggctcctcctgggtgtcacgcgcctgtctttgtccatggaatgctggtctgggactaaaaacaggaaaatcacagtctttcatagctagttactaactcacaagatgaaaatgagaaaaatgtaaattctagcaccccatgtttatagtcggcctgtgtgtgccatccacctggcgctctctcagactgagaggagataaattagctggtgtctttcccagggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggtgagtggacacctgctcctctgtcctgcgggttttcgccctgtttcagagctttggaaccgacaggtttccctcttcactgtggcagaagtacctcttctcacagatcttacaggtcaccatctcaggactttttaggatctcaaaaaacaacagcaatgatcgtaagaatgctagtaatttaaccttaccatgtgccaggcacccttcgacctttcacacagatagctttatggaatcctcacgacagccatctaagccaggttttagatcatcccatttacagatgaggaatcaaacggccactcagccgtggggcgagccgggtccccagcagcctgggacactagcatccgcctttcagccctcacactgtgtccctccagctcgctggggtcctttaaaactgaagttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactctgtctcaaaaaaaaaaaaaaaaaaaaaaactgaagttgccacaggactttaatttatttagacgataaatctctgccaatacatcatccagtaccaactttggcactacttaggaaagcgtttctgagagccctgtgtgtatgtggtttatttttgttttgtttgattgtttgattttgtttgttttgagacagagtctttctccattgcccaggctggagtgcagtggcacgatctcggctcactgcaacatctgcctcctgggttcaagcaattctcctgcctcagcctcccaagcagctgggattacaggcatgcgccaccacacccagcttttttaaaatttttttatttattttttatttttagtagagatagggtttcgccatgttggccaggctggtctcgaactcctgacctcaggtcatccacccgcttcggcctcccaaagtgtagtttttctcccttgaagcggttatgtaatttcagtgcaatattaaatatgaccagggaagcatattgtttaacagcaactcgatgagaggcggcattgaggcaaagcagctgtccccaggtttgtgaacatcctcgtaggggatggagaaggctgcccgttggaagcagccaggcctcacggttcccgcttgtccacctcatcccgtctggcacagcacagtgagtgcacagaccgggacagtggccacaagtccgggcccaagcttgcccctggcccttcagtggttccgattccctttatgcagaactgcccagcccaggtctgtcctgagtgcgaggcagatgctcacccacgatccagcttcccacagatgcatgagaaatcagtgtgaagatggcctagtgtcttagattcttaattccgtaattgtaacgtatcctgttcaaagccgtgtcattctctgaagctgttgccaggaagtactgagatgtttgtttaccgattgcaaatgtggatcctttcttttatttttctaatccactgctcttgtctaagtgccaggtgacagagtccattgtgtgtaactgctgccagctttgtctggcttctctttccttaactatgcagaatccggttgccttgagttcggagaaaataaagaatcggccagggcagtggctcacacctataatcccagcactttggaaggccaaggcagaaggaccacttgagcccaggaatttaagacccgcctgggcaacatagagtgtgggtctacaaaaaaaattaagaaatcagccaggcatagttctagcttctcaggagactgaggcagaaggatcgcctgagcccaggagttcaaggctgcagtgggctatgatggtgccactgcactccagcctggtcaacagtgagaccctgtctcagaaaaatgataataaagaaatgataccaataacaaagagtttagaatggttgatttctctacccatggccattctgcctcacccctagtggggcaccccccgaacgcgccatggttacggcgatgagacgtgctgtttgctccccgcgcaggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagaggtaaagcgctcagaggaaccggcgggaggccagtggggcccgacgtgtgcccagctcagacgttaccacgggctctagaacattctgcagattgggtgtcctggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgacgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacgtacctgcggtgggtccggtggacgcggttcaggtgggggaccctcagcatcatctccctgaggctgcaccccacatcctgaatgctcccgtggaaagtcctgaaggggccggcatcccgcttcatacctggcgttaggtctgcacgtctgtcgctgagcggggtgcctgggctgccctcgtgggaaggatccttctggggtgttgatgctgttgccttgtccacataggtacctggccctggtgagtgccttggcctgcggtgcggactgggtgttccttccagaatctccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcacgccgttttctctctcccgactctctgctgctggagcctgtgtgcaatacaacctcatcccagtggccaggcttcggggcctcccctgggagggccggggaggagtggttcacagggagatggcaggaaactctggagggaggcagaaagcatggcgtgcacggggcgcctgtggggcgtccacctgtgtgtccttccccatgggaggcagaaagcatggcgtgcacggggcgcctgtggggcgtccacctgtgtgtccttccccatgggaggcagaaagcatggcgtgcacggggcgcctgtggggcgtccacctgtgtgtccttccccatgggaggcagaaagcatggcgtgcacggggcgcctgtggggcgtccacctgtgtgtccttccccatgggaacccctgtcaatcacaccagcaccctccacctggggctgactgggggccacatttctatctgcggtggtgatgtgagctcccagtcccaaagagctctcttccagtgagccacagccgccctgctccttcacccctgcccctctcctcacccctgccactgccccttcacccctgcccctctcctcacccctgcccctctcctcacccctgcccctgtcctcacccctacccctgtcctcacccctgcccctctcctcacccctgcccctgccccttcacccctgcccctctcctcgcccctgccccttcacccctgcccctctcctcgcccctgccccttcacccctgcccctctcctcgcccctgccccttcacccctgcccctctcctcgcccctgccctgccccttcacccctgccccctcctcgcccctgccccttcgcccctgcccctctcctctcccctgcactgccccttcacccctgcccctctcctcaccctgcccctgccccttcacccctgcccctctcctcgcccctgcccctcctctcacccctgtccctccctgctgtcacccagcacacctttcaccaccttctgatgtcattgggaagcagctcttaggaagttaggcaaagattcctgcccagaaagaggccagttcagtttgagacagacttctgtggttttgttgcatttgttgctaagaacaggattaggaatttgagagctttaattttctgtctccacagaaccgtgcccggaaaaaaaggctgaatattattattgtggctgaaggagcaattgatacccaaaataaacccatcacctctgagaaaatcaaagaggtgagtgtgtgtagctgctcactttctctcggtttctgcctggaagcaggggaggctagcgtcatgggcaggcttggtttagaacattgaattattaactttttatccttgatatttaaaacattttcataatgactcagaagttggacggcaggggaaacacgcagctcccgctcctgggagcccattccgcttacgtcacctcttgccgagcccgtagaggttccgggactccccagcagacagagggggtcagctcgagtggccacgcgtgttctttggattagaatgttccggctcttaaacatgagctgctctgagaatgaggactgaccacttggcagccgacccgggcttctgtttgccacagtgggaaaaggcggcgtcttgctattccctgtgccctcccataacccagagcatcagctgagcacattcttacaaagccactgtgtcctcgtggccctgcctgggaacaggctttggcaggctttggcaggcttcgtgccctgggacttgctcaggccagtgcctgcctgtctggagaggactctgataccatgggctgtgcccctgctgtagacggggctgcaggctgccggggctggggatgggctgtggctccagcagccacggggcagaagacgtccccacctggctttgcaagtcggcttctttattgtgctttgttatggtcagttaaggagcaaagcatatctctggatatgaaaacagtgatggacacctgggaaagacatctgccaatatttataagtggtcatccataaagtccaggcaaagattttatttcccgcttaactgtaattaaattataggacaatggaccgagaaggaaccaaggaatttacgtagcccagccccactgtccttacagaggaataagctgagttccagagacagtcagtggcctctccagatcaccgggccggtgtgcccatgggctggggcgaggggaacgccttgattgggctggcttgtgctgttcaaatcacagctgaacaaattaaagctggttcaaggaagatgtttacattttttgtaaaatataagtaatagtttaaatgcaagctactgaaacgttacttttttatttttcttttttaaagcaacgaacatattacttgtattcattttctaggtgcgagccaagatcttgtctggtaacaacagtattatttttaaaaccaattttcagctgcctgttatatacactaaacgttctgctaggaaacaaaatttagaaataacttttcccatttagatctgaagaaagagcgaaaaaccttttccagtgcccagtacctccttccagatctgggctgctgtgtccgcatcacagttccgcatcctaacgagatgtttccttgcagcttgtcgtcacgcagctgggctatgacacacgtgtgaccatcctcgggcacgtgcagagaggagggaccccttcggcattcgacaggatcttggtgagttgggaagggttgggcatcttcacaaggtctctaggaggaagcgtttctggagaggcacaggcaccagccggccacagaggctggcaaggtgctccccgagagatgcccgcggcccggccctcatcttaacgatccttgagacctttggtgtagaccagtctctaggcctgcagccattcagatgcggggagagctccctaatgtgggaaggcagtgcttggtgttggcacgacgtggaccccagagggcacaatcccagggcagaaaggctgtgtttctagtgagtttctggaaactgactcagggcagcaggaatcccaagtacaaaccctcagttcttaacactcctgctctccatgtgccctgacctcctctctgttcccgtcttgccagttctaaaggagtggaaatcgctttgctctaaagagttgggctggaagcgggaggggctgtgagcacctgactgaggtcattggacgtcatggaaagataggaggtgacagggacagggcaggacgggaggctgcccctgacccacatggacctggtttccaggccagccgcatgggagtggaggcagtcatcgccttgctagaggccaccccggacaccccagcttgcgtcgtgtcactgaacgggaaccacgccgtgcgcctgccgctgatggagtgcgtgcagatggtgagtgggcagcccatggccaagggcagggcggagacggctgggacagaagctgcttgtcaggccagcctgggcaccttgggtgtctcgtcggtgcacgatgcattacacggcctttctgagaaggaggtgagctgcccgtggggagggagaaggcttatgttctctcccacacctgcagagcctgcgccgtcttcgctctttggttttctaagttaccatccatctgtgtggcacatagtcgtaacctcccctgagtgggggtctagagcatcgggatcctcaacagtcgaggatccaggtggccccagtgcaccaggtgctgcagaaggacagagtgcagggaggcagccgagagagagagatccgtggacagactgcagggaggcgggcgtgagagagacccatggggcagagggggcagggaggcagggaggcgggcgtgagagagatctacagggtggtattttgtaggggaaggtgggaccttcccaaacttctccagtttcagccatttcctgtcctcctatccccaaggacattcaggtctgtgatgggacacagggaaagctctggtcacccgaagatacacccacccttcttgggccagggaactgtctgcctgcaaatgaacaaagggaaaagcagttccagcttttcaggcattggttcagtagtggaggtggctgtggagttagctgcatttgaagttatttaattaattaatttatttatttagagacggagtctcactgttgcccaggctagagtgcagtggcgtgatcttggctcactgcaagctccgcctcctgggttcacgccattctcctgcctcagccttccgagtagctgggactacaggtgcccaccaccacgcctggctaattttttttttttttttttttttttgtatttttagtagaggtggggtttcaccgtgttagccaggatggtctggatctcctgaccttgtgatccatccacctcggcctcccaaagtgctgggattacaggcatgagccaccacgcccagctgttgttttatttttcagagttcattcatgattcgtgactcctgttttgttgcctcttaacacacacaaagaagtcgtgaagcaatcaagtcagggacttgttgaaagtcaccttgtaaacataatttccaaaagcccaagggagaaaatagtatttgtgtgtatgtgtgtgagtgtgtgcgcaggcttgtgtctctgtgtgtatgtatgtatatgtgtgtgcatgtgtatctctgtatatgcatatacatgcaggtttatgcatatatttatgcatgtgtgtgcatgtttgtgaggtagtttgggtctgcatgtatgtgtatgtttatatgcatgagtatgcatgtttgtggtagtatgtctgcatgtatgtgtgtgcatgtttgtgtgcatgcatgtttgtacgtgtgtgcatgtttttgtgaggtagtgtgtgtgcatgttagtgtgtgtgcatgtgtgtatatgcatgtgtacatttgagtgtgaggtagtatgtttctgcatgttagtgtgtgcatgtatgtttatatgcatgtgtatatatgtgtgtgaggtaatgcatctgcatgtgtgtgcatgtatgcttatatgcatgtgtgagcatgtttgagatagtgtgtgcatgtctgtgtgtgcatgtgtttatatggatgtgtgtgtatgtttgtgagaggtagtatgtgcctgcatgtttgtgtgtgtgtgcaggtatgtttctatgcagatgtgtgcatgttggcatgagtgtgaggtagcgtgtgtctgcatgtttgtgtgtgcaggtatgcttatgtgcatatgtgtgtatgttggagtgtgaggtagtgtgtgtctgcacgttagtgtgtgcctgtgtgcatgtgagaggcagtaggcttaaaaggctcagagcactgaacgacatgcggtacgtgtattttgagcctgtgtctcatgtctctgcttgtctagagacgaccgtggtaggtgtcacttgccctgaccttgaaaccacccttgtgtggctttgtttttaaagctgagggaccactactgtgcacctgctgtttgtcaggcgtcttcctgagggtctgacatgcttgaataaccttagagatagctggaagtaggagtatttttctcatcttacagatgaggaaattgaagttcagagcgagaaagaacttgaccaagatcctgacgttgcccagggctgcctggcgtgcatcagtcccagccccgtgtcccagggcctccatccgggcccctctgctcccccgcccgctgtgacctcgctcccatcccacatcccccagtgagctggtgtgttctgttttgtttttccccaccataatcaaattgagaattccttagaaccatgcctgagagatttcatttcctctggctttgttctcttggagttaaatcttcacagtgttgtgtccacaaacagcaggtgacaccttctctttttcctcagaagcctcctgagctaagcagtcccagggctctgacctcacagccgggccgtgtggggctggctgccaaccagcattaggacacacttggcggccggtcgtctagaccattaaccctggggctgctggctgcccgggtcagactggagggggctggtgggaaggaccgagccagtctctacctaccccatccatgatgcaccaggtcctgacacattctttcttcttttcatcattgttttaaaagactcaggatgtgcagaaggcgatggacgagaggagatttcaagatgcggttcgactccgagggaggtgaggtgctttggagaaagctctgccctgtcaggaacacacacccctcaggcccagccactgcaaacgtgcttaggggttgtgcttattccatgtcactgtgaaaaatcagaaagtcaggcagtactcacagcaccgctcttgcagtagcaggccctggtgactggttagagagaaatcattttctaaatttgccattggtcctttttggtaaggtgatggttgtttaggagctaatgagattaaggcacaaggtgacttgtggccctttaacaacaaaccaaaacaaaaaaaggagtctccttctgttgcctaggctaaagtgcagtggtgccatctcagctccctgcaatctctgcctcccatgttcaagcaattctcatgtctcagcctcccaagtagctgcgactaccagctcgtaccagtgcatgtcaccacatccagctaatttttgtatttttagtacagacggggtttcaacatgttggccaggctggtctcaaattcctgacctcaaatgattcacccgcctcagcctcccaaagtgctgggattacaggcttgagccaccgcacgcatgtcttgcaagagaaagttatgaagtgtagaagcgtgcccttttctcttagtccatttccaccagacacggacagcaccgcgggtcgcggctaagggctctgccatgcacatggaaccctggggcctcctccttctgcccagatagtcgggcagacacattgagtgctggcagataagccaccttttctccacatgagccctgagttgtgtccggtattctcgactccggtccaacgacacccttttcctttaggagctttgcgggcaacctgaacacctacaagcgacttgccatcaagctgccggatgatcagatcccaaaggtaggtggccggcctcccgcgatgccccgacctctcctgcgggcctcccctcatggcctctgcctcagtgaatgaggccacctgttttcaggcctggcacggcatgagccactgccaaagtgtgcagcaaatggagctcacgtgtgcccgtgacccagcactcacctgccttctgttttgcagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccaggtgagtcacccaggatgccgtaggcaggcagacaccctggctgtgagcacagtggacgtggcggcgggggggtgccctccatggccctcataccttttcatgcctcagtccgggatcctgtgatattgtgactgaagcattgcttctggagtaaaatctcaccctaaggtaggtttcaggccctcagatggagcccagggtatgatgtgcttttgaattttctgaaaaggtgctgggggatggcagtgcctctggggtctgatggccctgacattaggtgagaaggaaggtggcgttgtctcggaggctgtggtttgtttaaaccgggcactggagggaaagcaggcagtgtctggtgtgcacaagcacccactgaaatacaaaccttagtgaacacaggtaacaccccttgatgtgtgctgtatccagttgttctgtgggattgacatgtgttcacccatttaagcctcacactaaatctaagatgttatccccattttcctcacaagaaaaccgaggcatagggctgggtgcacgagggaggactggaaacaggattctgagctcctgaccaggggctgaacttgtggctatttgtttatctgattagccaacaaatacctactttgtgaaattcttttttttttttgagacgaagtctcgctctgttgcccaaactggagtgcaatggcgtgatcttggcccactgcagcctctgcctcctgggttcaagcgattctcctgcctcagcctcctgagtagctgaaattacaggcacgcgccaccacgcccagctcatttttgtatttttagtagagatggggtttcatcatgttggccaggctggtcttgacctcctgacctcaggtgacccacccaccttggcctcccaaagtgctgggattacaggcatgacccaccgtgcccagcctcctactttgtggaattcttatgctgaggaattaaatgagtgagcaaagcagacacaactctctggttccgtggagactgcgtttatagatggggagagaggacagtggctgaggatcctcctgctctctggatggtgagcagtgctcagaggcatgccgaggagggcctgctggagatcccccagacagcaatgctggggaaggtgctcccaggctgctggtggctcatggggccctcaggggacactcatcccaggtggagggaaaggatgctctggagctgatgctcacaggggcgggggctccaagcccgcacagggcagtgaggatgggaactgcaggggcagggccggcttctttgtgggcagcctgaggaggttggcttttatgttatgtgagattcgaaggtcctgagcagggactggcccacaccaagagctttctaaagggacccgctgctgttcactgaggcaggaggcagggctcccagccggggctttgcagtcacctagcaagagatggtgggtccagactggctactgtgcagatggcgagaaaccttcaagggtctggaggtatggagggcacggagggcagatggggtttgcttgctaagtacacgcaggcataaacagaggaggcaaggatcactccattcctggcctgagcacatggaaagggtagagttgcaatttatgaggactaggaagccctgagacacacttcttgcaggtaggatgaggagcggagactcatgaggccagggtgaaagtgtgtgtcccacggccgaggacaggactggggatgctggggtgaaagtgtgtgtcccacggcggaggacaggactggggatgctggggtgaaagtgtgtgtcccacggcggaggacaggactggggatgctggagtgaaggtgtgtgtcccgcagctgagaacaggactggggatgccggggtgaaggtgtgtgtcccgccatggaggacaggactggggatgccggggtgaaggtgtgtgtcccgccatggaggacaggactggggatgctggggtgaaggtgtgtgtcccacagctgaggataggattggggatgccagggtgaaggtgtgtgtccctcagctgaggacaggactggggatgccagggtgaaggtgtgtgtcccgtggccaagaatgtgcagtaagccgctgtgtcccagcatcttcaggagggtttggctgagctcatgggtttaggaatcttcagcgtctccacgtagttaaagatgcagaactcacagagcttccctgagggcctgagtgcaggcaggagagagagaaggtccaggactgattcctcagggcgccattgttaagagtagggtgggaagaggaaaccccagcccaggagactgaggagtggcagagaggtggggtggagatgccctgtggcatccctgggaacacagatgatccaccttccaccaccactgcccgcccttctgtgttggcccatccacccgcatctcagcagcaggaaccggatgaggaaccgttctgtcctgggtggatcttgctttccccgtctttcttgttcagacttgtgaagattaattggcttaaaactggtatttgctttatttaaaaaatattgccttcaaaactgatttatgtgggaaaaaaaagcctgatttatatggttctgtcaaatatatatatatatacatacacaccttgtacagtatttaccttttgatgtagaatgatcttttttctaatgtaatttacctggagatccccctgcagcatggcagtgtgtccaccacatccgtgaacttacccagaatctcgtgaccggaagctgcggagctggggttcgagccccacgggttctcctcctgcagtcctgccgtcctcgcagtggcatcctctttctgcgattaccttagtttgcttagtaatctgttttccttttttctccctagtttgtaagaaaagaaattttcccttaatcttttaccaacttagaaaccatcatgttacttttcttttagttgccggtggcgggatacggtgagctgatgtatctcacacgtggctcaggatgagacacagaggccccgacaggcagggagaacgcagcccctctgctgctcttcatgagttgttaaccttggacttctgcttctcaccttgattcatccgggcatcgtgataaatgctgtctcatacgcctctcaaatctttaccggaatgcagcttgttgaaaagtacagaaagctatttttagcactttgcaacttgcctttcattgttcactttagctgtttcgttctgtgtttgcacattagatcaaagaaatcggctggacagatgtcgggggctggaccggccaaggaggctccattcttgggacaaaacggtaacttccaaatctcaactctatgacctgcttttaaggaagaaggaagagccgtgttctgggagagaatcgctgggtgccgacgccagttggattcctggaaaggcgtccctaagggaggggtgcaggcagttaccggtcctccctccagtggaactgcccgtgttccagggagctggggatgtgtcccagggcgtaagagagaagaggaggtaacttgtgaatgccttcctctaattcatatttccattcatttgaaaagccagctggcgagcctaaagcctccacttggaggtcataaagatgagtggtgtcacggagccgtggagatggcactctaagcaaaccctaaagcagcctggatagcaggtagcattggtgggaagcatagccctgagcagctgtgactcgaggctcagatttccacagccgaggaaaggacccaaggaattctagtctaaaaatctctttttcagacctacagtaagcctggcgtccctgcatccctggggacaatgggatttcctaatgtagatgaagcctgagtaattctcacctttgatcatgtcagaggtgcgaatattaatctctgtcatcactacacattacaatttcacatggaaggaaggtagtttttggcaaatataataaatgatggattccatgtaattccggcttattgttccaagggagttagctgcaccctttgctttgctttacagccaggaccctggtactcccagccactggtgggatggtgggagcctcggagctgggttagctctacagctgcctcccggctgttctcatgagctctgtgtgtgggtgccctggacggtaaagctctaggtagaggcagatgcatccctcggtgtgcgttctggggctgaggactggctgctgacaccccgggcacaggtgcttgatagggccagggcgttgctctcgaacgtagagaggactcgctggctgttgtgggctcgtcctgaagaggcttaagaaacctcaccttaggggccagcacaggtttgcacttagctgcattcacttgtctgctctgattgcctggcctgaacgtttttgccctacggtgtcttataaatctaccaagagtacaagtacttcacttcttccaatcaacatgaaacctttggatgggcttgggatgggatccagggaggggcacagtctggtgttgcacttgttagccctgtcatgtgacattggtgagagcatgggggagggagagcaggtatgagcagatgggattttaaatgagatcaatagtggataatgcatatgtaagttatttggaaactggaaatttccatttaaacaattattgggcacggcggctcacacctgtaaccccagcactctgggaggctgaggcaggtggatcaggaggtcaagagatggagaccatcctggccaacatggtgaaaccctgtctctactaaaaatgcaaaaaattagccgggcgtggtggcgggcgcctgtagtcccagctactcgggaggctgaggcacgagaatcacttgaacccgggaggcggagcttgcagtgagctgagattacgccactacactccagcctggtaacaaagtgagactccatcttggaaaaaaaaaattgttattaattataacttcttaattttattttttctaatggggcagtagagttctttttaggtcaaggtatgagctgaaatgctttattccattttctcatgaaaacactgttttgagatgagattcctggtcattctgccatctgccagccacaacggcatgagtgaaaaggcagacgtttaccgctccttaattaaaaccacagactggggaaggcggccgggtggggaccggcgtggcgtcctgcggaccgcgtggagtttggggtgtctgacatcgttctccacgtggctattttcagcgttctcccggggaagtacttggaagagatcgccacacagatgcgcacgcacagcatcaacgcgctgctgatcatcggtggattcgaggtacgttaccgtttctctcttgccggtcttgcaggtgtgagccgcgccctgtgttggctaaacattaagctacttgttggctactggccacgatccgagatgataggttcccagacccagcggccactggagaattgtagaacagcaggatagcaggtggtaagacgtggcctacgagtggcccagttccagtaaagcaacttaaccgagaagcaaaagcttgactccttaacccgggcctcatctattcagtgagctcttaatgtatttcaggcctgtggaagtaattctatctcttgagtccagagtccagtggctacttagagactaaggtagttatacctagaattttgtttaaaatcacatattggactgtagaccctaatattttttctattcatgaagattagtcccatggtaacctttccatttacttttagaaaaagtaaaaactggccgggcgcggtggctcacgcctgtaatctcagcactttgggaggccgaggcgggcagatcacctgaggtcaggagttcaagaccagcctgaccaacatggtgaaaccccgtctctactaaaatataaaaattagccgggtgtggtggcaggtgcctgtagtcccagctacccgggaggctgaggcaggagaatcgcttgaacccgggaggcggaggttgcagtgagacgagattgcaccacctcactccagcctgggccacaaagcgagactccgtctcaaaaaacaaaaacaaaaacaaagtaagaacctcagaaatgagactcttacccatgagaggtttagtcatctaaccgatcatgtctgtcctgcgccctttgtgcttacaacctgccgatccttgtctgtggtcttaaggcaactgtgtgttgatctcggagtgttttcgtgatgccccagtgtgctccctgcgtgctgtggtggaggtggcgctcccagcctctcccagcgagaccctctcctccccagcttccctctcgccccacaactcccacgcttgtctgacaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacgtaagtccgtgtgcgccctgccaggcgggcgccggctgacgctaaccccggggccccggccctttttatctaccagtgcgctagaaatagccttttacaaataccctgaatgagagcttctcgttctttttttcccccagaaaagtatgttttaagactctgaaaatttttgatctcactcccagagagttttaccacctcttcttctgtgtggccaccagggggacgtagtgtggccgagactccaggggtgcccgtgagcacccgaggcgctgaggagggctgggtcgcagtctcctgtgattgtaccagcattaaaaatcgctgtgtgtgtgtgtgtgtgtgtgtgtgtgtgctgagcctaaattttctttgagcctccaatacccattatgatgaacccctgccttgatgctgagggtagaaattgaactgaatattttataattttattcattgccctgaatgcaccattgcatttgttatctctctggtcttggctgttgacctcattttcccctttgtaaactggggatgttaaattacctctaaggcaataattggtgctactttagtttttttgccaagagacaataataaaacatagaaatatattcttctttttttctttgtgggacggggtcttactctgtcacccaggcttgagtgcggtggtgtgatctcagctcactgcagcctcgacctcccgggctcaggtgatcctctcacctcagcctcccgagtacctgggaccacaggcatgtgccaccattcccggctaaaagaaatatacacctattcccatgtttgtgtgtcacgcttggtaattgatgtgggagtttgaagatccgtacctaacacagaaagcatttcatttttttaaaatttgatgtctaaaagtttgtagtaattctcaagttttaatttttcttgtgagacttggttctcatgaatatttttcaaagatattttttcttgtaaaaccttggcatgaaacttatttctagcactggtaaataaaaaaacaagcttttaacatacagctcatatggtaagtaatgcttagcactcgtttcttgcttttctgagcgttttaaactttcttcactttctttgcgaaggaaacctgcccaggttttcctgtgttcactggctttgggggcaactttcaccttatttttggcagttgctaatctctgacctagacgttgcttctgttctcctggtggtgggtgtcacggctttgctgctgcggggctggcccggctctggacctaccttcgcactgtgaatgtgaagatgagcctctttcacagactggattccgtcattgctttcactgctctttcgcctgctttagctagatttttgggtctgtgaaagttgggtgtgcaatgggagggactgaagcttcttttttccctaattgttacctaattggaactcgcccagagggaacgggtggagaatttgagagcggtcgctgcagttagctgagtttctttttaattccagggtcctctgctataaataactgttttttttttttttttttcagattgtaaatatgtaacaaatgcatagggtcaaatttatgaaaaccaaaatacgtggggcaaaaacaccccacaaatgatcatttccacctgcttttacttcccttggagggattgtgtgatttattatgcgattgttttaaatgcagtttttcattcattcgagtttctcgaagctaggttaaacaatttctttttttttctttttttttttttttttttttttttttctttttttggagacagggcctcactctgtttcccaggctggaatgcagtgctgcaatcgctattcactgcagcctcgacctcccaggcttaggtgatcctcccacctcagcctcctgagtagctgggactacaggtgggtgccaccgtgcccagctaattttttgtatttccatagagacggggtctccctgtgttgcccaggctggtctcaaaacgtctgggctcaagcaatccccctgtcttgggctctcaaagcacaggggttacagggatgagccaccgcgccgggcctgaagttaactgattacaatgtctgagaaagaactggagcgtgtagttagttgagcctcccgttggccaggcacagccaccttggtaagtgcatgtgtgtgtccttgttgcccttctgatcctgagctccaaggaacaaggctgtcttgggagtgcggtggttctagtctcgtgatgggtgagtggcgccgtctgaccgaggtcaccctggcgaatgctgtggctgctggggagctgggacagagaagagaaagccgctgagggtccctctgtggaccctgaagggagagggaccgatatgtgaacatggcagctgttttctccagagccctgtttactgacggccgaacagtgtgaatcctgagaaggtttggatttgggtctgaactgggctcgtctggccatagaagaacatgagctggtggcgtcctcaggaaatcagggtgtgaggcaactggacgtggatggctccgggtccccccggccactgtcctgaagccgccggaggctgaggacgcatgggagtgagcgtctcttccctgtccggccacaccctctgtgactggtgactcatggcatggccctgggcagcatttaggtttgaggtctgtagatggctccagtatactggcttctattgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctccgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcgtgactgattcacagcctggctgcgcttggtcttgagaattttatgttttgctgggcagggtctcccccgtattgaagcttcccttcccttttttggagactgaaggaaggaaaagaggagtgatagggaagaggggagagaggatttgcagcattgtggctgtccccacagatttcaatgtggagttaagctgccgagacccccacctgccctcctgtgtgcctcaggcccctcctggtcccaggtcacccacaccgtctggcttccagcgagcgcttctcggagaaacagccggctccccacagccagtcttggtcagtcctgagctcgggtattccacagtaaagtgagcgacatcacctgtctgaaaagcataaggagactcccacgtggcggtgctgaggggccacatcctgggcaccaggccagccagtgccccgacatgagtgttgctggctgggaagcagctggcatttggattgaagtcctgcaaaaactgccatggccagagcctgccaggcagagcctgcacagagcggcccaagagctgggcacgtgctgggcctgggtggaggtggaggctgtgccatggggtgcgggggaccctgctcacagctcaccttgtggtcacccagcactgaccccgttcacagctcgccttgtggtcacccagcactgacccacccgccccaccctcctatccaccgtgctgtgaactcacctgccacgggtctacacccactgtccgaagccctcggcccacacgggctccaggccttgggatgctttgcgttgcaccagggctgcagagcccagatcgctcactgtccgactctcccagggaggtgtgggcgccgccctgtgtcccaccagtagcatttctgcagcagatgtggggatattcacagtaagacggacacgtccaagaccataaatagttggttttgccaccacgtggatgtcaaaaacaccttgctgtgtggggccacttggaggtgggaacagtgggcgtgtggacctgtcctgctgtgactttggttaacaccctgaggtggagtctgaaaaaccccggtgtacacgggctcaagaaccgctcccctttctgataccggagcgcatttcccagtggaaccccagagcagcaactcaggttcttgctcgcctgtgcggctttgtgtgcggcttgccgagggcagaaacggcagcttccgcccggagagcagagatgtggcgtggggctgagtgtggcccaccggtaatccagctgcatgcccccttccctgcctgcacctgggcgccgcctctgcacgatgaaggcgggcatttggtgtggtccttacagccgtgtgccccatcccactgatccttgcctgcctgcagaaagctacaggattggctttgcctttaagtgtcctgactgccctggcctcccttacctaccatgacacgccgagagctgagctgtcccactcgtgactaactcgccgttgcctgcaacctgctccgttgcctgcctcacaccaccccgctgtgctgcctgcaggcaccccctttcatgaggacctgggctgtgcccaggcggccccctgtgttgctggggcctgtgctgctctcgcacggcctccagagcctccctcggccccttgacccgcatgaaccggcttcccctggtgactcagtcccctcccgtcccttcctggacctcagcacaggccctggggctggcaggtgagcacccggcacccccgctaaccgcttggccctgctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacgccctcctgggcaggcggtttcaccaacatgtgccttgggaggggtggattctgccagtcgtgggtgtggtgctgacacccacatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagccagctccggagtttgcagtgaaaactcccagtcctgctggagactccttagttcagcttagcacagaacctcggaagacagcagttctattccgggtacttccttcagagctgagttacagtgcagggaagggagcagaggagccatgaggtcggctgcagcttcctgtgagtccgagcctcagcctcccactcgagctgaggggcgtgtcctggccatctctctcctaggcttctccctgtgttccccagtgctgtggtggtcttgcagaggctggccctggctcattcccaggacttccttgggccccgcacttgacccctgttgggtgaatgccattagggtccggccatcgctggcttcactctcctttagcaccttgtagatgtccatgcacacttccaccctcgcgccccacacgcgacgcagccctaccctggccagcagctgtgctttgctgcgggttccatgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttctcagcagcaggatcgcctctgcgtccttgcagggggtggcgtctgctgggggcacatcccatcgtgcagggggaacggctgaggtcacaggctttgcctgacaagtgccactcacagctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcacacagtcgggggcgtggctcaggtgtcagggctgcgctgttccacagccccctggggcagcctggcgggaccagaactcagacacgcctgggcacaaatcagcctcttgggagagctgctttgcccgcagaattcttttgccattaagcggttgatgtcattctttgaatgagtgacagtaattccccacctcagggtgggctgcgggggagattcagttggaaaagtaacccatgaggttttgtgcctctgggggtcctgaggccccacccgtgcctgggattctctaagacaaaggagaagtcttaaagccttacagcgtcttaagtcttagatcacatttagagagacccggtacaggtggaacagtgcaaccctcagaattctgcactggcccttcaagaaggcagttgtgggctctttggacccttgacggggatctgtcctctgtcctcctaagcacaaagatgggaattcttcccattgcctgtttctctccccatctcggcttctacacaatgcaaagtggcccgctaactagagtccgtgttcagttttgaatacatcaaccaattattttgggaagaaaagaatctgccaaagaaactggaaatacagtttggaatcatttaatcaagcctgcatttattaatcaaagtgcacttttagatttcatccgaagtgctcaagtgaacatttcccaatgggtgttaaacttgggtgcacagactctcacgtggctcctagtctcaagtccacacccccacttcatgctcttactcttggctgagtcccatggaggcccattagggaatcctgcaggatcagccgttgaccaggacggacggacggctggctggggaataccatgcttatgtcattcagagacaagcatttcttgagcgcctgctgtgggggctcggccgggtgctgctgatggtgcactggtgtaagcccagcccacagttcctgtcctcatggaatttgcagcctagtgaggaagatcctcccaagtcaaataaccacaaggtaactgcagggagagacaccgggataatttctgtgaagagaggacatggggtggctccgagagcccctgacagagggaactttgtggtcctagaaaccaggtggtgttttcctgaggaaatgacattttcctctggatcagagctgaggaaggtgcctctgtgtgtcccgtggccgctgtgacactgaccacacacctggggctggaaaataatactctctcccacagctctggagcgcaggagccatgggctgaggccagaatgtttgctccaggagcgtccctcgtggcccgttcaggtgcccagagttgcgggccttgcacgccttgtacgccttgttccctggcgcctcctccttccatgtgggtgtgcagcatcccgctccagggccttcagcctctgcgcccctcatctgctgatgcaggtgatggcatttaaggcccacctgggtactcctaggattcacctttatcaccgcatgagggagcattcccaggttccagggattagggataggactgggattcctttgggggctgctctcccgcccaccactgtgccggaatgtgatgcacacagcggccagcatatccaaaggccccaggaggacctggggtggctggaacaggacctggtgccgggagcaggcggggccggggattcccgacaaaggcttgatgtgtacttgaagtgagcaaagggttttgaataaaccaagaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcaggtatgtgacggggctggcctcagggcccgtccccttgggatccactgggtgctgcggagtgaatcatcgtgtctagggtggtttgctttccaaggggcatggagatggagatgctacagaacatgccacgcttgatacacttcgcatcgcccaggtgcccctactgcgtgtcaggtgacggtgggtgtgcctggttgaggacaccttctagtctcatgtgtgaaacacaagcttgtttgtttgacatagtctgttgtgtagttaatgttgtctcacttatgtcaccaatgatttgagaacctccgctgacagtcaccacccacgtctgcgacaggctctgaaggttgctgcagcttcttttaaatcctgaggcccctgatgctgcgtctgcctctaaacggacacagacatgaccgtggtttctcggcatctgtggctcttttagggaagggtgtcgctgaccccgcggtctgcccctgcttggacgacacagcagaatccaggcctggaccctgcaacattcaaagttgctaaacttcatgcaagatgacaggccttggcagataaaatgcaacttgaacaattgtctttatttagagagggagtcttgctgtcacccaggctggagtgcagtggcgtggtctcggcttactgcaacctccaactcccaggttcaagcgattcacctgccttagcctcccaagtagctgggattacaggcacgtgccaccacgcccagctaattttgtatttttagtagagatgaggtttcaccatgttggtcaggctggtctcaaacttctgacctcgtgatctgcccacctcggcctcccaaagtgctgggattacaggcatgagccaccgcgcccagcaccattgtcttttaaaaagttaggatgttacttgtttctgagccaaatagatcaagtaaaaagggccttggcactaattatgtgacatgtgaatcacgaatttctttaccatgtcaaatatttgtggagtcattcactgcatcatgatgtttctgtcaacagtgggtcccataagattataatggagctgccccaaacaggtgcagttttttatcttttataaaaacatatctttttacatatatttttataatatatattttataaaaagatgttttttatcaaaaaatatgtatctcttactgtgcttttctacatctagacatgtttagatacacaattgcctgcagtattcaacagtcccagacattcaggtttgtagccaggaacaacaggtgtgcagcaggctctgcctcctgggtttgtgtgagttcactgtaggatgtttgcgcaaggcttaagtcacctagcaatgcatttctcaaggaacatatccccctgttacatgactcatgaccgtatttcagaaatctatccaaagatcctgcctcaccagcgctcagcatggcaagggcttaagagaaattatgacagatttttattttttgctttaatttttgagatggagtctcgctctgtcacccaggctggagtgtagtggcacaatctcggctcactgcaacttccgcctcctgggtttaagcaattctcctgcctcagcctcccaagtaggtgggactacaggcacctgccaccacgcctggctaattttttgtatttttagtagagacgggggtttcaccatgttggccaggctgctctcaaactcctgacctcaggcaatctatccgccttggcctcccaaagtgctgggactacaggcatgagccaccatgcctggcctcctactttgtgaaattctgccattgcgcccagtgacagatttgattagatgtaaaaacctccattttcttaggatgaatcattagagaattacctccctcttgtaatcctcctaacatgatctgaaatggggatgttcttactctaagaccatcttttccttaagaaatctgtgtatgaatgtgagtctacaaaattctttggtcagacactgctcatcaggccgtcacatgagattccatagaaaggccacaggtcactctttcctctgagagcaccgagaacatcgtcatgcaaataaacaaggagcaatagagccatgaatgatcactaggcaaagcacggaattaccattttcagagggaccctgttgactctggaaggtgttgctagtggccgccgtgagggctgctcaccgtgccctgtcctcagcgttcatcgctgcagacgtgtcctccctatctgggaggaggctccccaagacccaagccgcgagagctgcagcctccttggccacgctcactgccacacttggttggcacttcccagcctgcagtgcctggcacacagtaggtacttagtagaagtttattgtctgattaacaaaatactctcttccagtccaacgtggagcacctgacggagaaaatgaagaccaccatccagagaggccttgtgctcaggtgagagagagagaccaggggctgatcttaccctcaccgccacaccctggttcttagattctagtctgtgacttgggctggatgagtggtcatttctttgccgctagagtgcactacacacactgagcaggtgcagaagacagctgtggtgcattgctctaaaggcttgcctgcatttagacaactaatatttttgctttatagtctcttattctttgatatcttgcaatcatttccctaattagcacctgatgtttatgaagaaagaaggaaatacagtcatccctcttagcctcagggactgtgtcccaagactgcagtgggtgtctgaacctggggatagtacccgccccctgtatacacgaggttgcttccatctgataaccaaggtggctactgagtgactcgggcaggaggcacagacagcatggagatgcagggcacagggatgattgacgttctgggtgggacagcaagagagcacgagatttcatcacgctactcagaatggtgtgcaatttaaaacttacatatttatttctggaattttccatttaatatttgtgggcctcagttgaccactggaccatgggtaacaaactgcagaaagcaaaaccgtgaactggagggactggtgttgatgtagaatcaccatagggttgggggatgcgggagtccagcctcccagggccatctccccaagcagggagccacgtgcccactgcacgctaaacaaagtgactccttctcgctcgtttcagaaatgagagctgcagtgaaaactacaccaccgacttcatttaccagctgtattcagaagagggcaaaggcgtgtttgactgcaggaagaacgtgctgggtcacatgcagcaggtaggcccgagactgcatgaggggccacaaagcccctgtcatgtgacttttaaaagattagtgtcttattttagccattgtggggaaaaatgtataagtaaattccaagatgataaaaaacatctgaactttttgagacagagtcttgctctgttgcccaggctggagtgcagtggtacaagcttggctcactgcaacctccaccttccaggttcaagtgattctcctgcatcagcctcccgaggagatggcagtataggcacccaccaccacacccagctaatttttgtatttttagtagagatggggtttcaccacgttggccaggctggtctcaaactcctgacctcagatgattcacccacctcagcctcccaaagtggtgggaatacaggcctgagccactgtgcccagccaaaacatctgaacttttaagtgatgccaaacatcaccagctttaggattcttttgttggtgaggtttgagtaatggggattttaagggaactgtcagctttcatgaaaacagtgatacccccattacttggaaatgcttattcaaattaaacacttcatcaagttaaaaactggagcttccctaagatttaaaatggattatcagacatgtagtatacttgacaccccaagtcagaatgacctggaatgagctgcacacaggcacacacgtgttatgagctgagcctgggacacagggtccaggcctcctaacttgcacacactccttcctcaccacctcctattcttatacttttaagccagagcccatgaatcccctgcaatgatgatgaaatagtaggcatatgtgtgatcttcttaaagaatccacaacggttatcagattaaagctgtgacccatccccagctcagatgagttcatgaaatcctgatttaagattttaaaataatgaagattgttagttgacttgttcggtttattaaaatcctcatcttactgagcggggggaacacttgatactttttcttaacaggccaagttcaggctacgggaatcacaggttttgttctgttccaactataaggacctagaaataaaaacatgaattctgcaaaatagaaattgtcatttctatttaacagcaaagtgttactgtataactggtatttcatataactctaaccaccaacagggtggggcaccctctccatttgatagaaactttggaaccaaaatctctgccagagctatggagtggatcactgcaaaactcaaggaggcccggggcagaggtaaggggtctggggagggaggccacagcctcgtgatgcaggccgtcctgccttggtgaaaatgctgtcctatcggggagaagtagggtgctggttccttcttcagttcagtactgagctgcacgtgatgttttactcctgatctctgagtgttgctatttaaccaaccttggattcctgggataagatcagcttgggtatgacatgttctcttttatcactgctagatgcagtctgcagttcttttgtgcaggctttttgctctagagatcctgaacgttggccagcaatttcccctcacagtttaagtggggccttctattttttgaatgtttgctaggacaacctccttgtgactatccatcaaaacttccagttttgaggaagatctgactgctgaatgaattgttcatgtttgtagaactgcatgttcgtagaactgtgcatgttcttccttaaatcagttctgtaagttacatattctaagaaatctttaaactgaagtttcaagaaacatgacttttttataatactcttgttaatggctccaacatggctgttccccactcattcctgagtggctctttgtgccagcatctttctcacccccacccccctcagctttcttaatcagtcatagcagatgtgtgcttttattccggcaaaccactatcactgccagtgtccaacttagaaaaatgacagtctataaaaaccagtgatgtgaatagtttcaatgggtttgtctttttgaagaactgactttggctttgattctttctacagcgattttcttttgctaatttagctatggatgctttttgcctctcagtgtgtgtatgtgtgagcataaattagtgtcctgtaatttaagctaatttccctattccactatttagtgaaaaattctctccactgggaggaaaaaacaaaagctgctttccaggaagccctcggggcagtcccacaggagcagagctgcacgaggccaggtgctggccccactgcgcggctgttctcagtctcactgggcttccaggccgggttcagcatggttctgaggaatctcagttctcatctcgccccgtgattctgctcccccacctgcccatgttgacagggtgttattaatcttttttaaaatcttttataggaaaaaaatttaccaccgatgattccatttgtgtgctgggaataagcaaaagaaacgttatttttcaacctgtggcagagctgaagaagcaaacggattttgagtaagttggctgggttccctgaggcaataagaccccaatgtgagtacgggacaggggaatggccattgctgttgctgtcggcaactcattcaggggtttgaggaactggcttttctgaagctcagttaaaaaaatactaggtcttggctgggcgcggtggctcatgcctataatcccagcactgtgggaggccgagacaggtggatcacaaggtcaagagatcgagaccaacctggctcatatggtgaaaccccatctctactaaaaatacaaaaatgagccaggcatggtgatgcacacctgtagtcccagctactcaggaggctgaggcaggagaaatcgcttgaacccgggaggcagaggttgcagtgagctgagattgcaccactgtactcaagcctggcgacagagcgagactccaccactgggtcttcgggaataattttaaacaatggtttcatttgatcctgaaattggctttatcatctagttgattcagccgaccctacaaaccctgtgtttctggcaagaccgctcgctgtgctggccaggcggaggcatctcccgccagtgactgcaggcctcactgctgtctcctcttacctccacaggcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgcctatgactccaac

SEQ ID NO: 35754 - DNA, 7802 bp, Homo sapiens
ccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgcgggccgggccggagcccgggggcgggagcgacgggtttcgggggtggggtgggggcggggaggctagaatcccaacgggaggggcagggaggacggcgcgggtcggccctgcccagacccccgacctgcccgactttcctggaccccccgatggtctttggcccagcccccagccgatcgggcggcgctcctgcgccggtctccgggcgaggccccacccccggggcgctggccaggccccggctccaatgtcagcgctctcgcggggcgcgggagtcacaagctcggattcctgggcaggccaagctctccaagactgggctccacgttcccagctttgcaggcgtctccttgggacactggtggtcgaatctaggagtaatgaccaggagatactgagtagtgacgacaacaacgatgttaatgataataaacgggtctcagtctttataattttggtggtccgtgtttgttggccgtttactttttatcagtcaccgagtgttgtagtgttgttttaccgctctgcaaaacgggcttgtcattggggacctctgatcattttacagatgtggaaacctagggattgaggaactttgccacagtcacacacaagtaatggcagagctgggattcaaattcggttctgcctcgtgtgagcgtccacgatataaatattatgctgcctttttagtcaaaagtagaattaggacctaattcaaacatactgaatgtctattgggtacttggcgctttttgcatagtgagggagacattgaagtccactttttgtagaaaaggaaacacacattttttgatccgctcaagtgtttggctttgggcaagttaacctgcctacctgtctgtgcctccgttttctcaaatatcaaatgaaccggtcgcctgctggcttccgcctgtaatcccagcacttagggaggcagagggaagaggagcccttgagcctaggaattcgagatcatcctggcaacacagtgagaccccgttctctacaaaaaaaagaaacaaaaatcaataaataaaatgagaccaattaaacgtatttcataggaaacttaaaaggtatgacacatatacatttacagtagcactattggccaggcacggtggctcatgcctctaatcctgatgatttgggaggcagaggcaggaggattgcttgaggccaggagtttgagaccagccagtctaacatagggagactcttatctacaaaaaaaaattatttttaattagtctggagtggtggtgtgtacctttagtcctagctactcccaaggctggacaagagtaccagttgagcccaggagtttgaggctgcagtcagcgatgatcgtgccacatcaatccagcatgggcggcagcgagatcctgcctcttaaaattaaaaaatatcactattaactattagtcacttattgtccaaggtagagtgtagagtgggggactgtcccctttattctgttaattatactttatactacccgaaattacattttcttcacattagtgttctctcattgagagcagggacttacttgtgttgagtttgttctgtgctgtggcctctgtgtctaaaacagcacctggcacataatgggtgtttagtataagtaaatactgtgttgaatggcatgatgattgaatgaattcaaatctagcatgctttagatgctgagaaagcttaaaaaacccagcgtgcttgcctttctgccatcagggctggcagtttctctgtcctaaactagaagggaaaagagaatcttggggtctccagtgactgtctgtaccactccctctaggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaaggtgggtgacgtgtgctggctgggagggtgggtggacgagctggggagctggcaaagagcctgtgtgcccaggagagattagctgtgaacagggcggggccacagcggagcgggttgttgggtctgatagggttgctgatgccagctccctttttcttgctgttgcagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcagggtaaggcgggggcagcagtcccagcttgggccctgtcctcctagcacattccagcgtccacataagtggtcccacacacctggagggagggcaagccgccagaagccagggtccgatttctctctcttgaatttgcagctctgttccctcttcaggtagcagcgggcgagaggaagacgcggcctccacgctaggtgggtgggtggtccccagggcagaggtgactgggtgccccagccatcagctgggccttgtctgggtgcgggagggcctgggagctgccctttcctcttcctggtgacctaggctttgctgcttcctccacagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacagggaattcctgggagccccgagccggaacacggttctgtccaggagagccaggtatcggagcagccggccacggaagcaggtgggtgtgcacatgccgcatctgccctccaggtacctgactcacattacactccaccccgcagtgctcctaggagcccggcgtggtgtctgactgcaccccttcctactaccagcaggagagaaccccctggagttcctgcgggaccagccccagttccagaacatgcggcaggtgattcagcagaaccctgcgctgctgcccgccctgctccagcagctgggccaggagaaccctcagcttttacaggtgtggtcccaagggcagagggagctagggcagccaccatttcccttccctgtgggcaccagagtccataacacgtaggaatcgttctaggtccggaaagcaggactaagcacatgcttcccccacgcccctgtgcttcctgtgacctggtgacccccctggtttctcagtcttcccaaccaccttgtaaggtgtgggtgctgtcaacatcacctcccacagaagaagacaccggaaacttagagcagcctgtcattcccagggtcacgcagctggtagtgtgtgtgtctgcctcctgcctcggggtggggtcctgggctggggctctggcttcacatacagatggtgctgcgtaaatgtctgtaaggtggcatgacgtcacccaggacagctgtgccccagttggctctgggacaactctgctcagtgaggctccatcttgcccttgaaggttcacaggaagagtgggggagtggccccctgggtgcaagtaggttcctctgggttctcggtgaagtgcctaccggtcttggctcaggaccctgctgtctgacccttctcctctcacttctcagtcccttgccagctcctcctggtcggtcgtgttcttcatctgcactcagccctccctcatagtgtcctggggccttcagtctgtatgggaacccccaaatctatgtagccagcccaggcctctctgaatgccacactccatggctggcttaattaactctccatcaaagtgctccctagactagacgtctaagacttagaacagacctccccagtcctccccgatctctgcaaggattagcttggggttgcttcagccccaggccctggggatctgctggggtctaccccttgtcctgtctgctcttcccactcagcccctccctgcactccagctctctggtagcctcttcctgggcctctgccactgcatagtcccacagtccacttttcaaccatgaggcagatgactaaaaagcactttcttttctttttttttttgagaggaaatctcgctctgtcgcccaggctggagtgcaatggcgcaatcccggctcactgcaacctccgcctcccgggttcaagcgattcttttgcccccgcccgagtagctgggactacaggcgcccgccaccacgcctgactaattttttgtatttttagtagagatgggatttcaccctgttagccaggatggtctcaatctcctgacctaatgatctgcccgccttggcctcccaaagtgctgcaattacaggcatgagccatcacacctggctgactgaaaagcactttcttctttaatgtgaaaatgatcagatgcatacaatggtagagttatatcagagcttccagatacccaggtagggcacagtggctcatgcctgtaatcccagcactttgggaggctaaggcaggcagaccacttggtcaggagttttagaccagcctggccaacatggcaaaaactcgtctctactataaatacaaaaagtagctgagcatggcggcaggccactgtagtcccagctactcaggaggtggaggcaggagaatcgcttgaacccaggaggcagaaattacagtgaaccgagattgccccactgcactccagcctgggtgacagagtgagagtgtctcaaaaagaacagaaacaaaaatgaacaaatgaacttccagatacctaaatccaacacccagatgagttcactttttttggtttgggggctggtaggtgggaatagagacagggtctatgttgcccaggctggttttgaactcttgggcccaagcagtccctcctgccttgcctcccaaattgttgaggttacaggcgtgagccaccacacccggccaagttcacctttctaaaagatccacagaccacgtcttttcccatgtaactgtcaccaccgtggcttccccctgctctagaaaatgggtctgacttgggccttcctctctggtgtcattgtctgcctcctcccccttcccttgttcgctgttttttgttttttttgttgttgttgtttgtttgtttttgagatggagtttcgctcttgttgcccaggctggagtgcagtggcgtgatctcagctcaccgtaacctccgcctcctgggttcaagagattctcctgcctcagcccccagagtagctgggattacaggcatgtgccaccacgccctgctaattttatatttttagtagagatgggatttctccatgttggtcaggctgctctcaaactcctgacctcaagtgatctgcctgcctcagcctcccaaagtactgggattgcaggcatgaggcaccgtgcccagccccattcactctgttcctgcttctgtttctgagacttcccagatgcatccaccctgggcctttgcacttgctgtttgctttacctggaggaaaccctctgcatccgccatactgcaggcctctccaccagccctcatctgcagttccttcctagccagacacttgcagttgtctggttcatttattggctcactcacttattttttgagagtctcttgcccaggctggagtgcagtggcacagtctcggctccctgcaacctctgcctcctgtgttcaagtgattctcctaccttagccttcttgagtagatgggattacaggcacgtgccatcacacccagctaatttttgtattttagtagagacggagtttcaccatattggccaggctggtctcgaactccaggctggtctagaatcacctgaagtgattataggtgtgaaccactgcagccagcctatttatgtatttatttattcaagacagggtcttgctctgttgcccaggctggagttcagtggcttactgcagcctccgcctcctgggttcagtcttatgcctcagcctgccaagtagctgggattacaggcgtctgccaccacacctggctactttttgtattcttagtagagatgggggttcaccatgttggccaggctggactcgaactcctgacctcaagtgatccacctgcctctgcctcccaaagtgctgggattacaggtgtgagccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtaagaggcctggctgaggggtgactgcaggtgggcaggacccctaccctctcctgctcacacttaacctatcttcccacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaact

SEQ ID NO: 35755 - DNA, 32618 bp, Homo sapiens
ccgagtagctgggactacaggcgcccgctaccgcgcccggctaattttttgtatttttaatagagacggggtttcaccgtgttagccaggatggtctcgatctcctgacctcgtgatccgcccgccttggcctcccagagtgctgggatgacaggcgtgagcctctgagagcaaattttacccagttcctctctatcctcccgatgactctgaaatcaaactcagcaagtcatccgagcccccacggcgcagcggccctaggctggcatgggcgatgcggagctactccgccctcaggaagcaggcgaggtgcccagcgggagaatcacccacatcaccgtctaatctctgctgtgaagtggaagcgcgagaaggagggagcgtctcatgacggagggtgtgaagacgctaggctggacgaagcagaaaggcgggtgtcactggggacgttctgagggtaagccgatggcggctatcgcggaggagaccctggcgaggtggggccccgcgcggggcaagggggatggggtgccacagagggctagttgcaagaggacgcgtgacggctgcagctctgcggagaccgggcctcgacggccaaggagtggcaggtcggcggaggcgggggccaggcccggaggcagagcgagacaggagagcaggcaaggcgggggccaccgtgagtgggggccgcgaggcgggggctggggcgcggggaggtgctaggtcggcctcggctcccgcgccgcaccccaggcccgccaggaggcgccgctgccccgcgaagccgttccggcctctcccggccaccgaaatcccgcgctccggcctagagaggccccggaagaggcggtgcagcgcaccccgaggccgcttccggcttcggctctgcaggagaggccagaatcgggggaggacgccttgggcggggcgtgggtgagagaacctgggggaggtgaagaactaggaggttgcactgggagtggacaagggggaaaataagaattagggaggggctgcggtgggcagggccaagggcaggtagcaccctgcaaggttgcaccctgcgcagctctcggtccactgctgagcctcctggctttttacctcgcaaaatgccgtcctggtgaggtccctggggagcccaccgctggccaagacccaggacagggcaaggaaggcttcctagaggtagagaggtgcacaaaggcgggaaagcagatacggggacattgggagcccctttagaccgatctttaggtgtctgagccacgcccatttggagggaaggctgaatggggaccagcccgcccaaacctgctggaggaaacaaaaactcactcccgttataattgctccccgccccctcaccagctctcttctccccggagacgggacagccctgtctccacaggcttcactccatttccctcgaatggtgcccacctcctatcctcccatctctcttatcctcaggttctactactcatagcaaccagaaggaactttaaaaatcagatcatgttggccgggcacggtgcacggtagctcacgcctgtaatcctagcactctgggaggccgaggtgggcggatcacctgaggccaggagtttgagaccagcctggccaacatggcaaaaccccgtctctaccaaaaatacaaaaaaattagctgggcgtgggggcgcgccttgtaatcccagctactcagaggctgaggcaggggaatcgcttgagcctgggagacaggctgcagtgagccaagatcgcgccactgcactcaagcctgggtgacagagcaagactccgtctccaaaaaaaaaaaaaaaaaaaattcagatgatgtcattctgccttcaacaccctccagttgtttccttcatacttggaatgcaatttaaactttcttgccccatggccgggatgatctggcccctgctgacccctgccccctggtactagcccacagcctgtcctgttggcatggcatgccatgctggccctcacattagggcctttgcactggctgatagcttttcaaaagctttttctccaacagcctgaagtcactcctgacaaggcccacttccctaactctgtctgcttggccttgatcgcagtatttgctccatacggtacaggcagagcgatgcttgtgcgtccagaactcagtgaccagcttccctcccgcaacaggtccctcctcccctattactcccttgctcctagtcacaatctacaggaagcccctgagcccagctggcaaggtgcaccttgcttggctgtttgctgttgcatcaccttcattagggctgtttttgctccttcattaaattaaattccaggaagcagtgctaatgacagccctaacgagtcacgggagaggctaccagccccagcctttggaaagcatggcaaggaggactaggcaataacatgaacaaagcagtagctcctgggaatagaattgattatcatttcccaggccccccaaggaccctgggcttcccaggggaggtggcctttggagactgcctatgcaacaggcacagtggcaggttgtaccatgaactcttcaaggacaaagaaaaggagggaggttaagtttaggccttggccccaaagccctgagagctcctgagttccctgcagggcttgggtagctcctccccagtcatacaggaacaccctgaatgccagaaccagttgggtttgtagggctaggtgtggatcactggcttggagatgttggtgcccctacctcagcatcccctggagactttggaaccccctgtgtggcttgttcctccatgatgcctcatggcagtcccctctcacaccagtcttctcttgctctcgctattctggcccggctggactcctctctggtttgggagcatccagctccttcccaacccagggcccttgcacttgctgctgcctctgtcgtcactctcttctggcttgttacaagactggtccttccacatgattcaaagatcccctcctcagactatcttctcctgcacatacctcccagtggctctagtgtcaccctgttgatttcctctgaaatggtgaagttcatttccctgtttgtttggtgtgtgttcctcaaggacagggcccagctgcctcttttaccatagggttctcagcacattggcaggcaatatgttcagggaacagtggttgaacagatgaccccttcctctggatcctcccgcactgccccccagccgccacccctgtgtcaggttgggcccccttgcctaatccagaagcttatggggaaggggtgctggggcctgaattctccaggtcaaagccaatgatctgtgaagagggtggatgaccagaaagggggactttgggatccaggacccccaggcttttgagttttcctcctggacgaagagaggcctgggaagaggggtctgcaagggagcagggagggagggcaggatggctgactccagtttcagaacttccactgggctaagaagcaggaaggggaaagcgcaggagttgaaccaggaagtagaacctgccccagggcagtaaggcgggagcaagctgtagccacgaggtctacaagcagtagctgcaaggctgtgattgagttggtcacaggtccttggccagggactccctgtcatctgggagccgtggaggtagggtggtcaggatcctgaactctgggcatccctgtggggtcctacctagtcctggactctgggcagggacaggcacacccaccccgaaactgcctttggggaagtgctagcagcttccccttcctagagcctgcaggcaagcatgtcacagcccactgagagggtcttcattcctcaacctgctcagggctactgctcgataggaactcaggccaagctggacctgctgtgctgcctgtggtgagccccaagactattctggcagtaggggtgaaccagcagctgccacttctccattccagctgaggggccaccctcaactctgctgatgtcattccattgtcctttatggtctagtccaagcggtgctgggcctggtgggcatggggtcaagtcatgcctcctctggtgctcgtgaggccctggctaggcagctgccctctgcccccaaaatgaactctcctgaaaggactcctggattcctgagtatgaagaaactgagatgcccacgatgtacctcactgatgactgtgactggctcctggcccactctggacctcagctgactcagctgcaaagcaaggggtttgtttcttcagctctcagccttaattttctcgctagcccttccccagacccctgcctctcagacctaccaccctacctttgcatgtactcttccatcttcttgcaatattcttccgcactgttcttctccctctagcactccctgcatcacctcctcaaagaaagcttcctgaccttcccaggcactattggtttctcttttctctgcgtatacaactacatgaatatttccagaggggcagcagctcccagctccaggatgaagagattgattgatggattgattgattgattttgagacagagtctacctctgttgccgggctggagggcaatggtgcgatctcagctcactgcaacctctgcctcttgggttcaagcgattgtcctgcctcagcctcgcaagtagccgggattacaggcatgcgctgccacgcccagctaatttttgtatttttagtagagatggggtttcaccatgttggccaggatagtcgatctcttgacctcatgatctgcccacctcagccttccaaagtgctgggattacaggctcgagccaccgcacccggccttattcatttaagttgatacatatttacctgccaccctgcaaggggcctggaattagggatatgagtgggagagacccacgaccagaatagtgggatctggctggggaaggggaagcccgaggacaatgggactcagagaagcccagctcacagccagggaatgaaaggtggggaggagggattaatttaacagggtagggggatgggagggaagatcgagggatggagagagcaaggcaagccagatggttggagtgccagtgtgttgcaagtggagggacatgaggtggacccttgagtggggacaatcataaagccttacagaaatcgctactattgggccaggcacagtggttcatgcctgtaatcccagcactttgggaggccaagacgggaggattgcctgagcccaggagtttgagaccagcctggacaacatggtgagacttcatctctattaaaaaaaaaaaaagggccgtgcacggtggctcacacctgcaatccagcactttgggaggccgaggcaggcagatcatctgaggtcaggagtttgagaccagcctggccaacatggcaaaaccccatctctactaaaaatacaaaaattagccgggtgtggtggcaggcgcctgtaatcccagctacttggggagctgaggcacaagaatcacttgaacccaggaggcggaggttgcagtgagccaagatcatgccactgcgctccagcttgggtgatagagtcagactcagtctcaaaaaaaaagaaatcactactataacacctcacccttattgagggctttctatgtgccatgcacattctgcatgttttacatgtttcctcctggagtcctgacctctgcctgtgctttgggtatgtataaccgttaggcccattttactgataagaaaaccgaggtacagggagtttctggtacttgtccaaagtaacaagtagctggcaagtttgcaaactgctcctcagagtctttgcttccaactgccagcctacagcctccaactgctgcagagtccaaaccagtgtgtgtgggggcttcatctattctcagggcattggggaaccacagaaagtttccgagcaagggggtgatgtgatttctttcagtaggatgcccttggctgccatgtggaggataaattgtagggaaacaggagagccaaggaagacgttagaatcctaggctgggagatagtggggacagagaacaaatacagattggaggggaaattgaggtagggaagaggctgatggcatataggggtaggggagggggtcattgctgtggctggtggggggatcatgaagtggtggagagcctgggaacaggggccagtgggatgggatgtacccagttctggacagtgtggatttgaggtgcctgggtgtctcggggaggcttcagagcagtggtggacatggggctggcaatcaaagaagtcaggctggagaggaccttgtggggttctgagcccccagagtgggaggtgtatgagtggagtggcaagcagaggcctggccatagccctggggaccccatggagatggagaaggagcagctagcagggtggaagcaagggttgctggactccctgggaagagcataggactggaaaggagcagctgactggcgggaagggtgccataaccacaggacctggcctggggctggggaaggccatgccttccagtagccccatcttgccctgcctccatagattggggtctgtgttgcgcccacctactgagagctgggcctccaaggggctgacaggttctccctgttgcctggcaactgtgagagctgttggctgttgctaggagcaggctagagaggccagaggagcgaggatcagctctcaagcctggggcagggtgacaggtagagggaaggggagggtcccaccttggaagccagtttgtagtctgtgcgtggacagattgtattcttggccatgtgtacccatttttgtagagtgtgttctgtggatctgaggcatgttggagactgacctatgtgtgggtgtctacagcatatctgtggccctggtggacattatgtgtcctcaacatgttgcatgcccatggcagggcctgcttgagcttcagagcagtggtggacatgggacatcatatcctatgtctcaggacaggaggggggcctgagggagtcattggaggacttccaggccaatgacccctcaacaagagagacattcagatagggatatgcagacactccagggagaacagccagcctggggattgggagctggaacaaaatgtgtaacaaggttctttttttttttttttttttttgagacggagtcctgctctgttgcccagggtagagtgcagtggtgtgatctcagctcactgcaatctccagttcccaggttcaagtgattctcctgtttcagcctcctgagtaaccaggattacaggcacgtgccaccacgcccagctgattttttttttttttttttttttgagacggagtcttgctctgtcacccagggtggagtgcagagacagaatctcagctcactgcaagctccgcctcctgggttcacaccattctcctgcctcagcctcctgagtagctggtactacaggcgcccgccaccacgccggctaattttttgtatttttagtacaaaatacaccgtgttagccaggatggtctccatctcctgacctcgtgatctgccgcctcggcctcccagtactgggattacaggcgtgagccaccgtgcccggtctttttttttttttttgaaatggagtttcactcttgcccaggctagagtgcaatggcatgatctcagctcactgcaacctccgcctcctgggttcaagtgattctcctgcctcagtctcccaagtagctgggattacatgtgcccaccaccacaccccgctaattttttgtattttagtagagacagggtttctccatgttggtcaggctggtctcgaactcctgacctcaagagatctgcctgcttcagcctcccagagttgctgggattataggcatgagcaaccatgcccagccaaaatgtgtaccaaggttctaaggaaggggtttatgctaaacaccgggctgttggtggcaagcaccctgtcttgcttcaggggccttccctttgggctggggcctcctagcctcatggcactggggtcacacaaaatgccttcgtggttaatttttggcagacccttcaaatgtccaatcgagggtggggctctgggctgctcctggagcacaggatcagaaagacttgaaatgttcagctagaaacactgctgcttccaccccacctttgcctggccatagggttgcagccattgcccagtggggacaggccacaggagggtgggatgtgggatcatggccacctccagacgtggacaggccatggaagagacaggtcataagatcatggccacttttgtttctagaagtccagtggcaacttcttcctctttcttccctcccaaccccctcaccctgcctgcccgccctcctctcttcctccctctccaccctctcatcctctctccctttctcccttgggtcctgattgcctggtcccagattggagtccaggatggctgcctgccgaagaatgcctcccggtagattggggaaggatggatatgagaagccacccagctaaaggagacagcctaggcaaaggtgtaaagatggaaaccaatttttttttttttttttgagacggagtcttgctctgtcgcccaagctggagtgcaatgaatggcgcgatctcggctcactgcaacctccgccacccgggttgaagcagttctcccgcctcagcctcctgagcaggtgggattacaggcgcccacgaccacgcccgggtaatttttgtatttttagtagagatggggtttcaccatgttggccaggctggtctagaactcctgacctcaagtgatctgcccgcctcggcctcctaaagtgctgggattactggcgtgagccactgcgcccggcctttttttttcctttttcgactagctgcaacccagagggagaaggcggtaaacccgccttaagactgagaaaaccgcagtccagaaaggctcccgagttcgtagatcccaaaacaagtttactggactcattaactttaacaaatgacaaagacacgcctcctccacctaactcgcccaactcgcagaagctcagagggctggttcctgctctgccctcgagggcaccggatccccaccctcgggttaacagatccgccctcccggctgtccagcaacagagctcccggcgctccgcacccaatcacagcccggtcccgcctgcagcccgcccagtgccgggtcccggggtttggaaccacccctattgccttttctccgcgtggccccgcctgcagcccaggcccgagcctgggctgcgcctaacttcccccttcgctccgccctcgagccaatcaacagcctctaatctcctctggccccgcctgcaagcccgccccggcccagtcacaggcttggttcgcccaggccccacccccggcccgccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgaggccgcgtcccgcactgggatccttgattcccagctcgaatccccagacaaggactttgacctcccagactagggcttcaaactcccagacccgggctgtctgggaccccacacctgggccaggaccagggttgaaaactctagattggactagacctttgatcctgcccagactctagaccagacccctgtctcatcccagaccccagacctccaaatccagtcaacagtgccccaacacccgcggtccagtgccctgcttggccatccccccttgctaactagcttcacagaacttcagagccccgccatccttccctacactttgcccaaacccccaggatgcccgccacttgttccccaaccctcaggctccgcttgttttcctcacctgcgccttttattcctattgggcatgagcatcccgcggggcccctgccaggccccccacccactccctccttctccttctgtgccccatccctagtctggaatctgtatcctccacctgtgcactctgacccaaggaacctctcgagtgggaaactgctcttgagccccatctccagctggaaccccttcagcgagccctgctccctgcttcctgccctccagatccttctctgcaggcatcactcccgaaaccctctgctgatcctcccctaagtcctcttacactctggccttccccagatccctccacccttcctgcaccaagtgggctgggctaggaggcgggagccctgggttggagagggcctaggctgccttatgcagaacccccacggggctggattgaggctccactggtcacgctgggggagggggccaggcctcaggcttcccaaggaggctctatgttttccagtttcgaaggccagtctgggaagtaggagagagagtggaggagttagggttgtggccgcctccaaggccagaaaagatggtggctgctagaggagtggggggaagtggaagtggtgagacagccgacatattgctgcccctgcgggtgagcccaggagatctgctagtaggtgctgggctgcccacaccccttctgggctgcaaggcctgggatgtagcctctgagagttggggggcttgttggatcttgggaccctgtgaagggggatggtggactagctgaatgaggagttgaggggccagctgggggtgggccagggtgcctctgagcatcccagctggccttttgcaaagacggtgggcctactggctgtccccatccagcttcccactggaagtaggtgtggtgcccagtggcagtctaattttgatttgggggttttagagttggggggagggaggcccttgcaacagcgcagcaccgttgtaggctgagaagtgcatgggggggtgtggcccctcgacttcagaactgtcatagggctcccaggctgtgaaaagcagggcttttcgtgctggacctgtggccgaggaacagcatgtatgtccattatgggccatctgttgactgtccctgcggacccggcctccggggcacagccttggaggtttcaaaatggcatccgcttcgctgctgcctcagggaggaagagaaggggcgggaaggggcggcggcccagcctcctgggctgctttgcgttgggcgcttgcctcttcctgtctctgctgtgagtgcggcagcggcagtgagtgggtgtcgacgcggcggaatgcccgtcgctgctgctgctgctgcccgacgggcctggggagggcacttccggtaccgctgcctcccagtgcccagccaggagtctctagacagcctctccccaggcgattgcagttactgtggtggccgaggaaatgcaagactggaccatagagctgggggaacgcagggcttctggctagttttgtgtcccgacaccagaagggtcccccatcccaccaggcctgctccttggagcccagctcaccttttgggctaaggcaagtgagacctggtaactcctcccacactgggctggcagcagccaggggtgcagggtctggcttagcactttctagcctgggaagttcaccctggggtcctggccttctggcctttgcttactctgtgaaatgggcttcctgggttttggccaaaggagtgccccaggtcaggatggggagggagaacaagagcctcctggtggttcttgttggggatgtaggttgggagtaaagaccctgcagtgtgctgcaaagggctctgaccaagctctgcttgatattgatgacccagtctgccatggctgcctggggagggatcctggcttgagccatgcctttcccatccaggtgcaaggtggtgatgggagcccagctgtggtaagttcagagttctgggcgcctgtcccatgtagcgggagactttgtccaggcaacgggactcaggttgggcaactgccagccttccctcccagccagaaccacgcctgctgccccgcccgcacaccgcctccctcccatcttgggtagccctgccagcaggcaggcacagtccttgtcaccagggcagaggctgatgtggtacacacaggcaagagagtatttcctggcaactttgtagggggagcagataccagtcctattctagggatgctccccactcctacccagctcaacgtgactgatcagctaggcccaggtggaatctgggaccctggtctgggctcttaagggaaaggaagccagagtgtatgtgaggggggagagtctctgatttgggatgggcctgtgtggacagcttcacaaaaaaaggagacagtgtccaccattggctccataaaggcttcagaatgtaaacagagcagttctctcttgcccctggaactttgtgtgtgttgttccctacttgattgttctttaaaactttactctgggatcacctcccaggatccttcctggacatcctccctcgaccaaggctggtgaaacatctggctcccagcgctgttgcttcccccctcagatgcctggagactgcagggcagggctaagtcctcttcatttctgtgcccagcatggagcctggcatctactgggtgcttctcatctgtttgttgaatgaaggaagtatcctctgaacctgattttgggtagatggtggagtaaactgagcggcagtttgcatactgtgggcaggtggcaagggcccacaggcccaccacaggattggtgaccagcattgaggggacactgagaaaagttcttcaggctgtttcttcccagccccgccacaggctatgctggcacctgagagagttcttatcccaccctgtgcggaactcctgctgagcagagtggctttgtattcttccttccaactcaggctgttggtgcactgctagagggctgctgtctctgacactgcagtagccacagtcgagcttgagctggctggtccagcaggggctgctccgcagccctggggctcagaccagagcaatgctgtgagagtcctggtactggccagtgcagagactgcacatagcaagggctcaatgaagtttaccaaaagaaaagaaagggggttttgtggcctctgtcctgtctgtgtctcttgcaaagggctggcatactatagatgcctaatgagggtatatggacagaatgaagtgattgaacatgtccatgaacagggcagagctcctgggagaggagtaagtataatcctggggcagccactggagcctggtctagctagagacagataggaagggttagcttgggattctggctggctgggtagtgagttagactctaatggtgcctgtgaaggggggcttcctggaggagggggtctgctgggcagctgtgaaggatgaataccatttgccagggccaggcactgggggtcagagggaccaactcgacaagaacactgcagcaggaagacttggcctgtattcccaagagcttgggtgggtgtttcctggcctggtggggaaagggccaccctccctggaccagcccatggggtcatccagacctgagttcgaatcccagttccacctatggcactggctgagagactcagcatcaggtgaagccctggcaggagtcctgctctccactcataacctgggggcagagtgcctccctgcagccacaggttatggggacagtctaccaaagcttggaggtatgaaaaatgggtgagggaggccaggcgcggtggctcacacctataatcccagcactttgggaggttgaggcaggcagatcacctgaggtcaggagttcaagaccagcctggccaacatggtgaaaccccgtctctactaaaaatacaaaaaaattagccaggtatggtggtatgtgcctgtaatcccagctattcgggaggctgaggcacgagaatcgcttgaacctgggaagtgaaggttacagtggaccgagatggtgccactgcactccagcctgggggacagagcaagactctgtctcaaaaaaaaaaaaaaaaaagaaaaaaaaagaaaatggatgagggacccactgctgagagtttggtgggaaggagtctcccatcctagaggctgcctggcctgggtttggagccctagggaaccccctcccctgccctcaggcagctgttcacagcaagtggggagcccaaggcgtgcagatagttggtgccagcaggagtgacagactgccctggggaccttaggcccaacctctgggggtctaggtttggagatgtggtagggccctgggtgccaggtgggccagtacccacccaggctggcctccagcccctacactctaccccagccctctccttcactgctggagctcattagcacttgaatggggggcggggcggcttgggcctctgagtctcttcttcccacccctcccccaggcttgtcggggctttgtctgcaggagcaggcagggatagagctcccacactaaggagtgaacaggggtccaagctatagctgaccccctctgcctgcatcctgcccagttctgctaggctcagcccctgcctctcacgccagtgtcagtgcagccaacatgaggtcatacctctagggtaggagtgagactaggtcctttaagggatacctctgagctgagagactaggtgaatcagggcagctggagctcagctgggggcatcccaggcgggttggggagaggaaccccagacagagggcagagcaggtgtgaggacagagagaatgagccgcgctgctgtggcaggaggtggaagtcaaaccagttgcgggacacaggcttccatgtcagaagccctgaggcagcatcacaccacccactatgtgtcagagcctaggctgctggatggggcctggggatggtccgggacccctttggccctgggcagcttgtcagcggttggccctgggtggcctgagaggtagggtcactgagtgccatcactgatgtcccaggcccttgaacatcagtttgcctggcaagtggcagcaggtagtgctgagggtggggtgtggtcaggtcccagcaaggtccctaggcctccagcactgcagggggtggggcagtaggtgcacttggggctacttgggccacaggcagacacacaggtcctgtatactctgccgttgatcttagttcttggtccctggctgtgactctctcagtctgtctctaaaagccacccattcacttggcgggaacaggatggaggaagctttgtccacccaagctcttagccactgaggaaccagggactccccccaccccacccacagcagaggaggagactgtcaccccagagcctgagtgctgcctcccctacatcccgttgtgctgtggggggaggcaggaccgggcagatgggggcaaggtacaggccagggagtagtctcatcttcccagcatctcaggccaggaatcccagcctaggagttgagcgaggaggggaaggggtcagcaggttctggccaggccactgctgatacaccctgcctaagagtgctctgcaaggtgctttggggaaggcaaaggattgggccctttgatggtgtccctggtacctgatgctctcaggcagcccttccctcagctacaggtgcagggtggaaccccgtctgcccagccccacccagcccttctagcttgaagctctcgttcttactaaaccccaaccccaccctcaccctgatgttacttcttggggctgtggctgctcttggtggctggggaggaagaatctttctggaataaccaaacatttgctgggctggttcttctgtgccggcctctgtgcacatttacaaggcttgaaaggcagcaccacaccagtctgagcaaaggcctaaaggtggggtcatctcagccttgttggggagaagatatccttatggcttggaggaatctgggggctccaaggctgctgacagcctcaggatatgcaaaggaggtgatggcagcacctactgtgtgtgcccccggcgggaggaggaggtaatgaagtctgcacgacatggcagggcagggctgggcctctcggggaagtggtgtccacaccagaggaaaaggaggaagcagctgggggaggaggagcccaaaagaggaagaggccagagggctgcctggtgctagggtgggggtgagagcccaagggccccccagggctttgccaactggaagggtctaggaggtgaacacctgcccaggcttatctttgcactcctgtgggccattctagtggcggtcactgagttggagccagtccaggtagctctgtaccttgtcccaccccagcaaccatcgggcccaagatcccagagaaggtggtgccttcgagaaggattccaggccccttctttggccacaggaagttgtggctgggagaaggacgctggcgggagggctagcaggaaggcagagggctgctcttagattcccgagcggccattgctctccaaagccggaaggccagccacaggctgagatgaatgcctggaaatgcagcaacagccccgagatgagctcactctgggtttcccctgctggggggcggacaaaggatccctggcctcagcctaaggattctcccctaccagcacccactcactgggtctagggctgcattcactgggcctgtttcccctcaggtgataaccacagctgtctctgattgagccttgactgttgtgtggagctgaattcttcattatcttgtcatatttaatcctgtgaggctgggactgatattacacccatttcactgatggacaaactgaagctcagggactttatgcacttaaacagggaacagagatgtcaggacatgacccatgtagtgattaagcgcctgcctccaactgccatggccctttgggagtctgtgctggctggaagtaacggatcaggcaggacagcaggcagacggtgtgggtgcgtgtgtgttctgcctgtgcctatgggccctggctttcgggcctcaattcttcttttaggaggcggaaagggagctgtctgtcctggaaggtgggacccaagactctgtgtatgaagctttctacagccatgtggtcatgggggaccccctccactcctttttttttttttttttttttgagatggagtctcactctgtcacccaggctggagtgcagtggcatgatctcggctcactgcaacctccgcctcctgggttcaagcgattctcctgcctcagcctcctgagtagctgtgactacaggtacgtgccaccacgcccaactaatttttgtatttttaatagagacggggtttcaccatgttggtcaggctggtctcgaactcctgacctcaagtgattcgcctgcctcggcctcccagagtgctgggattacaggtgtgagccactgcgcccggctgcagctgcaccttttgacttcccactttttctcctagtccgtatcctctcacagtgatgctcaagttatagctggcaatttaggacttcattctttccctaatattatgcttgttctcccataagccccagtcttagactgagaccaagcctggggaaggctcagaagctattgaagtccatggtgagggcctctgagactgggaattgtccagaggagtgaaatgaaagcatgttccttagggctgcactgtgagcacaggctcagtgctgggtgcacgtacggtactgtgtggtggtagaatgtggccatggtgttggctgatgactgcatgatagttgttgaggctggttcctcttgctccttggcctccgaatctcagtgctgtggcctagtggggccttgccctctcttgtaggggttcctaggggttctgctgtgttgccaggccaggccgtaagggactgagggggctgaggaaggcttaggagagccagagcagaagcgtccaagcctctctgggccatgaagccatgcacagagcagagacccgtgcatcctcatggccacccaagactgtgggtcccagagggtccagttcctcaccatgagacctcagactgtcctcttccctctctgtatccagcactagaatctgtgatgctgtgattttttttttttttttctgagactgagtttcgctcttgttgcccaggctagagtgcagtgatgcaatctcggctcaccacaacctccgcctcccaggtttaagtgattctcctgcctcagcctccagagtagctgggattacaggcatgtgccaccatgcccggctaattttgtatttttagtagagacagggtttctccatgttggtcaggctggtctcgaactcctgacctcaggtgatccgcccacctcagcctcccaaagtgctgggaatacaggcgtgagccaccccgccccgccagtgccgtgattcttagcatggtctcctggcctgtggacacaaggacagctgctggcttgggttgggccctgaggcagtttggggtgactttgaagaggctactcagggcaggccttgggtttggcaccctccctcaaggggtacatttcatagatgaggcctaggctcccgttatctttcccagagtccaccgccatgaatcagaagggaaaagaggtcattcaggtgccttgggaacagcggagggatgcctgaaatgaagaggcctccagggagacggtgccaaatggcccagctccgcgtgatccgcgtcttgtccagcacctcctggctcctgcacaggcggtacctggggcctgaggcgccagcgatgaacaggtctggggcctcctttatatcaggccagccttcctcacccggtgcctgagtttccctctgtgcagtggaaagggccccactgagggagacacaccttgccccagaaagactttcccatgtgtgggcaggacctgaggcctcagtttccctaacacagagatctctgacttggcagtaggaagccaggccctgcttggtagtgctcccctttgggcactgtgaacccctggaagccgctggaggcagccgagtgccagagactggcgggagggaggtgtggagtctgttggtctgttcaggcatccgttatagggccatgccacacacatgggtgggagtgttgccggtccctttcaagacctcgagtccctgcctcccagtgccggacccgtgctgagccttctcggagggaatgaggggggccggggagcagcacctggaggaaggaagagacgccaggggcggggctcagagggcctttgtctggcggggtctctgcccctccctcccgttgccatggtttctgtgtgtgccgagtctctgcaggctgggggcttcccagggacgggctggtgggtgggacaccttccccagtcgcccctggctgaggctgcttttctgaaacaaaacgctccccagtgctgcccagcccccacttccttccacagtgtctccggctgccgggcgccccctggtggtggcggggcatgggtccctaggactgcaggggacgtgggggtgcacgggatctgagaaccacaggctgagctggagatgtggcaccttcctgggataagagaaggaggtggtgtccgggctgcctttgtggtgggctcagggctacccccacctgccccaccatatcccactgggataggctggggagttgtggcagtgtgggcgggcctggtgttgtgggtttgagctgggccgctgcccaagtctaccctgtggtcccagccgctgctgcttctgagaatctctgccctcgggcctgccacgtcagctggctgctcttcctggccccacgtgttcccacggagcccaccagtatgggggttctctccagggaggtgtgcctggctttctgggtgtgtgcagccagtgagcaatgtcagcagtgaggctcctgggcaggaaggaggccccagctgtgtaggagtgccgggttatactgaagggaagtgacgacacagcggaaagccaacagaggagccagtagctctgactcctgtcccaggttatgctgagtcccagcagggaaccaccacagctctgaatcagcctgttagccgctgtccattgctcttcatctgctctttatctgaaaatcttcagaagctttccttcaaatgagatgaccacagcagtcttctctgcaggttgcaggaaatgagaggtttggggaaatctgtactctttcaaagggtagataaatagtgataacttttacctgaatgctcacatgtgccccacactgtgagaagagctttgcatttaatccttacccatctctcagaaggagacagcgttgtcccatttcacagatgaggtgccagagaaagggcaggaaaggagctgaagctcttgaggatctcaggaaggatcagagtggacatcagggctgtggcaagtctggacctccttctgggagaggatctgaaaatgggaggcaggctggctggctgcttgaggcttgacagctctgcccaggggaaactgaagccagaaaggatagtagcaagtcccagcctcccagcagatcaaagcctattaaggagttagagggtccaagatgaacagatgctgtgacttgaatgctggggcctggactaagcatcaagtgacaagacctgtgggcctgtctctcctgctgcaggggccctgctggtcttgttcacgcaggtggagtggtactgtctcccttctctcatcggttccctcctctggggctcagcactcccaaagtggaagcagatgttctagtgcagagcagctgccaccacccagcacatcactatgattactgcctacctgctgtgggccctaactgcgccacagggcaaaggctgcagaggtttcttccttggtgggaagaggtgtgactcagtgggaatgccaaggccaccccagggaacctctgcaggcctctctggtcttacccagctggggacagagcacttggtggggccctctgcgggcaggaggggctgattcatgccaccttctattgcctcagttcccctacccagcatctttgcagaaatctggactcaggctggacgcggtggctcacgcctgtaatcccagcactttgggaggccaaagcaggtggatcacttgaggtcaggagttcgagaccagcctggccaacatggtgaaaccctgtctctactaaaaatacaaaaattagccgggcgtggtggcacatgcctgtagtcccagctactggggaggctgaggcaggagaattgcttgaaccgggaggcagaggttgaaccgggaggcaaaggttgcagtgagccaagatcatgctattgcactccagcctgagcaacagagcgagactgtgtttcaaaaaaaaaatctggactcagccacccctctgagaggcaggtgcgaggggagctgggtgtgtgcaaaactcacagataagcctcttgccagcttatctggtagggggcatccctcaggtcctgatggaaagaggacccagccagagatggggagagtgaagctactaccccacagctgccagggcacttagcctgtgggctgcccgagagctcttcaccccacccattccacccagatgccatcctggggctccacccacctctgctcctgtcccccttctctgctggagctgctcctgggctgtgcccctgcctctgtcccgttgttccccctgcttcctgcctggctgccagcaccacacccttgtcctgccactcactacttcccgcctgagtcacagctgctggaaagacaaagagaccagcctgagtctagggataggggctccatgaccttgatttgcttacctgtcaagtggaactcttttttcagtgacccctgcttgggatagagaatgttctcttaacatttaagaggccttaggaggggaaaatgaaacttgaaggggacagggaagtgggccctccctggctggggcagggagcagatatcctggctcctagtgtgactggctctgtgctgcctacctcatgtctaccaggtctagctgctgctaggaaaatcagatgcaaagcaagtttgcaccctcgtccctgggcagggtcacgaagcggcccacatcacctactaagagtgggcaaaaggccagaccccctcttcactctcagtggccagatagggaaactgatgcctcaagtgggcaggagtcccgaagtcacacaagatggggaagctttcaccctagacctcaggtcccccatgccctgggtagcttccctgctgagtctgagctcgcctggctcgggactgcatggggacccatgacttcgcatccttggcctctgctcctgcagttccccccatcctggctgtgactggctcctggttcttcctcctgctctggaggagccagtggggaagacagtcaggtagccactgctgccctccctgccccagtgggtgctttgagccccagggggatgggccttaagtgttcaggcatcgctgtgaggctttcctgggacctttccccatgtcctcattggcaggtggaggagtgttggtatgcagatcctggctgcccctttgccatgcacagcccaatggggagggagtggtgctggtatatatcccggtacacaccccagtgaagatactgggcccggcccctgtagtgcccaggggctaaagcaatagaggggattgctgccccagccacagcgccccagccttcccagggcctgcacatttgtatgtccacaagattgtgcaaccatcactgctatctaattccagaacataatcaccaccctcaaaaataaacttcatacccaactagctgtcactccccatctccccagatcccctcccctcatcctggaaagcaggcctgggacagtcagaagctcagtgattgcaggcgcctgatggcatttgtgaggagggctcaggcctttcccctcagggtggtctctggcgtagggggctgaaggtgggcaggggccttggcaaggcctgccaccatgtcccaatgcctgctgccgcttgttgagcactgcagacatggcccagagtctgcctggggagctagggagtgaacccagtgccaggtggactgtgtggctccgctgcagtaccaggtacttaggacagctctaggagggactgcacggtgggcaagtgtgctccctgcagaggggactctaaccctgtgacctcagcctccctggacctcagttccttcactggttagattggggtgagaatggaacctacctcccaggattgctgtggagatggcagttggtgggtgtcattgatgtagagcagcatctggcacatggtgggcgctgttttcatatagctttgctgtcgatattgccgatgttattgttactgcttgtgttcgtttgtgtgttagcaccttcatcctctgaggttgttttgaccagccccaagggatgctgttgagcttggccagagtacccaagtttgacctctgcacagaccttactacccacccagctaagctgcacagaggaacaaacgtgccacagtgatcagaattgggacactgtgaatggggcatggggcacgtattcccggcaaagagaacagcatgagcagggccctggagatagctagaggtagtgcctggcagctgcaggtgtgactggcagtgatggagcaggagcacagggtctgggaaggacagcagggcccagctgggggccattcaacctggagctcaagacaagccagcagcaagggagcaaggtcaaggtgaggccctgcctccactccctctggcccccagccagggagttgggtggcccccctggtccttctttacacagactccctgggtaatacaggctcctgggctgcactcctcaagatctggctctgttgtctgggatgggacctgggagtctgctttttttttttttttttagaccaagtttcgctcttgttgcccaggctggagcgcaatggcacaatctcggctcactgcaacctccacctcccaggttcaagcgattcttctgcctcagcctcccgagccgctgggattacaggcacctgccaccacgcctggctagtttttgttatttttagaagagatggggtttcaacatgttggccaggctggtctcgaactcctgacctcaggtgatccacctgcctcagcctcccaaagtgctgggattacaggcatgagccaccactcccggcggaatctgcttttttaaacacctccccaaggcattgtcccgcagggtctcagccacattttgagaatggcagggtggaccaggcatcatgggttccctccaccctcttgcccttctgagtcctggctacatgatcttagatcaatactttatttttctgagcctcaatgtcctcatctgtagaatgggaacagaaacagtatctgctgtgactaatacaggagagaatgcagcaaatctcagtaccagctaaagagaaatatgggccagggctgtaccaggccagggaaaagcttgagtcagtatgggcgtgtgtgggtgtgggtgtgtgagatacgccgcaggtctcccagattcatgagtcagtacgcgtgtgtgttacactgtaggtctcctagattctagccttctagcctccatctgctcagggcagacctgagcgcagtgagcagagggcggggcattgggccatgtccagaaagctgaagtgtgacgctgtgctcctgcttaggcccctggttgctaaggctcagtgtggggagaagaagggctgctaccctgttggatggagtatgcagggcatcttcctgccagctctgcccagggcaccatattggcatgcaccagctgcacaggttggcgagcctatgtatgtgagaacagggtggctccttcatggctggccaagtctccagccaagaccccccaggacagtggggagccatggtgggcagcagagcttgtgggaggcaaaggcctgcagagagtctgccatggggcacaggtgctctaggttaccttgaccactgtggccctgccagctgcattcctggtagctcaactgcccaccaggcccagctgcctccatctcacggtgcagctggtgggaaggttagttctgcctcctgggctacaggtgtctgggcatttgttctgtgcctgtggagcccctctgggcctgccccctgaccacctgtgccctctgttccaggtgctggggagtcagggaagagcaccatcgtcaagcagatgaagtaagtgctgtattccagaggcagtgctcaaactccagcttcccctcttcaccctctgggcctgcactgcccccgactacaggcccagccagtcttagccaggcccagaatcttctgagaagcagaaggaccctcaggtcccagtgggtcaggggcagttttcccttctctgaagcaggtcccagtagccccaggcagccgtgggaactcccagtgcccaggggacactaaccttcctggtccctggctatcaggatcatccacgaggatggctactccgaggaggaatgccggcagtaccgggcggttgtctacagcaacaccatccagtccatcatggccattgtcaaagccatgggcaacctgcagatcgactttgccgacccctccagagcggtatgtgccctccgccccaccctctcccacctcccaaaaggtttcggggtggctggttgtggtggctcatgcctataaatcccagcactttgggacgccgaggcgggtggatcacctgaggtcaggaccagcctggccaacttggtgaaaccgcgtctctactaaaaatacaaaaattagccgagcatggtggcacgtgcctgtaatcccagctacttgggaggctgaagcaggagaattgcttgaacccgggaggcagaggatgcagtgagccaagatcgccccattgcactctagccttggtgacagagctagactccgtcacagaaaaaagtaaacaacaacaacaaaaaggttttagggcaagtctcatcctagggaatccaagaataccctagcctgggccccattccagaggtctccctgcctctggcagagtgggggtacattccttcaactgcctgaccacccgccactgtgcccaggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctagtgagtgctctgaggggctgggcagggcagggcaggggctgggggaggactaaaggctggaccggagggcctgagaacccccagaaggacactgctggtctttgcttatgaaaccgatgactgttaaccaaggccttcctgttttttggtttggggggtgggtgggtgtcacgttactgaaaggccaggaggaatgacaggcaggtggcttatacagtacatctcttccaggccagttgagtctgatctgtcttgacagtcttctaaagaacatttgcggccgggcgtggtggctcacgcctgtaatcccagcactttgggaggctgagacaggcgggtcgtgagatcaggagatcgagaccatcctggctaacacggtgaaaccccgtctctactaaaaatacaaaaaattagccgggcgtggtggagggcgcctgtagtcccagctactcaggaggctgaggcaggagaatggcgtgaacctgggaggtggagcttgcagtgagcggagattgcgccactgcactctagcttgggtgacagagcaagactcagaacatttgctgccacctgttctgtgccaggcttcaaggacacagtgatgagtggagcaaagtccccatgcagtgacaatttagggtgttagtgaaaaggtagaggtggagttggcccagagacaggattgctgagctctgaaggagagtcagccaggggaggagtggatgaggggattccaggcaggggcatagcatgtgcagcatctcggggtggtggggagctggctgtgcttgaacataggctgtggaggctggctggagggggccacaggggaggaagttatctgggaggtgacaggtgtgtgtgtaggtcagagcccctggacctcagctgtgaccctcgctggccctaggctgaggaattacaaggggtcccaggaatcccagaggcatgacaagcctgcaccctttccacagttctgaactccttccctgtggtatctgtcatgtacttggactggtgcagggtgctgaggaccccacggggaacaggatagacaggctaatagccattgaggatggctgcaggggacatccacaggctttggatggtgtcaccagataggctgctgtccctgtactctagccttcccctatctctgcttaagccagtcccctctgactggaacacccttttgctcctattgttcatccaatcctgagcctacccatagggtggatttcagcaagggtgggtgggaggaggaggagggtcttgcctggctgtgattcctgagccctgtccaagccacatgaacagcctcctcctacccttcttacatggcctgaatgctcttgtgaatatgtaccccctacaggagctgtggagtcacagccaaatgctgtgggggcccccaggcctcaccactgcccctccctgagatctctggcccagccaccagcgagcttggggtcagagcagcagggaccttggtgcccatgatactcaaaggaagcaggaatagagccacctccaggccacctcctgcttctccatcatcctctttctctattctccagacattaggcacccactgtgtgcccagcacagttttgggagtgaatacaggccctgttctcccagtcaggtttaagccttgatagctccccctgggaatgggttgcggattggaacaccacaggaagcagggctccttcagcccctcttcgcagcaaccctccaagtgtgcagcgagtcagggggtccctggggcgaacccacctgttggggaaaagggagaggctggtgtggaatgcaccatggtacctccacattgaggactctggcagtagggggcggggcatggtatgcgggtcacagcacatgcgtcatccttccccatggcccttcctgtttttctgttttgtccctgctactctgagatcatttccctctggcctggtttggcctgggtgctggtgggagccaagggccagccccagcagccttgccccaggaatgaaaagtcagctctgggcagcagcctggaggcctgggaccagcctccagggcatggcagggatattgaggcaggcagcagaggcaggccctgcaggggtagccttgatactaattaagggaactggtaatgaggagcccctgggacccctgccaagcaggtgtctgtgccctccccctgaggaacccagatttcattgggcgctgggcaaagagcccactggacctggcaggccccaacctgtccagcaccacatcgagggaccgcacccggctgctctgcggctaatgccgtaattgcgcccattagcatcctgaatccttcaccgaaggactaatttgcctcctcccaccctctttgcctatagctccaacatcctggatcctgtccgaggcaggtctggctcagaccctgggtgctggagcttggctggctagctgtccacagagctgcacctcctcccattcccattctacaggtgggaggccgggggctctgagttcaggtttcttcatttgagcaatgaggtaatgcaggcaggggttaaagaaacaagggctgtgcctaggccaggcgcagtggctcacgcctgtaatcccagcactctgggaggccgaggtgggcggatcacctgaggttgagaggtcaagaccatcctggccaacatggtgaaaccccgtctctactaaaaatacaaaaattagctgggcggcaggcgcctgtagtcccagctactcaggaggctgaggcaggagaatcgcttgaacctggcaggcagaggttgcagtgagccaagatcatgccactgcactccagcctggcaacagagtaacactctgtctcaaaaaaaaaaaaaaaaaaaaaaaaaaaaagcaagggctgtgcttgagaaatggcatgggagggaaggggcctcttgcagctggcccagggtccagctaaggaagccccatgctggcccccactgaccctcccaccccccatccccagctacctgaacgacctggagcgtattgcacagagtgactacatccccacacagcaagatgtgctacggacccgcgtaaagaccacggggatcgtggagacacacttcaccttcaaggacctacacttcaagtgagcgagcatgtggacaggtgggaggggcaggacctgccagcctctggggtagcagaggcaggggctggtccaggatcccccagccccactgaggttttacaaggctcatgtgttctgggcaagcacatcctcaccacctagtgaaccagcagtcaggatccacgccacctctgccagctgctcacagcctctgctgctcctgcctgatgtggctgcagcctgcctgctgtccaagctcctggcccagaaccaggggtgaagtgggcaagtgtggatgattccagaaggtagctgccctactctgggcaggcctctgtcctcagtcagccaacctgagaaatggggtagaaagcctcccccaggctcccttcctggaactaaggtgatctatatctgcaggatgtttgatgtgggtggtcagcggtctgagcggaagaagtggatccactgctttgagggcgtcacagccatcatcttctgcgtagccttgagcgcctatgacttggtgctagctgaggacgaggagatggtgagaggatgagagaatgctgcgggtgggggcagcgggcttggggagtggtggctagcgttgaccttgctattctacccccagaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggtgtggggactgtggggatagggcctccagagggttgcttcttgtcccaagtagcctatggtgaccaggtggccctcaggcgccccccactggacagaagtgtaaccttggaacactggcaggggctggtgcctcacttaggcttgtatagttgtgtgtgcacacatgaagcccttaacacactcaagcatgtacccctgaacatgtgtacatgggcatcctccttcacacagtggggtacccctttgcacatctggcatgtatgggcagccacaaacattgtcatattatgcacatgcatgcacaggttgtatgcctggccgtccacacgcacagacccttgctgcacacgtaggatgcggcctgcctgccacacatgcagcacaagtcttcattttctctcccccaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatggtgagccagaggggctgtggcagggtgctggggaagaactaagcgggcctggagccccagcagggggttctgggggtgggtaggggggtgaacctggagggggaggggcaataggtgaccaggggacaagggaggagaaggcccagggtgtgaatcaggaggtcaagtgagtgaggtgcagggcatggaggaggtcatacaagcaggcctggcccagtggtccagacagaagggcctggccttgccctgggacagaaccagaggccatcctgatgttccctggagaaatctcacctcctcacccaccaggccattggcccagcctgccggaagctgcatgccagcggagcccagccctgctgcccactaccaccagctccatgtgcacctccagctcttgccctctgacttgtctgagcgtcccgggcttaggctggccccactggccctggtggaggtggggatgactctcccagtgccacagactcccctcccccacgtaacccagcaacagaaactggctcctgggcggcaactgtgtccctggtaacaaatgggtaggaaaaatagagaagggtcattgtctagggaggcgggagagaggcacgccctggctgcttcccgatccatgctctgctttcccccacctccagggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaat

SEQ ID NO: 35756 - DNA, 36835 bp, Homo sapiens
ataagttagcgccgctctccgcctcggcagtgccagccgccagtggtcgcacttggagggtctcgccgccagtggaaggagccaccgcccccgcccgaccatggccgagggtgagtatcagagtcaccgcagccgccactcaggggccccggggcattgggggtcaggacccggtgggagctgaatccctaagtcctgatttggagagcaacaggcagaccgggctgggtgaggaggcgtctcaatgctgcttggagcctcagtttccccatccacactgcataaccattaacccttgcctccctggatcaggtgaggcaatggaacgcgacggggtgttgtaaactgtaaagtactgtcctggcggaccactggcacgtgtcctcagtcagtcagtgggggctggctctctgatgtgtgcctggagctgtgcagggggtgctggcctggcctcagaacacttaggtttgggtggttcttgccagccaggaccaggtggtgtgcatgccacgccggtggtgtgcaagccaagcctggctgagtccttggctccagcggccagagaggagctttcggcatcctatccaggagccttcggaaatcaggcttgttcttcccgccctcacgttctgcaaccctagaccttggccaattgttgagtctcacctataaaataaggacaacagtgtccttattttataggacaaggtttatgagatttgttttcccccaagacccccacccatctgtcaccctgaccgtgccctggtcctctgctccagcctttggtgcatctgtgaggaacgagaggagtggaacagaggcttaactaatttcatactggtgcccctgactccctccccacacacaagcagcactctcgtaggtcccagctggagggatttctacaatggaggatgtcactgctggacccagaatcccagctggctcttgggtcaagttcatctggggatggcttctgcacccattgcaacccccaggaaggggtgtgggacagggacatggggcaggtggagcaggaatgggtggcaggaactgtggacccacctgaccctgctgtgtgatctcagccacctgcctccctcgggcccagctcccaacacactgtgatgtgtcgcctcggtggccgcttgtcctcaatgcatcttctcacccccatgctcaaaagcagggctcagtggggctgggagatcctggagatgccagttatgatgagcctccagccccatgtcacagtggccacttctgacagaggtctcactggcctagaaggcctaggccctttctaagtgcagaaatcctataaatcctacaattctagacctgcatctttggagctgggcgtgatttctggaaacccttcttcggacaacagatggagaaaatgccccagctcccacagcccagggactggccgtatctccagggtcttccatgggaacaacaatggcctctttcctgctcaagctccctgggtctgaagtttccaaaaacatttcctcgccgcaataggccagcaggaagtttttccttctggccactgaggtctcttctgttgtgattacacggggaccgacatccctgatacttcagtggcgcagaactatctgcccccaggtttgagaacaacacaggacatggtggcgaaggggtggtcataagaggggctggagaaaaaactgagctgtagtgaggtggttcccagggcagaatcctacagaatcctacagctctggattccaatcccaaagcagccacttgctctgggacctggagccacctggtgtctttgtctacaaaatgggaatcatgatagcatctatgtaagcggagttgttttgggatttaagtcgagataattcacatacaaggcactttgcatctcatttttggaatagtcgatggtgagcaggagacctgggctctcccactgcaaggaccaacttgcggcgtgactttgaacaaattcctgcccctgggcctcacttggaccacatgctgtccagtggctccacactcagagtctgtcttgcccactcctcccaccttaagggcttccccatcctgaccttgagcttgccaaggtttatgagatttgttttcccccaagacccccacccatctgtcaccctgaccgtgccctggtcctctgctccatctgaaactgtaaatggaactttcacgtatcaagcttctgtcctgggctgggccgtggggaagggggttcccaacacatcttctagactcacagcagccccttgagacttcagaggaggagtcacagagagggagagacacttatccaggctcacacagcaacacagcagaactaaaacctacctctggaagtctccaaagcacctatcatgttaaaaatgttttgttttggagaatattgaacatacacaaaaatagacagaattgtttaataaattcctatgtcctcatcacccagcactgaccaccgtggtgtctcctgcccctgcgcaccttcatctcagacatcacatcatgtcatctgtcaatgtttcagtatatgcctttaaaggataaggactctcttttttttaacacaaacaaattaacaaaaattctttgatatcaccattatgccatcagtatttaaatttccagttgtctcatacatgtaataaatgttttaaaatacttttttgaaatcaagatccaaatagatcaatacatcacaacgggtttaagtttctctttataggttctctcttcaatgtttttttcattttctttcttgcaatctatttattaaagaaaccggaccctttgtcaataatttcccagtatatgaagtttgtcaactgcatcctggttctgtgtttaacttgttcctcagccctgggtatttcctgtaaattgaacattggatctaaaggcaaaggccatgtaattgacctgtaccaaatactgcccctgcttaaaccaaaagaaccctctgatagcaatagaatagctcgtgtttattgagtatttattacacaacagacattgtactaagtgttttacatgcattaattcatttcttgctcacaccagccctgggaggtagatactgctggtcccatggctgctggaggtcacacagctaggaagtgccacagggggtcacgaccttgtgattaaaagatttaggcaaagctgggcactgtggctcgcacctgcactttggtaggtcaaggcaggagccatcacttggcccaggagttcgagagcagcctgggcaacatggcaaaaccaaaaatgaagaaattagctgggcacatacctatagtcccagctcactgataaatgaaaaaattagtggtgcacgcctgtcctctcagctactcaggaggctggggtgggacgatcccttgagcccaggaattcaaggctacagtgagctatgatcacaccactgcactccagcctgggcaacaaagcaagaccttttctcaattaaattaaaaagaaaaaaaagagttagggagattgggccccacctagcccccgtgtgaccagggctggggagacaggtcagtcgaaacaatggctgtgctttgtggggagtaagagggcacaaggcccccatgtctagggagggcaggtgcatcactggaggtctgaaggatgcccccgaggctcatgcgtctccttctgtttccatagagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggtgagtacctgcaaccccactccaccaccaccaccaccaccaccacttcctctccaccccgacatgccccagaaccctgacagagaacaggacaaataactttaccttctttgttccctgggagattgccacctgtcatcagccccattttagagatgagggaactgaggcccggaaaggaaggagatgtcatggcagaccaccagctttgtgagcaagtctgtgcctctggaaccctgagcttctgaaagcctattatcaccagggttgcaggtcagccttcaaccaggaaagttgatcaggatcccatccacaggctgggcgtggtggctcacacctgtaatcccagcactttgggaggctgaggagggcggatcacctgaggttgggagttcaagaccagcctgaccaacgtggagaaaccctgtctgtagtaaaaaaattcctatccacaagccaggcatggtggtacatgtctgtaatcccagctatttgggaggctgaggtgagaggatcatttgagcctaggactttgaatccagcctggacaacatagcaagacaccaccttaaaagaaaaaagaaaaagatcctgtctgccctttcccatatcaaaacaactttctaatctctctgctgcctgaaatccacgcaacccagccaggcactgggatcaggcccaaatcaggcctgggtggcagagaaaaagcccagctagcttcagccttccatgtgggcagttctgggtcccagcagttcattctccaagcattaggaggctgcctcaatctccggggctggacagaaagactaggattctagcgcaggctgggctgcctacctgctgtgtgaccttaggcaaattacttaacctctctgagcctctgaggtttcatcatctgaaagccctcacattggaaggttgttaagtgtctgctatgggggagggcctgcagatatttgcagctgttacttatctttgtactggggccccagggataggtaaagggacaccaagtccccaggcgtctcatccccagatgcgtgatgcgcaattttctttgttggccattcctgggaaaatggcctcaaatgccaaatcagtgggtctggtttctggtggcagccattcccttgaggtcagtgaggggccacctggctaggactcgggttgggaaaggccagctctttctgaagtctctgagggcagagatggcagcaagcattccttggctgaggcctgcattgaactagaaggctgttgataaggcttatcatggggactgcagcctagcctcggatagctcctccatccttctcctccctgcccctgccctcctggtggagacacacccactgcccaggggctcccccacaagcacactggcccccaaagttctcttgctaacagagccaaggagcccccagcaagtctctgaccctccagtctcagtttccccctttacgaagtgaaaagttagggtacatggcagttaagggctgggtctggtggcctgagaagagtcagacttgtgatagtgaaaatcacaacatctgtggggcacccactgaacgcatgcttgtcttgaatcctcgcagcttagaagttataaaggactccattttgcagatgggaaagctgaggctcagaaaggtcaagtcactggctcaggaaggtcagtcacacagtgagtcagggacacagaaggcttcaaaccccgactgcagagtgaggcttttcatccctatgtccctgcagcaggcgcatttatcacaagtgcctgccagggctcagtgtgttcctctgtgaaatggaatggtagatgagctgctggcttgggcagcctgtgatttctactttcttttttatttatttttctttctttctttctttcttttttaaaacttttattttaggttcatgggtacacgtgcaggtttgttatataggtaaactcgtgtcacgggggtttgtggtaccgattattttgtcacccaggtgctaagtctagtacccaagcgttattttttctgctcctctccctcctctcaccctccaccctcaaggaggccccagtgtgtgttgtttccctctatgcgtccatatgttctcgtcatttctctcccacttataagtgagaacatgggggatttgcttttctgctcctgcgttcgttcgctgaggataaggctgccttctttcctcttctttcactccagatgtcccctttcttatttctccttctccaattgtctgggcagcgtagtgttaggtaattagggccctgagtttggggttgggtgaagggctgctgctgaccttcccacctcagcaagctaatctctgtcctccagtctccaccaacttatctcaaaccataaccaacctgccccggtcacttccgcagcccctgtaggcagccacggaagagcccagatctctgagtacagagtgcacacagcttccctgtccaagcaaccaagaaattcccggggcccggagaagcctgagggacaataccaggaaaccaggccctcccccaactccaggcctggcctgggtcagcgcccggctcaaggcctggccagctgactctgctcctgtgtgggaacattgtagcttgtgatgggaaactgaggcccagagaagcaggagagctggctaaggtcactcagcgaatggagcatgtggcctgaccccacacattcttagatgttgtgtgttttcacccagacagtttgagacccgacagactccgttatggggtccaggccacactagacaaatgccatccttgtcagagggataaagttccctccaaggtggggtcggggtttgagggggtgtggcagtcacaatgggagtgaagtcagcctggaggagtgaagggaacccttatgaggctgatagaaggctttactctggaaggtcctgcccacccaccccatcccagcccggccaccatggtctgggatagtggccaggacccccaggctccctgtggtcatttgggcccagagtggccctcatggtgcctctggtctcacaaagaggatggtgtagaaccgcagccaaggaatttgtgaagtcagcttacgtgagcagcgggtggaccgtgggacagcctgtccttctcctgttcccccaggatctgggaagaaaggggtgtgtgagtgtgtgtgcatggctgccccaagatagagagaaagggaaatgcgtttcctgacttgtccccaagggtgacatgtcaacagcgacagtgatgatgggatctggcccaggcctgttgccacagagaccagatcattgatcctccgagcagggacatttctgagattggaaagagcacccttaagaattatgatgggaccacaggcgtaaactgaggctgtcctgagcaaactgtgatgcttggtcaccccagcaccacccctctcaacctcagtttccaaatctgtgaagttcttcaatcgaactagacaatttctacattccactccagtcctcacgatctgctatttggcctgagaattcagacttttaatggccccttttaataacactgacgatagctcacatttcctgcatgattactgtgagctggtcactgttcaaaatgctttctatgaactctctcacggaaccctctaaacagagccaggaggcgttcatgaaaactgaacaagactaactattgtttcctgagcacttactatacaccaggtgccttgtgggatgctttgtatgcctgtcctctttaagcttcacaacaaccttatagggaggtactgctactggcctcattttacagatgagaaaactgtggcatagagaagctaagtaacttgtcgaagttcagagagccagtttcgaacctgagattggactctcccaggcatgtggcctaagcctgttttcttcttggataagaaagcagatcagagaggcctggtgatgtggcccaggtcacacagtgctcaggggcagagtcagggagccagacgtagggtgggtctgggaccccaggcctgcatggctcctccccaaatgccagctctggaagtcagggagcattcaaaggcttccagtcggcccctggcacttggacagggcctgagaggcctgtgtcatgcctgttagttcatggttacatttgagctgggtgtgggtggggctggctggcagggaggagggggctgggggctgggagggagcccctgggtgagcaggccccaataatgtccacggtgggtgggcagagctgcaaggagggagatggaagaataaaaataaactttcctgggcacccgcccagccaggcagagaacgtcctctgtcttctctccaccacccatgtccagaaagtgaccagcccctcctcgccctgcccatgactcagacctgcctgtgggggcgggccctcccctccacctggaaaagcagctgctttgagagtgtgcccatcactgtgcctttgagaacccggctggggagtgtcctctttgggaagaagaggcaccgtagaagacaactgagagctaaagacccacttcagatgcgacctttgccacaaactcctaggatatccttgggagaccgctttgctctgagcctcagttttctcacctgggcaaggggtctcaaaggaagcaggtgcttcatgaagtgtaaaaggctgtaggaaggtgaggggtcgttatgaccagcatctcggaactgcctatggagatgtgggggacagcagatggggggcctggggagacagacaccttgaggctgtgtgggccagccagcatcctccgctggcctacagcaaggggctctcagaggaccgaggtcccttcctgctcagcgtctgggcttccttctctgagagaaaaagcgggacgctagcaggtagaggatgtaggcaggaaaggagggccctagggcatgttgcctaatccttgtctatgctacacaaatggggccaggtgatcccagagagagggatgggcttgtcccgagtcacatcattgcagagcagtggaactgagccttggctctgggccacatggcccctctctcaggaggactctttagttgaggacatgctgtatgcctgtggctttttatgcattcccacaaaaccaccctaaaaggctggggttctgagcccccctttacagatgaggaaactgaggctcagggagacaaacttcttgccaaacttatttcagtggttagtggcagaactaggcctggagcccaagctgggggaccccacgtaggtgccctgccctgccagccctgctacccctagctcacggctactgcttctccctccacaggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccaggtgagccacacgccatccactcacagcgttggggtgggcagggctggatccgcccatggaggaggctactggaggtgagaagaacaggggataagagacacacatcaaagtggactgagtgaggcccactgtgctccagcctcacaaaaccctcaagacatgagtactcctgttatccctgtttatagaaacaaaatgaggccgggctcagtgatccatgcctgtaatctcggttctttgggaggctgaggagggagaatcacttgagcgagccaggagttaaagaccagcctgggcaacagagcaagaccctgtctctacaaaaaaaaattttaacagtagctgggtgtggtagtgcacgcctgtggtcccagctaattgggaggttgaggtgggaggatcacttgtgtccaggaagtcgaggctgcagtgagctatgattataccactgcactccaggctggttatcagggtgagaccctgtctctaaaaaaataaaaataaaaagaagcagaatgatatgcccaattccacatatttaccaagggacttcactcgctgtttgaggcctgtatattcccagaccactatgaactggggcttagcggtgacttggtttcaaaagccccacatcaggaatagggtgcccagctgatgcctaggcccaggcactgtgtcctggttctgtttcatggggccctgttttttgtgtgttttttgttttgttttgttttgtttttgagacggagttttgctcttgttgcctgggctggagtgcaatggtacaatctcagctcactgcaacctctgcccaccaggttcaagcaatcctcctgcctcagcctccccagtagctgggattacaggcatgtgccaccacgcctggctaatttttgtatttttagtagaaacggagtttcaccacattggccaggctggtcccgagctaccgtcctcaggtgatccacccgcctcggcctgccaaagtgctgggattacaggcgtgagccaccgtgcccggctgaggtgggaggccctgttttaaatctcacccagactggtttggggaagggaaacccggaggtgaggttggggggagggctgggggaggggggtgagtaggagcagttagaccgtccagctgcctccttatacactatctcagtcgggcctctcaacaatcccaagggggagatgacacttccccacttcacacacaggaaactgaggctcagagtggtgaagtggcctttggaatctctttgaataaataagtggacaaccttggacaaaactagaaagtcagaggggagagcttggaacaaaggaaactgacttgagcaagggggaggaggcaggggttgccagtcacctccccaggcctcgattttcccatctaactagcaaggcagtcagatctaatgatctgtttccttcctattctaatgaaacaaagcagggaaagaagcatcatgggccaggcccctcctgggaatcgggtgtccctcttcaaaagggcagaaattctggcctcctggctgttagacaaccaccttcttgctggcccactgctttatcttttttcttctctattttgaggcattttatatttgagcagaaagcttttaaaatttttcacctttccatattttgatttttatttcccagtataacagtaaaccatgacagcattctctttagaaaagcttcaagcccaggtgcagtgtaatcccacacctgtaatcccacacctgtaatcccggcactttgagaggctgaggcagggggatcacttgaggcaggagttcaagaccagcctggccaacatggcgaaacccaccgtctctataaaaaatacaaaaattagaccgatgtgatgacacacatctgtagtcccaactactcaggaggttaaggtgggaggatcgcttgagtccaggaggttgaggctgcagttagctgggattgtgccactgcactccagcctgggtgacagagcaagactctgtctccaaaaaaggggagagaaggggagggcttcaagactacagagaaatggcctccccctttgacccctcctccttgggggacaccattgttagatattttgcgggggctcacctccttaggtcagtctgtatgtgcctggagaaattgctgtattttataggtctctgtctctctatcacaaacataaaaggatcccactgtatacattaacctacaacttggttttttcccctcacaatacaccgtgaggctctgtccacattggtctgcatacatctgctcattcattctttttttttttttcttttttttgagaccaaggctctctctgtcacccaggctggagtgcagtggtgcaatctcgcctcactccaacctctgcctcccgggttgaaatgattctcatgcctcagcctcccgagtacctgggattacaggcatgcaccaccacgccgggctaatttttgtatttttagtagagacagagtttcaccatgttggccaggctggtctcaaactcctgatctcaggtgatccgcccacctcggcctcccaaagtgctaggattacaggcgtgagccaccacgcccggccacatctgctcattctttctaagggcgttgagtgtcctgtttcttgcccatgtggatggtccagcccccactgatggacatgaggttgtgcctggaggctcatggcacgcagggaccatgcgtcaacgagcacccttgcttcataccctgtggccaatggaatgatttctcgggacagaagtggccttactggatccccccccccgccccataggtttgttttgaattttagtcaatctgcagagggtagcaactagttggcagctctgccaacaggacaggaacacgccggtgtccccaccctcgtccacaccacaaggtttcagagttcagggaatgggaagcgtggttctgggggatggcccccttcctcctgcttggcctcacccggcggcgggttggagtggcggtcagccaagcggcacagtgactaaagtgacccacatcccggggcgggaactgtggagctggtgatgcagaggcaggaagttgggctggggtgagcgcaggggcgctgcgggaggaaatcagtctgatgggtgggaaagggccgggtctgcctggaaaatgggaccctcctgtatgtcagttccaagaccaatatgatcgagtgccagttatatgcaaggcttcacgtccccagtgcccccacctttaccagatggggacctgagctggggatgtcacagtcttggcatcctgagctggggtggggacaattcaacaagtgctgacactcattctaatgttgaaacactgtgggttcttctttctctttcattcttatcccacaccccccggctgctgcagagccattatagttcattgacttcaaggttaatttttatagaagtttccagagccaaagatcagaatacacaagagacttggcctctttcccatttttcctcactacgatgaaagtcagggctgctggttgctgcagacgggcatgacaaagcccaggggtctgaggggccggcagctgcttccttcccaggccagcttctccattagacccggcaggcactgtgcctggggcctgagaaactcttaggggcccgtgaacatgttttaatgtaatttaaaatcaggagaaaaaaatgaacatttaagttgaacaataggttttaatatgtaatattgagatagctgtaattaaccaaggcagtcataacattcaattaccttttttctaatggaggaaggaatgcatgaagtcaagagtgcctggggctcaccaaagtcataatggggctccagattgccccttcttggcctcagtttcttcaccggttaagtggagtcagtaaagccagcctgacctttgggctcctaccatcttgccccaacttcctcagctccttcttctcccctcactggccacagacaactaaatgccctgcattttccagcagccaaagctttgtgctttctggtcctctgcttagaatgctaccctccaggttccaactctctaaaacttaatcattttttaagacaacattcagatgccacctcctccagggagccctctgtaactctctcaagctggacaggaccccacctctcctgagctgcaggaaccctttcttggccttcccctctgctactgagttctctctgccttgaatcatgcgcctccctcacgctacctcagggctttcgtttccaaagcacctttcagatctgcattttgggctgacacagtgaggtgttaaggtgggcagagaaggcaaagtagcctacccagggtcacacagcaagtgagaatcaggagtttcctgactcccggtccagtgctcctgtgtccttagtctcagttttcctagctataaaatattcctgagccttagttttctggtctttaaaatggggctttcaaggatcccttcctcataaggctcttctggagattaaatttattaatacaggtcatacatttatcacaggtcctggcacacagtgagtgttgaagaaatggcagcctttgttgtcactaaccgataacaccttatctcattgacgtgggattattcattaatggttactttttctaattaaaagaaggatggatccctgagacgctggcttggcctagggaattggcacccttgactccagatttgcagggaccctgggcctccgcagacccagagctgaggtccctttcttcctgcctgcagcggatgctgtgtacctggactcggaagaggagcggcaggagtatgtcctcacccagcagggctttatctaccagggctcggccaagttcatcaagaacataccttggaattttgggcaggtaagggccacaccctgtctctcccaaccatctcaggcccttctgtgtgcccggccctgtgtctgggggcagccaaagctgcacaggtgggagtgagtcacagagtcacccacttcatgctgtcagggatgcaaaggccctgaaacagctgaaggttcagagagggccaaggctgccctgaggtcacacagcaaaggcggcagccttggattcaaggtggagaaagaactaggagagcctttgggaactgtgaagctggttggtatcctgggagggggaagagggaacagtaaagctcatgtattgaaacaataggcagtacttggagttgtgctggggtgagccctgtgtgctaggcatgtgctaagaagaggctttaaaccctcacccagatcagtggttctcaggatcactgagagtcttaaaacactaggggttgagaatttgctcttcaaacaagttcccaggtgatgctgatgctgcttgtctaataaccatactttgggaactgctgatctggttgtatctgctagctgctgctgcataacaagcctgaaatttaggggctaaaaacaacaatcacttattatttctcacaagtctgtgggtcagccatgcatggctgtctaggctgggcttggctggagtcagtaaagccagcctgacctttaggctcctaccatctggctcagccaatggctcatctgtttcacgtggtttctcactccccagtgggccagcctgggctggttctctaaactggtgatgataaatttcatttatcatccagccacctgtacaaattcttgagactctgctgggaaaactcacaaagcaagaaccattgcacccctggcccctcaacctcctggtgtgttaggaggtattggcctcctggggtggggttcaccctgaggcttcccccagcagcctctgggtcaggtttcaatgttcaatgaccctctagggagggtcctaccctgaaaccatagggaaatcttccctgtatgatctcaggctttgaccaaagttttctcatctgaatatcatgatgataattgcaaaactaactgctcagcaaccccgtagcctgctgtgggatataaatgaaatggtggtatgaccgtgatgcataaaatacatcagaaaatgaattggctctgatttttcatggctttttattctctcctgagaaggagaacaaagtcaagttcttcctttatttcccagggtcctgtttttttttttttttttttttttgaggcggagtctcgctctgttgcccaggctggagtgcagtggtgcaatctcggctcactacaagatctgcctcctgggttcacgccattctcctgcttcagcctcccgagtagctgggactacagacgcccaccaccacacccggctaattttttgtatttttttagtagagacggggtttcaccgtgttaaccaggatggtctcgatctcctgacctcgtgatccgcctgcctcagcctcccaaagtgctgggattacaggcgtgagccaccgcgcccggcccacagggtcttgttttgtatccggtcttgtgctgggctgtgggacatggcctttgcaaagcttctggaggtgatcacagtccaggaagatgagacctagaggaaggaaggaataacagcctatggggatcagggggtacttcttgaagtagggaatatttgagctgggctttgaagaacaaataggagtttgccatgcaaggaggtgtgtgcacgacatactaggccaagggaactatgcaagtgaaagctcagaggttggaaagtttatgtcgtgcctgagaggtatattgtagcttggggcataccttgtgtgtgaaggagccccaagagatgaggtgggagaagccagcagtgtccagtttgtggaacagccctgaacattaggccgatggcaatagggagccacagagggttcacaccgtggaaggctgttgtgcagcttggagggagatctggcccaggaaaggaccacagaagtggggggaaaagagcagacagaagggcccctggaggtgggtggtccagtggaaggtggcaagaaggggtcctgcttttgagaaagatgacatttgaatggcaaggatgaggaggtgtgagccctgcagagagcagcgggaagagcattctgagcagagaaatagcacatgcaagggccctggggcagtgagcctgggcagagtgagtgtgggtgtgagtggtgagagatgaggtcaaaaaggggatgggagcagatcatgaagggccttgaagtttgcacggtgaagtctaggttttactgtggatacggttgaaacagaagagtgatgggactggatttctgtatttagaatctgtctcagttcccatcagagcagcgtgtgtgggctgggttggagggggacgagggggctgacatcagctctgcagggtgggtcacgccttggggaagtgggagatttggctgagcaagaggagaaagggacagtgacagggcccaaggtgactctgagggggagccccagggacaccgggctgcccactccatgggctcctgctccagatttccaggttcccccaaccaggccctggatgaaaattgttaccctcttcgtcacacactcatggctcacccagtcattgtcccactccattccctcctgtgccaagagaagctgccaccagagagatttggtagactcggccggagtgtcccagtctgctgtgtgggacagagtgggaaacagctgctggaggcttcaacgcaggcttcctggaggaggtgccttcccagctccctctttctcctcttgtttcctctgacacagtttgaagatgggatcctagacatctgcctgatccttctagatgtcaaccccaagttcctgaagaacgccggccgtgactgctcccgccgcagcagccccgtctacgtgggccgggtggtgagtggcatggtgagtgagtggcatggcccatccaggggcggggcctacagggggctcccgcaggcctctccctcgcagtggagacacaggctaggcgcggtgggggacccgggagatgggtaagtcttggggaaaagaccttatattggaaagataagatttgcacagatgagggtgatgctatggggtcccccagagcaattaatttattcatttcttcagtaaatatttatcaagtaccacttatgtcctaagcactggggagacagctgtgtgcaagtcctgtgtgatctctagctttatggagactgtgttatagaggggaggggaggggaggggagacagacactaaccaaactaccatatgaacgagcaggcagttcacatggttcataaatgatggtgcacgctctgaaggaacccgaggtgtgagagcgttggactgcagggccaggctcagggaggggctgaggggctccctaaggtggtacccaggagaagggcattccaggcagagggcacagctgtgcaaaggccctgagaagggagcgactttggcaggtttgaggaaggaagagaggccagtgtgcctggagtggagtgagcagggcccgtgggtgcagaggaagctgcagaggtgggcaggggtgagaccagaagggcctcttggatcatggtcaggaggctgattttattctcgaggtaatgggagtttagggggaacgacacaatctggggtggggggcccaagcgggtctttgtaaaacttagatcacaccatgtcactcccgagcaatcctgtgttcataggacagagtcacatccccagtatcgcgttcaagtccttgaccctgccccacctccttcttccccatctccctcctgtcccccggctccagcccccaccatctgccgcacaccagtctgtcacacgatggcccctttgcacctgctctttcctcaccctggagctcccctccccagctttcaccccctgctgtactcaggctcacccaggcggcacagccgacaccccatcccaggctcagtccccgtgctgccccactggttgcaggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacaggtgagctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtggttgttaggatcaagggctatcattggagagactgcatgggctcagggctgagaacttgggcactggagcccacgttctcaaaaactcaggatttttaacttgagttaaaaaccccctccctcccaccacttgctctgtgaccttgagcaaatgacttctttctgaacctcagtttcctcgtctggaaaatggggacaacatcaagaccttcctcctagagtgggtgtgacatgaagctactcagcacagaacctagcccagtgtcactctcggcaaatattagccagtaataactggatcctaacagtaatatcagtgtcaagaaagaaagcatgttctaaaatgtagagggggaatatcgagcaatttaaaaccaaaaaagtaaaataaatctaaaacaaaaatcttcaaaatttaaggccagaaaatgtcgatgattgttgccaggctgatgatggtgcttatgagaatgggttagcatcacatgctggctaagaacgtagactcaagacatgaggattgcttgaggccgggagtttgagaccagcctgggcaatatagtgagaccttgtctctacaaaaaaataaaataaaataaaaattagcaggcatggttgtgtgtctggagtcttggctactcagaaggctgaggcaggaagatcgcttgacccctggaggttggctgcaatgagctatgattgcaccattgcactccagcctgggcaacggagcaagatcctctctcaaaaaaaaaaaaaaaaaaaaaaaaagagagagagcacaaattctgaagtcaaggcctgggttcaaatcctagctctgcttcttaccagctgtgtgtccttaggtaaatcacttaactcctctgaaccacagttccattgtatgtaaaatgggcacaacggtagtacctttatactgggatggttgtgaggattaaatgagttaatatgtgtgaggtagctgagcgtggtggtggtgcacctgtagtcttagctgtttgggaggctgaggcagggggatcacttgagcccaggaggtcgaggctgcggtgagtcatgattgcaccactgtactccagcctgggtgacagagcgagacctcatctctaaataaataaatgaatgtgggaagtgcttaaaatgattttgggtgcataatagaaaatacttatgtgatgatactatttattgtcacgactattattattaccaggctcaatctaaaaggctggtctggggcttccagcttttctgattccaaaaccagtgctaaggcccaggaaagggtgcctggcagggcccccagcacatcctccacaccagcaggctgggtcagggcagcctaacctaggttctcagctcggctgtccttgccttctgactcctgcctctctgcctgggactgcctgttccccgtgacctctgaattcctttttcttgtggaaactccttcatgccagacacttccctctgagagccctaaaacacctcttttcaaagaagcccatgggttttcctggaaaaaccccgaaatccaagacctggatccccaggctcaccggcagaaaccctggtcatcctggtcaccctgggctgtggccgcctgaagattgagcagcagatcctgcccctcagctgcccactgcagggctgtgttctggtccccgcagcctcttcccaggctgtgtaggatggagccagggaaaacttggccaagaaaagggctgtctgaccactgtggccgtggagttcacgtggggagccaatggtgaattggcccatgaactctggagctggactgcctgggtttgaatccagctctgccactaacccctgggtggacttgggcaagagaattgatgcctccaagcctcaatttcctcatctataaaatggagacaatggtgactgatctcattcataggaagctcttaataccagggagagatcacttagcacagtctctggctccggttaggcttgggtttggggatttccaggggagcctggcattccagctttcttagccggatccctcactgtacttcctcaatgtccatgaatcagccagcactgatggacgacgtttgccgtaacgggcaccatgacacactgtgctgttcccgagcaccccctcaatgcttgctctgggaatgggcagacaaggctgtgcccacacccgcggcctctctctgaatcaccacaaatccccacaagctgctattattagcttgtcttactgaggaggaaatggaggctcagagaggggagtggcttgcccaaggtcatacagctggtgagcagcagggtcagtctctgatccaggtgtgcacggtgctggggcagcctcctgttagactgatgaggaggcctcccgggacaccacccctggggcaagagtggcacttggctccctggaaagcagagacagacctcccccgtcctccggtctgtcctcaggcccactgcatggtgggataagacctgtggttaggacaccagccttcactgagggcagccttagggctgagccctgcccaggcctcagggggacagaaaccaggcaagagggggaggtcatagctgttccttcctccttcctcgaagctcctacaaatctcctggcaggaatccagggccaaccagtaagctcttaccctggcctatcgatggtggccccagggcaaaggtcgcatcccttctcccccactcccaaactcaacttcaatcaaaactaaaagtaaaacaaaagtcccacagattaccttattacgcctaatcttgtttctcttcattttttagatatttttttctgggaatctgttacttttacaatacacataaaaagcacatttttaaaatgagagagtaaaagcacccataattccgtctgccaggagcacccagtgggccgtgtgggtgagatccacaccgggattttcctccctcccctgtgctcctcgcctctctgagctgagctcagcttgcagatgccagtcaatgtcctgttgctgtttaacctgtcattgcaacatcagcccctttcccagcaaacagggcgttggcaggtatgcagggccctccctccggacaagtctgaggaccctgatctgtgctgcgacctatttatagggccacgtgcatccgtgttcttgtacattgggaatgatgatgagtcctcagtggcatcactaatgcacaaagagatggaaccaaggcccagagacatgaagggactggtcccaggtcacacagctgaaagcagctgggtctcccgacctctgtgccctcctctgcctgttctgctgtttgagtctttaagtccctatcttggggagagtcagtcattcaatcactccttccctccctccctctttcctctcctctctccttcctccactccttcatcccatttgacaaaatagtcaatgacaggcctgtgctgggctccaggatctaacataagacagatccctcactggccttggaggactaattaaagaatccctcacatgcctgtacactggaaggatgaaggatctccagccgtgctatgaatgcaaatgatggggcaacctgaacctggcaggcagccttccaggcagagggaattgcagacaccgatgccttgaagctggcagaggcagagcatgctggaggccagtgtggaggagcacagcgtgcgaggaggggttcaggggccagaccctgcagggccaagggccatggccagggcactggccttgacctcaagggccatggggaaccaaggacaattgatcacaggagtggtgacatcagatttgtactttatttcattttgagatggagtctcactctgtcgcccaggctggagtgcagtggtgcaatcttggctcaccacaacctccgcctcccaggttcaagcaattctcctgcctcagcctcctcctgagtagctgggattacaggcgtgcaccaccatgcctggctaatttttgtatttttagtagagacggggtttcaccatattggccaggctggtctcaaactcttgacctcaggcccccctcggcctctcaaagtgctgggattataggcgtgagccaccacgcctggccggggtttgtattttagagtctccttctggcaactgtgatgtgaggggcatagaatggacatggggtgaccagagaggtgggcgccattgtcccggcaggaagggctggctcatgttctcagcacttggacagcaggtacagtgttccctggaatgcagatgggcaggtggaggcccagagcagggcggatgtctccaggacctcaccccgctttccactcctctccaacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggtgaggtgggggccagggtgggatcggagcccagtagggagggccccatggagaggaaaccttggagggcttcttggaggaggtcacatttgaattgggccttaaaagttcagcagtatttgagcaggcttggggaaggcctagagggaaagtcaaccacatacatgatggggcctcaggaagaatcatgctgcaaatgttgtcgggagtctggaatgccacattagggggcccaggcttgattccaaaagcaataggttgtcactcaaggattcagagtgggagagggcggggctgacaactgccaggagggctagaggggaagagatgggcggggggctggggcgtggtccaggtggggagtgataagccctgaacggacagaaaagaagggatggagccaagaaattaggaggtcaaaggggccactgagaggggcaaggaggggagaggagttgagaagggctctgaggtgtaggagtgggcgccttggctagagagggtgctgtgagatgggcccccgtggggggaagaacaaggcagtggggagacaccctgggctcagtttgggacgaggcgagcttgcatctggggacatgaatgcatggtctgcccgtgggaggtggcgatgaatgttgctcatgttctgcttcattcccgcccccctatccccctcaggaacttccactgctgggtggagtcgtggatgaccaggccggacctgcagccggggtacgagggctggcaggccctggacccaacgccccaggagaagagcgaaggtgcgtgggcgggcactgtcgcgtcaaacagatggggaagacgaggcttggagagttaaagtgactcagctggagggcggcagaactaggagctcacccggagaccactgatgggtccacagaagggtgggggacctcacttacatcttaataacacacttcttgataaatctcaaaaataattcacgtgcattgcggaaagcaggaaatacagagaagctcaaagaaaaaaatcaaatagcatctttgtctcctccctctaaaataagcagcattaacattcacacgagcttccactgatttcaaatcgtgtatttgtatgcgggtgtatatgtgtgtgtttatatatgtatgtatataaacacacatatatatatgtagtacctgtgtgtttgaaagagagagtacactaaggcacaattttgtgatgcatatggacactttctaggaatatttttaaatgtataaaatataatacatagcgttacaaagaaaaccaattacattaaaatacagttgtcacaagttttaaaaaatgaatttatgatataataacatatgcttctttatagaacaagatctagcggtagagtcagtaagttccataatatagttgtagagataatttatgagcataaattaatttcctgccatctgggacagctgtaaggttgtaatgaccacgcctgtggttcttatgagtgacaagtcctaagtgctcctcaggctgctatggtcatttcctgcttttgcaattgaagaaagtgctatggtgaaaacaaagatacccttttttccccatcatagggttcatagacccctgaattctgttggtagtgccttggggggatccgtgggccctggtttaagacctccagcggcatggaacattttttcccagctctgtccacttctggataaagcattggcatttctccagcagatagttttctgtgatttgaatttttatttaatgtgaccgtggtccatcacatggatgtgctagactgtatctatccagcctctagtcctcagcattggaagtctgcggacagtgtggggcggttatcaaccacacttacgtaaacatcaggcacccgtattcacttggagaacacacacgccctggggctggccccatgcggggcactgagctccactctcagtatgagcaggaaacgagacagatgtcctccttgctaacatgttgcctgtccttggctccataatttcctcaggatgtctgggatacatttccattttatttatcaaatacttgcatagcatttagtataggctatgagctttacatctataattcaggaatgctcattaggtggtccagatcttatctccacatgaaactgccgcttcgagaagttagtgactggcccaaagtcaccagctaataacaggctgagctgggatttgaaccttaaaagttgtgctccagagcccctattctgaacccttgccctgtggtgccctcctggaagtggagtccttccgtcagagggccgcgtggtcttgaggtttttggctacatgtgattgaattgtggagcgttttagaggacaccacccaaccttcacccaggcccatcccttcccctttctacctctgccagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagagggtatgtgccctcagagtctttaatgcagccttgaagataagcatccagttttcccagcccggcaggctcgtgtatgtgtgtgcgtgtgttttaattggtagcctacgtacagcaatggccccgtaggctatactccatcttcagcaatgccttagaaacaggagcaaacatgttgagggacagtggtagaggattattcatttagggaaagagttctctgctactgatgttaaatcagttgcaggggaaaggacttgatttatttttaaaaattggatttgagcacatcgaacagccaattcaatatggtatctaatttctaagcaaatactaagcatagcaaagcatacagaggggactaagaaaccatagttcctgccttggcctgaccctcactgactttccagggttgcctggccatactctagctgaaagggataacacagaatgaaatgatgctctccccatcccctgaaaggtctagagctgatagtttcatagaataaatagatatgcacccaacaacactgggagaaaaaaatcaaaggagcacaggagagaggcaaatggaatataaggaagggagcaatcagagacagggagggaaaggattttaggtagaagtaatccctgtgtaattgcttgaaggtaagaaagattgcactgtattcgtgcctagtatgcaccaagcactgttgtaggcactggataagtaaaacacagccttagccctcgagcagctcaagaaggtaagtttgaaacagaaaacaacacaggggaaggagtggtcagagagggcttcctggaggaggggtcatttggggttgagtcttgagggatgtataggagttcactagtggaaaattaatgaaatgctgtgtccttctggcccagaaatgtagagaaggggctccttcatggctgccctgagtcatcaggcctctgcgaagacagctcgccctgttgcagcccccttcctgtgatctattccagctgtgattgaggctctcttctcaacccctacagggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagagtgagggggtggattctaacatggctccgttttccagatgagtagactgaggcacagagaggttaagtaattttcttaaggttgcacagttggggagttaacctgtcctcacagcagctatactgtttggtttcacctcatcttcgtgtgacccctgactgctttcacagaccctctgctgccctctcccagtgaattccactgtctccagcccctcatgcctcagcagcctctctccatgggcccttcgagaacctctcctgtgcctctggttgctctcggcctcaaagaaaagtctctaacccagcgccttggaaagtgcctgttgcactttccacagtgatggagacgtgctgagtctgcaccgcctatccagcatggctgccaccagctgcacgtggctgctaagcgcttgaaatgtggctggtgcaaccgtagaactaaagtttgtttgtttgtttgcttgtttttttattttttttgagatggagtcttactctgttgcccagtctgcagtgcagtggcacgatctcagctcactgcaatctcagcctcccaagtagctgggattacaggcgtgcaccaccatgcccagctaatttttgtgtttttagtagagatgggatttcaccatgttggccaggctggtctcggactcctggcctcaagtgatctacctgcctcggcctcccaaagtgctgggattataggtgtgagccaccgcacctggccaaaactaaagttttaattgtgttgaaagttagacagccacatgtggccagaagctgctatgttgggcagagcagatcggcgagccaaaggtgggagcgtccaggcctctgcagggagaagtgctttcttcctggacttgattgtccctctccagtgtccccagcaccagcctagttgcctttttaggcagatccccttcgcagtgacatggtgtcattagaccacccaacccagccccgagccaagactttgtcaccaggcttcctgcacagtggttgtcctctgggtcccttccactgtctggctttgtcactgtgcctggttatcttcctaaatataagcttgaggccctcagaggagccgtggccactgaggtcacatagcgaggcagtgagggaccaggaatcaagcccagggctccgcccagcagccccaccaccacccagcagccccatcccactttctgccatttggagccctgcaggtgtgaggagggcagaggggtttccaggctaggagaggacctgggagctgcagaatgagacattggccatcctctgaggggcagtggaatcaagtaggacatcgtctttgggcagcatctcgctgtgtcaccagagcaaatggccactcccctgcaccttagcgtccccatcaggctcctgggggtcatgatccaacagtgcaggaccatcgggggtaagagagtgtgcacacagtaggcactcatgcctgggattcagtgtggccacacctggagatgctggagagccctcgggtggggcatggtttgtgtttacagagtttgtttccccgtctgttttccccggactcctgcctgtcaaaccagtggtcgtccctctcctctatgacagtgcctggacccttggtgcccatgggctggcgtctggggcacagctttcaccctcctaagaaagcaggtctgtgttgcgggcggggcgtctgcagtgttgacagttgctgcctcctggtttttctatcttgggcccaccgtgggcactcctggagctgcacgccctgggcacacccactgtccggcccggggcagactcctcagcaggggccaggccctcagagggcagatcctcttggtaccaggacagggcccaacactgaagctgttgaaagacatttcccgaggccaggaagacctggctttgaatctcagctctgctgccctctgaatgcaccaccttgggcgcggtgaacatgctctctgagtcttaggtcatgctcgcctgttacatggggtgatgacatgcctgcctgatgcgcccgcagccgtgaggactgagggagaggatgcgtgctcaggaggtatctggaaagggcacagcagcaccagcacacggtggggccctcactcctccctgagtgcgagtgctaagaggcgtggggaggcgagaagcccgggacctttcctgaacaccttctgtcccaggcagtggtgtcagccctgggctcgggggttcctgtgtccctgacacctcggtggtgtagaaaggacccggccctcgctgctcatccaggccccgagagtccgagacaggatccatctctacaggcgtgtgggggttcaggacacaaggacacccaagttctagttcctgctgcctgctgcctgctgcctggctgtgggctcctgggtattcctctcctccagcaaggctatgggttccccattcacacaaaggggaaggtgctttcctcttttaagagcccttccagccctgttttgtgtgtgtgtatgtgtgtgtgtgtgtgtgtgtgtgtgtgtatacatttaggaggtccaagtgcggttttgttacacggatatattgagcagtggtgaagtcttgggcttgacattggagacccagtcccatcgtttcagtgcacacccaccagctccttctcgtgctcagagctgctccaaggggagaaagtgtctgtcctagaatgagtggcatgaggtgaactccaggcctgggccagacacaccaaaatcacttcctcccaggcctctgtggagtcagccctcacctctaagtcaccatcgggaccctgagagcattgttccgcactggcatcagccaagcatgctgacttttctcatcctcccaggaacatgctcaccacagagggtgagcagcaggtccctcctgttggggatccactggagacatagccttcagggagaggaaggggaggacagaaggtcctgggcattggcctctggctggaaagtgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccctccaggtgggtcacaggaatgcagccaatgtggcctcggtgactgtccccagagtaaccttctagaacagggcaaattgtctaaagaatggttgagactgaccatacaggtttcctcttcccagccagcatctggcccaagaccaaggccgtggccactggcttgtggacggagactttcaaaggtccagccctgccctggcctccacctcctagaatagtcgacagttgggccacatcctccaagcccccggaggataatgtttttcttctttcctgtggagctagctagaatttccactctgcaccaccaggtcttgacctagtaattttcaccctcttttgtcctttttggcacaaaagtttggttttcttccccagatcacatcatctgatgagaggttggagcagatccacccagggaatgaaaggccaaagaggtgggcaggtcggggcagcattttccaaagaggaggacgcagaccaccagtgttcacggtcaaaggttcaaggtcaaagcctgaaccttgaatcccacagtgagaaagtgactgtctcctcgggtctcaatccgtccttctggtgacctcctggggaaagtctctgagggtgctgatttgcctctggcctcctaagccttgccaatctccctctttagcagtagactcaggtctgaaactcagagtccacagcacatcactgtatctggccagaattgaatatgcatgactttgtttgtattttctctctttttttcccccttgagacagggtctcactctgttgcccaggctggagtgcagtggtgcaatcacggctcactgcagcctcgaccttccaggcccaagcgatcctcccacctcagcctcccaagtagctggaactataggctcaccccaccactcccggcttgaatttttgtattttttatagagacggggtctcactatgttgctcaggctggtctcaaactcctgggctcaagcaatcctcctgcctcagcctcccaaagtgctgggattacaggcgcgagccactacacccaactacttgtatttatttactgctcctccctgcctcctacaaacagaccccaggtctgttttcttaaatgctaaactacatgaatccttaaaatgctaaactgctaaggtcctccagcctcagtgttcttttcagaaacatggggctaagaaccacacttcagtgggtagctttgttcctgccatcttctttctcatccccatatcactgtgcggcttttgctctgcaacgacccttggtcttacctctgcccagcaggtgataagatctgggaacagagaggaaacagaggggaaacagagaggggaggtcatctccccgggctcacacagccagtgagtggccagacagggcctgaggcaagtctcccaatctgagcacttactggcagaggtgattcttcatctgtgcaacgggtacagcatcacgagcctcgtggagggaaatgaccttatgtccatgagaggcattcttcagtgagtgtggaccatattgttggactctaagatctggattattagtccagatgcctgcacagtacatatcagctgtgtgacctaggacaacgttatttcacctgctggagactcagttttctcatctgtaagttgggtggtaatacacgtacaagccttttagggttgtcatgtaggtgaagtaggagcccgccgtgggaagtgcagtgcctggtgcagcaagcagatgtcggctctgatcctccccaggatgaagggcccgcggctcacacaccctgagtcccgagcgcaccaggctcttccgggacactcgctcagctcatcctcccacagccttaggagtgcctgtgccacgcagatccaaacatcgaggacctgggaggtggagtggctcacgcggggtcacccattagaagaggcaaaggcaggattagaaccaaggcccgtgggagtccaagtgcgtcctctacccgctgctcagtgtccactctccagctcctcgctgggaaccctggagccacagtggggagttcagggatccgcccagccattcccccgctgtgtgaccccaagcacattccttcccctctctgtgcctcttggagttgcaagagagttgggaggggtgattctgcatcatgagcaccctcctttctccccttctgcagagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccgggtaagggcaggctgggcaaggggcagggtcccagggcagctcagcgctggggagagggcagatccctacccccaccccacacacctgcatccctgcaagctccagacctttggtgccttagcgatcctcaaatcctagcctcatcgaagaaaagcatcatgaagcctagagaattggggactcgtagcctctaggaatgaatctgaaaatcccagagtgttagggtcatggaatttggggatcttagagtcatgaatccttcaaatgctatactactaaggctggaacccccaggcactgggcactggtggggcagggtggggtgggggagtgaagggcacagactagagtctcactgcctgaatttgtaccagggcagccctgggcatgtgagtttgcccctctgtgcctcagtttattcatctgtaacatggggttaataatagcactgaggggtgttgtaagaattaaaagcatatccacaggaaacacatagagccatcctcagcacatgataagggctcactgaaagctaactatccttatcatcgccatcatcatcattatagcccttcacttagaggagccgcagcccacaacccctaagggcaacaattacacttaaatggtaaacagcagagggagcggcagtgagcagtgtgtcagacattctgctggaagcttgcacatattagctcagttaatcctcacaagaaccctcagtcaggcatttctctcccatgaagaatccaaggtgtacagagtggggagtaacttccccaggtcacacagtgaagaagaggcagagatcagcctggctcaaaagcctgtgatctttcccctccagaccctgggacaagggaggcactttggacatcccctgggtcacgtggagcctcattgcagctccatgcaggagacctgggccggtagcacaatcggtgttttcccgatgaagaaactgaggcacagaggtggggggagggggggtgatcgtggcagacctgggtacagctttgttcagcaaatattgggccaaattgcagtgaatgcagacagcccagcctggatcccacctgcccttgacatctgccccatgccctcttccagatccttggggagcccaagcagaaacgcaagctggtggctgaggtgtccctgcagaacccgctccctgtggccctggaaggctgcaccttcactgtggagggggccggcctgactgaggagcagaagacggtggagatgtaagtgctggctgctctagctttggggcctgggggaagcgggcagatgccggtgggggtagagactgtccttaggtaccaagccctggctgaaaatcccctcctctcatctcccacacagctgtgcccactcccagacaccctggggctagagttcccaccgtcacattctctgtcaatgctgacaccacccatgcacagatctgccacagacctccacagtgacatcatccgtcaataggcgctcacctgcagacacgtgcatcctcacatagacaggtatctgccctccgaatgtccacacatgagcatgcacacacatatgcatgcgtgggtgtttccacatagatacgtagctgcacacatacatacgagcacacacttcttttttacttttttactgtaatgtaacttatatacagtaaaaagcacagatcacctatgtacagctcaatacattttcacacacacggctacctgagcctatccccttgtgcccctaaatgcaccatctgcttttatgcacacggacacacatgcgtgcacaggcactgttcactctaggagggcagattgtccaggccccgcagagggccgagaatgaggcccattcatggacacgctgtgctgatcctcggaggtcacgtgacttcctggctggaccccagcatgcgggagccaggccttgggcccctttcctcaccaccccctctctccctgcagcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactc

SEQ ID NO: 35757 - DNA, 8330 bp, Homo sapiens
ggagtccagacccgacggccggcccagttccacgcacccagcgagcccaagcgccttctccgcaccaggtgggatccggggccccgggggtcttgaggacaggcctaacggcccagggctggagatgagaggtggcccgggcccgacccggctgtcacggggggcaaaggcgggccccacggactgggacgtggtagggtctgttgggcacggactgaggggtgagctggggcagcgagtttgctgggggccgacagggactctggccaggggccgggcagcaggaaggctgttctggcctctgagaagcagtggtcctgcggcaagggaaggccatcgtccaggccctgcccctttgctgaggagctggagatgccaagcccagagctccggggggggctggggagcccgggtacaagggtgctggggagagggttgcagtcgtcagttccccctggcccagtaaaggcatgtgtgtcacagatggagaaacagccctgtgggactccacgcccccacagcatctgtgtcccctccccatctcccatccctacaccctgggccaggggaaagggaccgagaccagggggcccttccgacacagccagtgctgtatgcagggacccgggccttcccctctctgggtcatctcgcctgtgggtggggaaggtctgcggagggccctgatggactcacccctagggggcaggacgaggactagtggctgggagaacctgatccctgctcttcccagccctccagctgctctaaggaggagactcagatgaggtgcactgagaaggaggcatctggcctgcccagctccaggggctggaggtcatgggggcactgccctgtgctggcttcagcccagccttttctgttatggtgggaatctggacaccaggatgggggacatggcatccagtcacatccaggccaagtatcagtgctgacccctggtgtctagggcacctgaagggggaagcgatggcctcagaactaaaggccccacccatgcctgcccctcgcccctccaccagttctagaaggcgcctctggatacacagagccctttcccactccactgccacaggcccgcctgaggactggggctccctgttttgttcaagcctcgagggcaccagcagccaagtttgctctccactgacccaaacctagcccaggaatcctgtcttccaggtggcccctccccctctcatgggcactccactccccttctggggcctcttttcctagctgcaccatgggggcacccctgcctccgctcaccacttcccacaattgctggggtggacatggcggccttgtgcaagcccttaagtacagtgctcccagccacaccacagcagagagtgcagaccgggtggccatgaaggcagaggggcccagctgggctcagacccagctgtgggtggcctggccatgcctgccctagagcttcatagagtgtggtggggacagtgatggccatcacagcctctgttgggcacagtgcactgcctctctgcatgcagccttctgtgggcaccaggagtcaaagttcccgagaacactggactcagggaaggactaggcccctctaaagcacgggagaggagggggccggcatctggggacaatggcactcccaactaggtcatgggtgagaaggaattctgtctaccttcctgaaccatgcaagaaacactgagggctgggtgtgtcggtccgtgggacacgggcaaccactgtctcatgactacaggcagtgatggccctggggaccagctggggctggccgggatcccagtccagggttgatgatctcaaaggccaaggaccgagaatgacttcaacagagtcatgggaggaaggcctggaaacagctcaagttgcaaccacacagcttggggtgaacaacaggcagaggaggcttcctggaggccctgggcccgggggtttgggcagagggaagaggggccgcagtcctggaacctcagccaggcccactgccccagccgagggaaggaggcactgggtcttcaggcgcatatccccacaagctgtggcaagcattcagggaaacagtcccaggcctggtctcagtttccccatctgtacagtagaagcagcagactggccgtagttgccttcatatagtcattcatcaaacaagcatctgttagcccaactatggcctgggattggtgtaaactgggggatctatgctggcccacaagggagagagatctttaagtgtttactgtggaagcaagggtacagggaacagctccctaggagaggggggcggtctcaagaactgggctggagaagaaagagcacaggggaggaggggaccacagaggaaagcctgggagtgtccagggaactgcagaggtcagaagggtaggattgtgggtcacaagagggacaccacgagggctgtcagagaggccaggagggactcacacagggccttgaatgccaggatgagggacccagacttgctctgaggggcggcaggaaccttcaagggcttcacaatgataggtgtaggtcagggtctgtatgggacagaagaggccggctggaggctaagaagccaggtctaagcaagggtgaagaagctggggttctcagcccaagcaagcctcacaccccgataagcagtggggagtgagaacaaggagtgggacccaggatcagtctgtgaccactcaccactggggggctggtcaagctccctgaggtggacaggcgggggtttgactgcccagagcctcctagaacctcaggcgggcagcagagggatggagtgggagagtgaggaacggcaggaatgcaggaatgctgatccagctccttcctgcagggccagggagcctggatggcagcccaggagagccctcactgactcccacgagtggacccaccttgtcacttggaaagagagagggacagtgtaaatgctattaaggattaaaggagataaagcatggtaatggttggcaccaagcccaatcctaagtgttttacccaaacagtcacagccaaaatagctgattccatgcccggcactgttccaggagctctcgggcactgagtcagttaatccctactgctgggcactcctcatgtctccagtcccagatgaagactctcgggctcagagaggtagaggaagttgttcagaatcacacagccacacttgtctgcttttgtgaagaactgggtggtgggagccccaaatccgtgggcagccttgaatgccaggccgaagtgctaaaagccagtctgggggaggcaggaagattccctggcccagagtcacagggccacccaacccccaccccttcctgcagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctgggtgagctgggacagggacaggggtgagatggatgaggccaggcaggctctgccaatcatttacagggcacctcctgtgtagtgagacgcgtggtgtccaccttagagaatagttgccattaacttagtccattcaacagggaaactgggccgggcgcggtggctcacgcctgtaatcccagcactttgggaggccaaggcgggcggatcaataggtcaggagatcgagaccatcctggctaacacggtgaaaccctgactctactaaaaataccaaaaattagccgagcgtggtggcgggcgcctgtagtcccagctacttgggaggctgaggcaggagaatggcgtgaacccggaaagcggaggttgcagtgagccgagatcgccccactgcactccagcctgggcaacagagcgagactccatctcaaaaaaaaaaaaaaaaacagggaaactgaagcacaaagcaggtccaccacagggtctgaacgtagacaggctgactccacagtgggcctgtcttaggcagatttgtgcactgggctgccaggtatcatttcatttaaagaaaggggtcagctggccaggcgctgtggctcacgcctgtaatcccagcattttgggaggccaaggcgggcggatcacgaggtcagaagatcgagatcatcctggctaacatggtgaaaccccgtctctactaaaaatacaaaaattagctgggcgtggtggcgggcgccagctactcgggaggctgaggcaggagaatggtgtgaacctgggaggcggagtttgcagtgagccaagatcacgccactgcactccagcctgggcgacagagcaagactccgtctcaaaacagaaagaaaggaaagaaagaggtcagcatctaaatgaaagtgtgaactgcaggctgcccactgcacagatggggaaactgaggcctagaggggcggccagaccagctcccctccttcagaggtcacccatctcaggctctcatagcctctctggtcccagtgacttcctcaggatcaggaccttagaactaacagggtacaaaaatcaagtccaattctctactgcagatggggaaacacaggcccagaggcaaggcctccacagaccatgccccaacccacgggcctgccccaacatccctcccaaagtgctggccacagccagccactctcagcccagttcccgcgtacccctcatgccgagtgacagcatccagaccagacactgcctgggggagggagagtccaggaccagaggacacagccccgtgacagtcaagcctcgagctttgaggccagagagtcagtccctggtagggccctgtgcactttcctcttcctgtgaaatggggccatgaccctgacatttccccacgaggcactgagcaggagaaccaggcaaacctgagtgggagaactgacagcacgctgcccccggccctgagcaccaaacctctccccgcttctggccaggctcgcttgaaggctccctcccccaggaggtcacctggcaggaagtaaactccagggttctttttttttccccccgagacaaaatctcactctgttgcccaggctggagtggcaccatctcggctcactgcaacctccgtctcccaggttcaagagattctcctgcctcagcctccccagtagctgggattacagacgtgcgccaccatgcccggctaatttttgtatttttagtagagacagggtttcgccatgttggccaggctggtctcaaactccagagcccatcttggcctcccaaagtactgggattacaggtgtgagctaccacgcctggccaactccagggttcttatctggggctttcccagcttcgtggaaggactgaggcctggtgagagaaggggctggccttaagtaccccagtgtcctggcgtcacagctcctcttgggcctcagcttccatggccatcccagggggacacagcagggtatgtgaggctcagggacatgaaaacttcctatttccaaggccacaccctgcacccaggcccctgaacccctgagacttcatgacagccctgggtgtccacccagaaaaacatgcactgtgtttgtagctcatatccgtgggtctgcaggtgagtcacacccttatcttcaagttaaaaacaagagcagcaaatataataataagaagaagccctgcaggtattatcttaaatctcaaagcaatcctattgaacagatacaattattcccactttacaaacaaggaaactgaggctcagagaggttaagtaatttacccaaggtcacacagctaccaagtagtggggctgcaatagaaacccagcagttgattccagtccataggcctgtgccagtcattgttatgagccttttgcaactactgtcttcacaattcccctaagagatggggaaaaccaaggtgcacagctgggatccaaacccaggcctgtctgacagcaaagcactgtgtctggactttggagttaggctgcctgggttcaaatgccaggtctactcaagtctcctccttacttgctgtctgaccctggacaagtcacctggcctctctgtgcctcagcttccatacctgtgaagtgggtaagaatgctgacttcacagggtggtgaaagttaaatgcaataaggcacgtggtcgaccagccacagcgagcagtctgcagagggttgttcttattacactttagtgagcactgccggctgctgacatccaggccacaggaggaaactggtgggagcagccagggactccgggcgcccactgctgtggctgcgctagagccatgctttccagttcacaaaacccactacctcccgtctcacacggagcggtgaagggcaggggtgggggacgggggtgcaagttgtcccagctggggacagagggcccaggaccacaggctggaacaccccacctgccacagggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtccgtggcgccccctaccaccactctgcatgcaagtggaacagggcccaggcattcagtgcctctgcccctaagggccagaacagacatcacccatctcccaggttctgtcaccagaactataaaagccaggccacctccttattgtcgccgcaaaggctaggccagaacagcccatgccccaagactcctgccttcgtgatctcccccgctggcccaatgcacattctccatctgttttagacctttccagaaatcaaaccatttcatgcctttcttgccaagaaggtatagaaactggcccccctcctcggatctcctaacggatattccatccctcagctcatttttcccagggacatgtcagggtgatgatggccatggtaacatggccatgggcccgcacgggcctgactaccttcacggtccctcactgcaatggcatacgttcatccctgttttctagattaaacaggcacacggaggttaaggaccttgcccaaagtcacatagctagggagaatgggaatcagcactgcaactcaggcagtggaactccagagctcacgcttaaaacagggcacacccaacaccatctgtgtgcacagcctcaagttccccaagtgacacctcggagacagtcccactgcacaactcctcccctcaggaccctggcaccccttcacgtgggatccgacaccccttcacgtgcacccccacacccctcctgccacgtcctcattcctcagactgaccagagactaagattgtatcttcccagcccctctaggtctgcaagagctgccagggggctgagggatggggctgctgtgtatgtctcagcccaagttcctgctctcacccaccctgcccctgcccgcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgct

SEQ ID NO: 35758 - DNA, 38046 bp, Homo sapiens
agtagagcctggtgcctgggagcggctggcgcggcggaatccagggccgacccgggccggaccgaccccaggcggcggtgagcgagcgcggcgtccgcccggggtgcaggccgggctctgcttcttccctcctgtggcgtcgcctggccgcgaaaggggaaggaagcggcggccgcagcggtctcaccgctcttccgcttgcggtttcgggggccggggcagagtggcgaggctttcccggcctggggcggggcagggcgagggccgggggtccgcgagggccacgaggacgggtctgggcccaaggaggccgggcagggggcaagggggcacggagggcttggggctggggtccgcggaggaaggttagaaaggggccaaattggggtatcagctctgaggggagggtccctgggcgccggggggctccagggcaggagaggggccaggctgggaggggtcttgggtccgagggaataggagagggggatgggctccgagggggagggtattagggcccgagggagaggggctgggcctgtggggttcgggggtctgagcggagggggccggggttcgaggggccaaggaaggtgggtgtggggggtctcaaggaaagggcgaggggtctgagagggaggtgtctgggtgcagagggaaagggatgaggtccgaggggaggagattggggtctgacgggaaggggtccaggcgcagagctactgggatggggtccgagggaagggaattggggttcgaggggaaggggtcggggctcggaggaaaggtatagggtccgaggggaggggattggggctccaggggaagggatccaggcgcagggaaaagggatggggtccgcggggtcaaggcggttggggtgcgcgactttgaggggctcgctgtgggacgtggcggagcagctggggatccgcccggcctgcacctgagcggaggttttgcaatcaggtcagtggaggcagcgaggcgcggctgcagctagtcgtgaggctctaaatttggaaccgtccctccttcggggtgtgtttaaaatcaccagaacggtgctttggggctttctgttacgtttccatcacctggatagtctaagggatgcctgatccctgaagctggaaggccttgggtgagaagggacagggcttcctcccgctggaatctgtggacgtttggggccccttggggaggaattcattttctgctgaaggaagctccggaggcatccggtgagcgctccctggaatcccatgcgctccctttgggctcagtgttgacttggctgcgcaggctctgtcggggggacttcacccactaggtccttcaggcatgatccagccctcaagcccggccgggcccaaggccgtggcgcaggaggggctggccgcctgcccctgtctccattcacgtgtttgaccgtgtgggtgagtcactggctccagagcactgagtcagtcctgtttctcctctggttagagaagtattcgccagatactcaaggaacaaggaagagtcttttaagtgggactcaataaaaagttggggaggcagggttgttttgatattaggtcccctagaactagaagctaaccttctgctatatcttactgaaaagaaatttcttttgacctggggcaggggtgcggtggctcacacctgtaatccctgcactttgggaggtcaaggtgagaggatcgtttgaggccaggagttccagactagcctgggcaacacagggagaccttgtgtctacaaaaaaagaaattcgctgggcatgttggcttgcacctgttgtcctagctacttggggcgctgaggcagaggatctcaagcccaggagttggaggctgcattgagctcgatcgcaccactgtactccagcctgggtgacagagcgagaccctgtcacccaggctggagtgcagaggctcttcacaggtgccatctagcacactgcaaccttgaactgctggccttaagcgatcctcccacctcagcctcccaagtagctgggactgcaggcccagctaaagctgacttttaattgtagcattttgatggacttgtttttaaaacacttttaaaatgacagcacacataatcggcaattcagatcttcagtctgtgccacgcagtaggtgctcagaaaaggtgtcctgagagtgtgaattgctgtgagcgctggttgctgccttgtgttgcagtattcccatggcctgggccagccaagagcaggggactgtgctccaggagcaggcttggctttcactgtggcccaggcccaccccatctgctcacgcactgctttgagtaaacggagtaaatgttgggggcggggtttcccttgagtaagtgtggtgtagggagtgtgcctgtgatggtgattttggctacgcaagtgtctgtttcctttctcctcctgctctgccatagatgctgaggctaatggaaagctgatggtggacggatggttctgtcctgtcatttaaaacattcttctgccaggctcggtggctcacacctgtaatctcagcactttgggaggctaagggcaggtggattgcttgagcccaggagtttcgagatcagcctaggcaacatggggaaaccccatctctgttaaaaatagaaaaattggccgggtatggtggctcacacctgtaatcccagcactttgggaggctgaggtgggcagatcacgaggtcaggagattgacaccatcctggctaacacagtgaaacaccgtctctactaaaaaaaaaaatacaaaaaattagccgggcgtggtggtatatgcctgtagtcccagccactcaggaggctgaggcaccagaatcgcttgaacctgcgaagtggaggttgcagtgagccgagatcacactattgcactccagcctgggcaaaagactgagactccatctcaaaagaaaaaagaaaaagaaaaattagctgggtgtagtgacaggtgcctgtagtcccagctactcaggagggtgaggcaggagaatcgcttgaacccaggaggcagaggttgcggtgagctgagatcacaccattgcactccagcctgggcaacagagtgagacttcgtctcaaacaaaaaaaaacaaaaaaaaaaagagagagaaaaatcagcttggtgtggtggtgcattcctgtagtcctagctactcgggaggctgaggtgggaggatcacctgaacctgggacacagaggttgcagtgagctgagattgtgcctctgcactctagcctgggccacagtgcaagaccctgtctcagaaaaaaaaaagaaaaaaaaggctggtggggggcttttaggcgcggtggttcgtgcctgtaatcccagcactttgagaggctgaggctggcaaatcacttgaggccaggagttggagatcagcctggaccaacataatgaaaccccatctctactaaaaatacaaaaaattagctgggtgtgatggcgcatgcctgtaatcccagctactcgggaagctgaggcaggaaaatcacttgaacctgggagacagaggttgcagtgagccgagatcgcgctgttgcactccaacctaggcaacagagcaagactgtctgaaaaagaaaaaaaaagttattgtgtagaggaatttttcactctgtctagacagcaagattacttcacgtttgtgcaatcttgatttgtacactgacgtttgcaaggaaggtttaatgttgaggatggacagagtcattatcttcttttgaaccgtattgtaacagctttatcgagatataattcacataccatacaatacgcctgtgtagtgtgtactctccactggtttttagtatcttcatgcagttgtacaactgtcaccacagtcaatttcagaataattttatcacctcaaaaagaagcccttgtaccttttagccatgacctccctatcctcaccaccaccatccgcccagccctgggcaaccagcaatgtatcttttgtctctgtagatttgtgaactccagacatttcctagaaattgaatcgtataatatgtggtcttttgtgcgtggttttcctttgcgcaatggatttgaggtccctccacgctgtagcaggtgtcactgctggatcctctttgtggcagaataaaatgcctttgtgttaggtagaccacatgttatgtatctatcagttgatggacatttggagtgtttctgttttttggctgctatgaatagtgctgttctgaacactcacgcacaagtttttgtgtgcttatactttatttctcttgggcatagacctaggagtggagttgctgagtcatacagtacctgagtttaaccttctgaggaactgccagaccttttccatttaacatccctgtcagcagtctatgaggcttccagtttttcaacactgttgctgagatttgtcattggctgttttattttagtcatcctagtgggtatgaggtgggttctcattgcagttttgatttgcatttccttggtggttaatgacattgaacaaacttttcctgagcttgttggccatttgtatatctcctctgaagaaatgtctcttcagatccttcaatcatttttaaatggggttattcgtcctttttattgaattataagagttcctttttttttttttttttttttgagatggagtctcactctgtcgccaggctgcagtatagtggcgcaatctcggctcactacagcctctgtctcccgggttcaagcagttctcctgcttcagcctcccaagtagctgggactacaggcatgcgtcaccacgccctgttaatttttgtatttttcgtagagacggggtttcaccatgttggccaggatggtctcgatctcttgacctagtaatccgcccgcctcggcctccgaaagtgctgggattacaggcgtgagccacctcacctggccaagagttctttatatattctggatctacagttcaaaatacttttctctcaggatcgtcttgtcaccttcttgatgaagcacaaaatttttaattttgtacaatttatttttttcctctagtgttttggtgtcatatctaagaaactattgccaaattcaaagtcacaaaaatttacacccttttaggattttagttcatttttgagttaatttttctgtatggttttgaggtagggctctagaggctttttatctttggatccacaaaacaatcaaacttatttcctattggttatttttgtgattgttttttaaatttccaatattgagagtataaaattgtggatctgagcctatccttagctgctcatgagtagatttttattatttactttatgattgatttatgtatgagacagggtctctctctgtctcccaggctggggtgcagtggtgtgatcatggctcactgcaaccttgagctcctgggctcaagcagttcccccacctcagcctcctgagtagctgggactacaggtatacacgaccatgcctggctaaatttttaggcagagttgtatagatgcttgccgattacactaataactgcagtaaccagaatgtagcaagcaatctgtagaagttaggattgccgaagggaactggggagagagatggagcaaacagttgggtcagaaaccagataggaaattaattaattaccaggagggccagccaggcaccatcccctagttcctaatgcgtgagaaaccactctgcctgtgaccggcttgttcctagggacaaggggatttcattcgtccatgtgtgttgtctagcagtatggtgtccagttgaggctgatgtgtggtcctagggaaggggtcgtgtgcttggccaccctctggggagctggagtcttgctccctgcgcggtaaccgtgtacgttcattaggaatgcagcccgcctcctcctcggctctccagctgccagtctcatgtcttgatagacagtcaccatactggtttttcctcccggccatatcatgatcctctcaaggagtgtttttcttatattattgttttaaaaagctcacagtaacaattttattttataatgtcattaattagaatgaataaaaagtgaaaatctctaagaattatggcaaacagtaaatgcatactagcaattaaggcaataatttctgtttgcattcataagaaacatcatgtaggccgggcgccatgcctcacacctgtaatcccagcactttgggaggccaaggcaggcggatcacctgaggtcgggagtttgagaccagcctgaccaacatggagaaaacccgtctgtactaaaaatagaaaattagctgggcgtggtggcgcctgcctgtaatcccagctacttgggaggctgaggcaggagaatcacttgaacccgggaggtggagtttgcggtaagccgcgattgtgccattgcactccagcctgtgcaacaagagtgaaactccatctcaaaaaaaacaaaacaaaaaagacaaaaagtcatcatgtagttagaaatcttttaaaacttatttctttagtttctctctgttgaacttttttattagtaaaatgcaagtcttcccatcctcctctcagatttcattacaaaaccttgttacgtttgggaagatttctgaagttttctaaaaagatctccacacagaagggtttgcccagggagctgctcaacatacatccttctcagctttttacccttaatctttttacagacggaatcagtccccaatgcctggaaattcctcattggattactgtgttttaaacagaatttcgtgaacagccttttatctccaagcggaaagaaaggtacttgtgcattgtgaacatcctaacattcttttcctgtggatggtaagggcaaaaatccctttaacaggaaacgggggaggttgctgtttctgtggatttactgggagagagatgataatattctggaaggaaatttcattgtttaaaaaataaagtcaggtttctgttgcatatgacttagaggagacaattgcagaaaactctggaattgaggaagagaaccattcctgtcctccctgaggggaaatctggccccttccccaccccatgaacatgggtggggcccccaggcacaggattgtgaagctcgcaagtgcccaccccgctcgctggtgaagctgtgtccgggaagatgagcagagactgtgctctgctaatctctccccgatgagcctgaaaaagtaccaggcaaagacacctgccgcctttctcctttgccttgggggtgaaggtggcctcgccagccctgcagggactcccatcctttcttgcagccaccttctcagtggtgggaaccatgggcagctgaagtcctgcaggcgggcagccccctcgccagggcagcatggtgccatggggcggccggagaccaagcatcccgtttctctttcctgcagccgttgcttcatttataaatgggcgcgttgggacaagatggactggttgtgcctttccgttctgagattctagttcatctgttttctaaaatcctggcaaaagcagatcactctggaaattcttgccatgctttgggcattgacagaaggttccaggggcactgttagtcctgctacaccccttggcagacggttcttccccaagagacaaagtcgcacctagaaatttgagagcacgctgccctgattggtccctcactgtcacattggatttggacttgagacccagccaggctggagggagaggagccagatgggacattctcaagctgcgaaggggttttgtccagtcctgattcagggcgctagagtcccaacatggcacctgagaaaaagtgaattgggtgtcctcagttcagacccctgggcacagcttatggttgtttgatttaaaataatctctcagttgctctgtggcctatgtgtaattgtattactatttctgtggaaaaggaatcacttctttttatacatagtttgaaaaaaaaaaaaaaaccttaaaattttatattttaccactgcagttacaagaattgtcttgttagggtttacagatgtgccattgttctgtataacagagaaaaccttccagtcttcaagggctgagggagaaggtggctgcccacttgcagagctgcctgatagaggaaaaggtggcattttatattcctgttttcttccaagtagagagtaaagcaattctccaataaactacttgaaacatttattaaattgtaagtctgaattaggaaaattattgttatggtttcagtaagcacttgaaatcaaaatgggtgcactttttaaaaatgtgtgataaaatacacataccatgagatttaccattagtaacatttagtatatttataatacataatccaaaatggtgcttttatttttggttggaaactatcatcatatgattgaacagaacaggaatatgttcttaatgaataaataagtgcacacacgacttttttattttccagaaaattttctcactcaaggtgaagccaaatagtatttccagtatatttctgacgtcaggtgacggcagtgttagaaccccgaggtgaaatttcttttactcctgtggttgtcagtcaggcttatggatcatgaaggattggctggtcctgcagcctcgtcctcctgggttgcctagaatctcggtagttttggccaaagggctcatctgctggcctctgtggatggcgccctgaggcctccgtaaccctccccggctgctctttcagatgtggaaagcttcagcaggccacgctgtgtccatcgcccaggatgacgcgggggccgatgactgggagaccgaccctgattttgtggtaggagccgccagcctttgctttcctctttcatgaagtggaagtggctctcctgggtttttctttgatggggtggtggtttgtctgtgtcacaatccaggctgtgagatttactggtcgcttttcttttcagaatgatgtgagtgagaaggagcaaagatggggtgccaagacggtgcagggctccgggcaccaggagcatatcaagtaagaggcgtcgccaccaccctcccgagggcccctctgcggatggagccccaggtgcaacagggcccatggtcatctgtggagggacagcccgtgtggaaactgcatttatcttcttgacctgatacccatgcagtaaatgaatataagacacacacatatatgtgtatttgtgtaatgtgtgtgtttatatgtgtatatttagatacttctgtgctcagtaatttttaaattcccattgcaaacaatttccgtatttataattttagagtgtccgcttctcagtattgtggcttttatcagggaacatttgtccctaagctctaccttacaagcgagaggtttctaaagtatgagatgtctgaataactgagaccttaaatgccctgtccctttttttattatctggaaatgattatgtgttaatagtgaggtactgtgagctttgtgttcttatcgaaagcccagagttgggcactgagtgaaccctgtcattgtttctcacttggcactatctaaaatgccagctcttggggcagttttttttttcgtcagaaagtgtagataaaaggaacttttaaaatatgctcagacttttattttaggccacgctgggttcagagtggatcctcctttccctggctgtgaaggcagcaccactgacccggtgaccgcctcagtatcccgggaagactgtcccgcttgaccacggtcccttcagctgagaaagatttagtccttcctccagaaaagaaggcacagcctgcacaatggctttttattttgttgttaaagatttatttatttatttatttatttattttgagacagggtctcactctgtcacccaggctggagtgcagtggtgcaatcatagctcactgcagctttgacttcctgggttcaagcgatcctctcacctcagcttcctgagtagctggaaccatgggcgcacaccacaatggctagctaagtgcttttatttcttgtaaagatgaggtcttgcttttgttgctcaggctggtcttgaactcctgggctcaggtgattctcctgcctcagcctcccaaagtgctgggatcacaggtgtgtgccgccgcacctggcccccagtggctttttatacacaagttttagtccctctctggcttgctcagcacactcccttccacagaagcagcttcggaactccggtggccgtgcggctgcccaggacaagagactggaatggggctgacttgggagtccactgtagccttgggtatttgctatggcgttaagcagactcctgaattcgttgagtcatcatacctcttctcatctcttctgttccctgtggcttcaaaacatgtctcggagggtggcttggagaaaaaacaactctccagtacaaaacccttgggctggttaggattcagagaggaacacatggggaataagcccattcttcatgctctggggccttcccaggttttaggagtggtgtctttctttctcctgctcataagggtattgggcggtttccaagcctggtttgtatttcatcttcaattctaggattgtcgtccagatgtcaaaggtggcgtcctggtgtctcctgggcagaaagtccgaatgccaaagtggccttcttatcactctggggtctctcaatgacagctgtgtctggcctaccagatttgagcaaaccttgtcatctgtttcattatctgctgtattaaaattttttaatggcatttagatgttaaattctgaaacgctttcctctcatctttgaatgtataaaaaagctggagtacttcaagtacagacgaatcatctgaatgttcagcaccactggacttctgccagtggccgaggaagggaccatagcctcgtgtttccccctctacctctggatgattacagactagctttcctattttctgcgtgtgaaataaaggtcaggcttcagtagagccatctttagcggggatttgggatgatcccagtgtctgccttcagattcgtgttctgtctcccacagagcatgcgtctgatactgcagactgccgaagtgggtgtaccagccggcagaatagtcaggaaggcacagtgcagggagagaatcggtgaacatcagataagcagatttacaaatttacaaagataatgtcacctgttcttatttatcataccaggaggcaaagctgcacgtctgttttattgatctgttcctattttcatctcttccatcaagcatacacaagctgagggagaatgtctttcaagagcatcagacccttaaggagaaggaacttgaaacaggaccaaaagcttcccatggctatggagggaaatttggtgtggaacaagaccgaatggataaggtaagtggcccgcggctgcctatgccaggctcctggtgtgcttggaccactagactgggtggcagagtcgtccctcagtctttccttagatcagcagttttgagtccatctgctgaggttgcgatttgcccggagtagacccctgttgattggacttactcatgaagtactctagctttcttcaaagctctttaggaatcctcagaggtgctggagcacgggtgttagtggggaggcccagagagggagattggccctcagaggcagccttgtgataggacagaagtccagaagcatcctggctctaggtgtcatcactgtcaatgcctgtggttccagtctgtagcctaagtcatgccagtccgaagaccaaagtcaaatctgtaggtccccatggttcacagcacacacggaatccagccaaaggcctggctaacatccttcatgcgttcagtgaccatcagagcagtctccctcgtgtaaattcggcgcgtaccaggctggggacagtgctcactctattcgagaggtctgggcaagcctcccagcagctgtcattgatgggatgcagactgccacgcagacgttgattgaggacgttggccaaatgcatccggctgcacccgtgctttaggtcctctctaccttaagaaagggagccacgttagctcaggagggctaccttttccttcctggagagaagatggaagagatcgcagtgtgtttgcatgtttcttcagtaaaacagacatcctggaggtgaacttttgagtctgagcaacataagcttgttctgacctgacagatgcttgcctttactctgtggaaagaagtgtgttagccagtgtcggattccagccggtaattccatacccctctcccacctcatgcaccagccagatgaacatttgagctgggcacgggatgatgttgccgtgtcacagtgagctgcaccttgctctgtcccccgcagagtagatgatgtggtgggccggcagggcaccccaaaccacgaccataaatagcctgggggaggagtggggtgagggaccttctgcaggaaagagacatggatgttgctgcgtcactaccacagagatgccctgacaccgagaagagcaatgtgtgcagaatcatcatctttggagtctaaaaaaagtctggtagcttttaggagtgtaaacaggcagacggacccctgagttcagtgcagcgagcgaagcaagtgcacacggacagacggaatccatgtgttcagtgcagcgagcgaagcgtgtgcacacggacagacggaatccatgtgttcagtgcagcgagcgaagcgtgtgcacacggacagacggaatccatgtgttcagtgcagcgagcgaagcgtgtgcacacggacagacggaatccatgtgttcagtgcagcgagcgaagcgtgtgcacacggacagacggaatccgtgttcagtgcagcgagcgaagcgtgtgcacacggacagacggaatccatgtgttcagtgcagtgaacgaagcaagtagataggagcctttcccactgcagactgaggcgagccctgtgcttagggggcttgtggggagttagcgcagagagacatttattctaaaaatggggctccctgctgtgggttgggaaaattacatattggggaaaagaaaggcaacgtgtcaggagagcctggtagggaagctgctgtggcttctctgctgctgctcggcctgcaccttttttcagcgcgaatctcgctcaccctagaacctgcagctcaggccttcccgagtgccaggagctccctggaagagccctcacttccctctctcctgtgcggtctccacagcagcctctgcttccctcatgagctgtccttgcctcatcctgctgtccttcccagggagactcccctccgggctgggcttttcaagggtcgggacttgtcatcctcaccttgtgcctggctcagtgccacgtgccccccccttaggccagtgctctcatggaaccaaggaggcttatggagccttgctctcacctctcagccggcaagttggagagctgtcctagcagggcgagtccagcaagggatgctgctgctgctcagtcccagctggcatcggggccaggttagcgctcagctcaggtcagcaccatgggacagatacgttgtcaaaaataactcagggccaggtacgggactggcacctgtaatcccagcattttggaaggccgaggcaggatgatcttatcagcccaggagtttgagaccagcctgggcaacatagcaagaccctatctctacaaaaacataattaactgggcatggtggtgcacacctgtagtcccagctgcttgggaggctaagctgggaggatcacctgaacctgggaggtggagactgcagtgtcctgtgatcgcaccattacagtccagcctgggcgacagagagagacgctgtctcaggaaataaatagattaaactcagattccaaaccgaaggggaaacggcttaagttatttgtaacttgcccactccagaaactaaaaaaaaaataaaaaattgaaatctctgcgttaagacttgaggaatatgtgctagagacttccagaacaaaagaagacattgaggacaagcacacgcgagaggagcctggacgggctgtcaggattctgtttatgctggggcctgagcacactgcacctttcccttgcggccagcggtggctgcatccatcacgcggggcaggcttccttcttgatcccttgtctccttgcatcccgtagccctgagtctacatattcaggcttcaagatacaatctccccagcgtgattgtttaataacagattttgtcaatgtgaaatcgaaggcaattttggagatgaatccctttcaatcaaaaagctggaaactttgcctagttgtcattctgggcatgtctttagatcagttttcctgtaacttccttctgatgaaaactcatgctggggaatccctttggcacgtctgcctctgccactccttcatctctgttttctgggtgagaccccggaggacacggatgggcagtctctgccacagagggtttggaggtgatggctcatgtggaaagagagtcagctgccaacctcaaaacaaacgtgggaagaagagggcgcagcacaggcccaaggcttagggcaagacctgctttttcaataggggaaatagtggacactctctgagttgcctgctgcgtcagcaccggtgtgggatgctgcttgggttagcaggttagcatgagtggctccacatgctagagggagtgagaagaggggtcccgatgtgccgtggactttctccacgccctctgctgggccatgtgcccgcactgtctgtgaaggagtccttgacccggctctgctgtgaggagggagcctcagaaccctggggcctcggtgtcaggactggagcagggccagtgctttgaggtaggagatcttttccactttgtggaccagagggtctctcaatagaactgccgaacggagttgctgaatcacacaagcagctgtggacagcacacctgtgaatggctgtggctgtgtcccagaggcgttatttacagaagagctgggtgccgggtctggaaagcccaggggaaccttgggctttacctgctggctttggcgaacagaaggtccccaaacctgtgtgcgctgatgggggctgacgacattaatgatgctgaaatgagctggcatgggagccggcagctggctcctgcctgaacagggtgctgctcagcggaaatccagtgtgagcctgtgtcttgcagactatttttgtttatagtctattagaacaaaatagtttgctggcagactattttttgtgccgattctttggtcatgtgattcacagaggtcccacttcagtagatgccagcagtctccacaccagcgggtctcacggatcctgccacaggctgccagctctgtgtaccttcttcatgcccggtcgtgtcagaaatccccactggtggccccgacctgtgtccagggttcgtgtgcagcttccaggagcccaagggctggggtgggccgtgaaagcctgcaccaagggctgggcgcggtgtctcacgcctgtaatcccagcactttgggaggccgaggcgggtggatcacaaggtcaggagatggagaccatcctggctaacacggtgaaaccccgtctctactaaaaatacaaaaaattagccaggcatggtggcgggtgcctatagtcccagctactcgggaggctgaggcaggagaatggcgtgaacctgggaggcggagcttgcagtgagccgagaccccgccactgcactccagcctgggcaacagagcaagactctgtctcaaaaaaaaaaaagcctgcaccaaggacccgggcctcccaggagtcgtgtcgccttccttggctccccagatgggtgtgttaatgtaaggtttccctgcactgaccaggatgtggcctcccccagccctgctctgggaggaagtgaagcgccgcagtgttgttggtgtctaatgctttgtgtttgaaccctgttccagtcagctgtcggccacgaatatcagtcgaaactttccaagcactgctcgcaggtggactcggtccgtggcttcggaggcaagtttggtgtccagatggacagagttgatcaggtgagtgatgtggcactgggactggggcaggttggggcaaggggggcgttccccgtagatctgagccctgttgggccacttgtagtagcaggcaggtgccctccagctctgggggactgcagagaggggcatctgcctcccaggatgctctgagagcctgggctctcagagagaggaagcaggatgcggcgggcttgctgtagcagtccctgcggtcgctcttcactacgtgcctcagtactggatggccctgtgtctgtcccaatgtgccagcagggaccgtttccacccgtgtttctcacatgtgtgttactgtgacagagtgacatcagagcctataccgggggggcaggatgcgctcgtgtccaggacccaggctttgcgtccaggtgttgttgcagtcatcctaggcccgagcctctttgattctcttcggctcgggtctgttggctcttttgtttaatagaggagcgatcaggagcctggagggagcagggagctgatgctggtcgcagattgtggctttgtgacatattagccacggttctgaatttatgtgtctgtgaaaggaggatgatcatacctatctcacgggtgtttgctcagatgcccatcgcagtgcctggctggtgggagtgcacccctggtggccactgctattctcattactaatactaatgttctcagcatgacttatttgagaagcgagtttttgtgaagcccgtggaatgaatcagctgagcattccctgctgccgcatgctggggagggcaggtcaccagggatatggcttggcctgcgccgcccactgggccttgcagtgggcctgtccgtttaggatgccagagctcttgcgtcactgccacctgcacctggcttaggaacccagaggtcacagcatcatgtgtttcatatttttttaaatgtcatgtcatgaattcagagagattgtttcagggacattggaaagtatttctccccactttttcatgtgtttttggtcgtcacagtctgctgtaggctttgaataccaggggaagactgagaagcatgcctcccagaaaggtaagacgcgaaaggtgcagaaagagcccgctccgggggccccgatggggagagtcacagccacctgaagccgtttccccgcgctccgggggccctgatggggagagtcacagccacctgaagccgtttcctgagcggtggctgttgccacaaggaggactctgccctcctcttcatgtttctggatcatctggataccacatgatggatgtattccccgttacacatccccctcggagccctggcatctgctgtcattgtggggcttctcccccttgtagcggaagccgccttcccttcatctgggcagcgctcctcctggaaaagagagctcacagattgatcggcagaaagctaacttccccccaaggctagaaaccagagttgttaaattcttgttttccttatacacatacggtcttaactgctggtgattaatcttgattacatcatgcagtctcttttttgaaagaccaaagcatatcgccaccttaaagttctcagtttattttttgcaagcttatttagttcttcctcctttgtgtcattgcatcatccgcggaacaagctctcagtccttacgcagtctcggtgcagtctaggtggaggtagctgtggtgtgggcaggcggaggatcagggtcttgtctcccatgttcagctgcatggctttcttcatatgaggctttctctttccatttttttcattttgttttgtttgtttgtttgttttgagacagagtctcgctctgttgcccaggctggagtgcagtggcacgatctcggctcactgcaacctgcgcctcctgggttcaaacgattctcctgcctcagcctcccaagtagctgggattacaggtgtgtgccactacccctggctagtttttctattttttagtaaagatggggttttgccacgttggccaggctggtctcaaactcctggcctcaagtgatccgcccacctcagcctccaaagtgctggttctttgtatgaagctttccagcttttacctgagcagttgattttcaaagtgggcatgcagcgtcatttctgactacacaaaggaactgccctgtaacagctgacagggcccagaacccccccatgcacctgttgtgaaacagggtccagcgtcacctgtatggagcagtgggtggcttgttgtacattttaaaatgtgcgcttgatgtgtttgtgagttgtaacccctacacacttttgcttagtttaacaaaaggaacagtgtagttcgtcctcaggcccccgtgctaattgctgccctgtctctccagactactccagtggttttggcggcaagtatggcgtgcaggccgaccgagtagacaagagcgcggtgggcttcgactaccagggcaagacggagaagcacgagtcacagagaggtggggcggaccccacggtctgtaatcacgcgtttgctccagaaacacccacgagggcattttctctctgcacacgtgattgttgtagattttttaactgaaaatgtttggtgttcttttcgtaccagtgtatgtgggcttttcctaattcgaatggctgcacagttccccatcgtatgaggattccatagtccatgtaaccattccttttttgaatgtggaatttaggttatttatttatttatttatttatttttggtagagatgaggtcttgccgtgttgcccggactggtcttgatctccgtggtctcaagcaatcctcccccaccttggtttccttaagtgctgggattacaggtgtgacctgtaaattttttttttttttcttttagacggagtctcgctccgttgcccaggctggagtgtagtggcgtgatctctgctcactgcaacctccacctccctggttcaagcaattctcgtgcttcagcctcccggctagccgggattacaagcacacgccaccacgcccagctaatttttgtatttttagtagagacggagttctgccatgttgcccaggctggtcttgaattcctgacctcaggtgatcgccctgccttggcctcccaaagtgctgggattacaggtgtgagccactgcgcccagctgaaacttgactgcagggaacattcttgtacctgtgttttgttcacaagtgattattcaaaagaatcaactcctagacatggaattgctgggtcgaaggctattgaatgtaaaatttccatagatactgccaagttgtccttggaggctgtgctgagttcttccttccccactgcatagcctgtacaccatcactcagagcgtttcccagggctgcagaggctgtggcctgcctgtttccctgtgcctcttgtttggcctgcacatttaaatttttaaaaatatttgccaacatttgaaaagtgagagcttgactatttaaaaactcaaaaaaaaaaaaaattaccccaaagcaagaaacaccactggaagatccgaccatgctggcttggcatttccctgaggaaagtgccggtggcctggagggcagcttggcttgtagtttgtcgcggcctggcctggccttgccttcctgccggtcaggccttgcctgccgcacagagctgcttgcctctgctctctgcctctttcctgggaacagtccattcctcctcttcccgacaccacacagttgtgagcagcgcatgctccgcgaagctgcatgagtgtgtgactccagggagccagggagcacaggccgagcacctgggcagacgcaaggctccttggatgcttcaggccttctctcccaggccttgatcctctgccttgtgctgttagtgggtccatgagagagtcatgttttggtgtcacagtgacatgctaaatggcttcattctgagtagaactgaagtttctggaggatgctgtgtgtgtcctatttcctggcatccccctgcgtgcttcagtttgtgaagagtggcctttgaaagccttgcccttctgctgcctcctgagcttagagccttatcataaactctcatctcctgctagcttctggatgcaatggatgatgttacaggaattcatctgctgtactttatttcttttttttttttttttgagacggagtctctctctctcgccaggctggagtgcagtggtgcgatctcagctcagtgcaacctcctccttccgggttcaaacaattctcctgcctcagtctcctgagtagccgggattacaggcatgcaccaccaagcccagctaatttttgtatttttagtagaggcggggtttcaccatgttgcccaggatggtcttgatctcttgacctcatgatccgcccaccttggcctcccaaagtgctgggattacaggtgtgagccactgtgtccagcctctgctgtactttaaaaaaaaaaactttttttcttaattctttttttttttttgagatggagtttcactcttgttgctcaggctggagtgcagtggcgcaatctcggctcactgcaaccttcacctcctgggttccagtgattcttctgcctcagcctcccgagtagctgggattacaggtgtgggccaccacgcccagctaattttgtatttttagtagagatggggtttcataatgttggtcaggctggacttaaacccctgacctcaggtgatccacccacctcgacctcccaaagtgctgtgattacaggcgtgagccccctcccccagcctgttttttgaatttttaaaatattagctaatgatttaacttagagatggggtcttgctatgttgctcaggctggactccgcctcctgggctcaagtgatcctcccttctcagcctcctgagtagctgggctgcaggcacacacccccacctctggttaccactgtttgtgtttctgttattacacataaatagcacctttaaatactgtctgtattattcagtggtcctacagtggacctgaaagatttttgtttttttaatcaaaggataaaatacttgcatgttcactgatttcgttgctccttttaaagtagtccttttttgtttgtttttagattactccaaaggtttcggcggcaaatacggtatcgacaaggacaaagtggataagagcgccgttggctttgagtatcaaggcaaaacggagaagcacgagtcccagaaaggtgtcttccgttttatcttaccctccagccagcagctagtaatgtgacaggtggtagccacaccggaaaaggaaaaacaaagcgttattgatagcccttaacgtagatgtctctttttcatgaaatgcccaacttgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacctgttaatgatgggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaaggtacattcactctgcctgtatgcgagatggttttagaagtttgtttttgttccttgcggggtcagttggtatgtgttgtgtctgcgtgtgcctgctgcacattgttttgtcttcactgtttgaagttgtcctgtgtgcccccccaatcccccagttccctccagctagtgtagtcacaaaccctccctgctgacacggggtggtaccccagagagctgggtttacctggaagtgggttgcacgggccaagcctgcagcagggggctgggtttacccaggagtggggacatgggtcaagcctgcagcggggggctgggtttacccgggagtgggggcatgtgtcaggcctgcagcggggggctgggtttacccgggagtggggacatgggccaagcctgcagtgctcctcatccaggcttcttgtctataaagtgggccacggtttttggcaggagatacttacttttgaaccgaaagtgttttcttgttggaatgggtgccccttccctggaaaaaggagcctgagggggctgaaagcctctcagtgtgacccagccctgagagaagcaggagcggggctaatggggctgcagcgccctccgaatctgcagggtctctcctcccgtgtacacagatacgcacactcgtctgcagtgtgcgtaggacgctaagaatgaactgcacagccgggagtgcctttactgaattatttgaagtacagttcttaggctgttccagatcttcgctgaatgttcagattttaagttcattctttaacgttgacctctggagccaccttctggcgctgagcctgggagtaggatctcaaaggccctaagctcaggagagcccttgctttctggaaactgtgtttgatttttgcgcatgctcatgcaattctaacccaactgtgtttcctcttttggttgttttccccaccgttgcttgtggattttcagattataagactggttttggaggcaaattcggtgttcagtcggagaggcaggactccgctgctgtggggtttgattacaaggagaagctggccaagcacgagtcccagcaaggcacagttgccaccagcctcctaccctccccccgaccctcctgtgcggccacttctagcacagacttcagggctcaccgtcagcacctgcaacacagtcctcctgtgtcaccacttgtcagctgtcaggctgttcggcactttaaacccatttctagtagagcgacactgattttgagtggttcactttcttccctgtgaacttgtgatctgtgtatggcaggatgcgccagttagtgtgtgggtgccatctttctaacccggtgacccatccagtctctggactggggcatctccggtctccagcagcattctgcccgaggctgttctgctgttattggtgactgccgtgagccactgagtcaggccttccagatgaggagagaggtgttggttcaaccaaaccactggccatttgaccaggggcttcgtagcagcaagggccaggagacaggcgtgttctgtgtggtttctgtgtttcatttgtggtggtgtttttggccggggttgggaggttttttgtttgttctgtttgatgacaccatatgtgtgtaacatctccacacagagccacacagtatgtacgtgaagccagctctgcatccttccttagagcagttatgttgttaccttcaaaatttggacttggttattagaacctgaacacataattggaaaaacagtaattccctaaccttgcagggaagactctaggctttccacctgcagcgttagaaacacacagcagtgttcaggtgtgggcaggtagacacacctggggtggtcccgcagactgcatggagatggcagtggctctccgtggcatcactgctgcatgacagtgtgactttcatgtggatctgtgttgctgcaacggaagtctttggctggtagaatttccacatggattttttttttctcttaaaaagcaagagaacaaactgcgattgagcctctttttagcgctcagtagagcaggcgcacaggaagcagatgagaataagcccgtgctggtgcggaagactgtgctattgaagtggcgcgttgcaaaggcctgtccgtgccctctttcctcgcttagctcctgcctgctgcccgccgcccctcctgcccctcctgcccctcagggaatgctgaagcctctgcccctggcctgtgctctgcttctcactgcctgtgtctcacgaccatgggtggaagcaaaacttgccttgcaagtgaagcctcgcttggccattctcgtttcttcccgctgtggtgcaccttcttgggctgtttctggatctgtctgcatgcacccacggccacccccatgctcgcctccacctcagagtaagtgttgtgttttgccacgtttcagactactccaaaggattcggcgggaagtatggggtgcagaaggatcggatggataaggtaaatattccagccccggagcttagtgtcttctgcctgcaggggctcttggtgggcgtggctcaccgtgctggccaacatccacgcgctggggtggggcacaagtgatttccgtcgtggtggtggtggtggtggcgatgactgactcggacagtcttgtgctcctcatggccgtgctgtgggataggcgctggcaccggcccacctcctaactgggggccccaggccaggcaggctcagcacctggctgcagccataggaacccagatgtttaacatgagaggtgagagcctcgagggctcatgtccatttgaacttaaattcttaatagtaaatcagattggaacctgagtgtgttagactgcgtgtggggctacctcgctggcagccagcgctgcgtgtgcggtgatgagccatgtctcccgtcttcagcctcgtagagacgcgggctccacactgcctgctcctgcgcgtggcctgtggtcaggggtggcagggtcagtccttgcctcgcagctgaccacacagcaccatccaggggcgtaggcaggcagagcaggtgttcgggctgggctccccagggagcagtagcctgggctcatttctgagggcaggcgcgagttcaccaggagagaaggctcaggagaccacggaggggcgaggtgtgggcctgggtgggacaggagtcactgcaggttctcaaggagcctagctgcagagggagggtggggagcggggatagagctggccctggagagccccacacaccacagagcattctgcatgtcgtgacatgcgtcacacaccacagagcatctgacgtgcgtggccccagaaaggttagcaggcaaggaacactgggggggtctactttgagaagcccccggcctcagcgtggagtctgggttgtgggggttggcctgggcagaggggtgtggtcctgaagagagctggaggggctcgggtggtggagaagcagggcatggtgtttggcgccaagggacgcaggggagggagcagtcgggtggatgtggggtggacgtggggccaactgtggagccgaagaactgggaggagcagatgtgggtgtcagcgagagagagctggggtagggccggggccgggtccgggtggcgtgcagagttgggaggggagtaggcacgcggtcagaggacactgggcagggggacccagtgaggtagcaggggccttgcaaggcactgggacagacggagggaaggagctcccctgtgggtgagtcagaggttgtggctttgaggccggaacctgagggactgcctgtgttgtgggtgtctgtggtcagcattgctggtgttggcggtgaccgctgagcttgtgagcacgtgaggaggcagtgtgtgggtgtggcctttcgtgtcattgtctttcatccaggagggggtggagcttctctctctgtttgctgtgtgatggaggagtccaaggcttagagagggtgacgtaactgcccgggtccccatacattgtggggatagggctacaacccaggctgggaggtgaagttgccccctcagggcaaggtgatgtctgcagagggcccagtgggtgatgggacccagtaaggctgatggccttgcctttgaacaggtgcaagcagctcaagggacatggagtagacgctggagctgactgatgggaggagggagcggggtccgaggaaggacaggcgggccaggaagggggcaagcaggaggtgctgggcagaaaggggccatggtatgggggctctggtggcttctgagcctcaggtgttctcatcagaggtagtgaaacccacagtgaaactgggtacggccactggtctccatgagccctgacagtctccacctgagtcagcacgtaagagtcatcgccgtcgcttggtcagaccatagttgagtcccctgcaatgcagaaaggtgtgattgcaccactgggtagtgtgtaggacgggccactggaggcttgcatgtgtccccagcgtcttcgcttcctgtaaatgctcacacctctgggtggcgacggagggtggggaaggcttgaggctgatcccagaattggtttgtggtagagcagatggagatacatgcatttcttatgctaatgctgacccacgattgcctgcaaatgtggttggtaatagttttcatgcctcagttagtttgcaaaaccgagaggccatgaagagtgctctgggctgtgtggctgggcctttgggaagatctggggaaggcatttgcatctggcaggagctaccacagggcatggagaaaagagaaaagtgctctcctgacgcccatgtcctgtctctgcagaatgcgtcaacctttgaggatgtcacccaggtgtcctctgcctaccagaagacagtacctgtcgaagctggtgagtcccggctgataccaggagcaccgtgtggtttcccaggaaaacactgaggggaaggacagttgtgaaacagccaggagcagatgcaccactagttgaaagcgtggttgttgctgcgtatttttgggaaagaaaatgatcgttctgatgaagatcttgtttctcctgcagaggtttagagtcaccttttagacgcagcatggtgcagccgtttcagtggggcccgtttcaaggggctcttcccagagcaaaggggctaagtgcacattcacaagggcctccacactgccagtgaccagcttctgggagcagctggggcctgcccaactccctgagccgctcggtcgcagctgtgacaggaggaagacatcatgacgtcgatgtgcaggcgacagcagacattctctctgctgctcgttcttgggcccttgacagggagctcgaaacctgtccttttctgtgctggacacacgatggagtcagatgtgggccctgccccggagagtcaagtagttggggaaaatgttatacatacatgagagcaagtgctaaatttaacacaggatgcagagagccaccactgacttccttcaggggctatggacccacagttctcagagattgagggcccaggacgctttgacactttgaccactcgtgagaacccccaagatgttgatgtatttgatgacattgactatattagaaattagaggaatgtggcccggcacagtggctcatgcctgtaatcccagcactttgggaggccaagacgggcggatcacgaggtcaggagatcgagaccatcctggctaacacgatgaaaccccgtctctactaaaaatacaaaaacaaaattagccaggcatggtggcgggcgcctgtagtcccagctactcgggaggctgagacaggagaatggcgtgaacccaggaggcggagcttgcagtgagcggagtttgcgccactgcactccagcctggatgacagagcgagactccgtctcaaaaaaaaaaaaaaaagagagagaggaatggtttatttatttatttattttgagaccgggtcttgctgtgtcatccaggcaggactgctgcctcagtctcctgggctcaagcagtcctcttgcctcagcctctggagtagctggaactataagcgcatgccccctgcccagttaaattttttttttttttgagacagagtatcactttgtcgcccaggctggagtgcagtggcgcggactcggctcactgcaagctccgcctcccatcccgggttcacggcattctcctgcctcaagcctccggagtagctgggactacaggcgcctgccaccacgcccggctaatttttttgttgttgttgctattttttagtagagacggggtttcaccgtgttagccaggatggtctcgatctcctgacctcatgatctgcccgcctcggcctcccaaagtgctgggattacaggcatgagccactgtgcccggccaaatttttttatctttagtagagatgaggtctcactgtgttgcccaggctggtcttgaattcctgagctcaagtgatccacctgcctcggcctctcaaagtgctgggattacaggcatgagcgacattggaaagttattaattggttcacttaaaaagaataaaccttggccgggtgtggtggctcatacctgtaatcccagcactctgggaggccgaggtgggtggatcacctgaggtcaggagtttgagaccagactggccaacatggtgaaaccctgtctctactaaagatacaaaaagtagctgggcatggtggtccacgcctgtaatcccagctactcagaagactgaggtacgagaattgcttgaacctggaggcagaggtcgcagtgagccttgattgcgccactgcactccagcctgggcgacaacagctaaactccatctcaaaaaataaaaataataatataactggccatgcacagtggctcattcctgtaatcccagcacttagtgagaagaccggcattgttttgttttgtaaatctctttaatagaagatggctgcactctcacatctgcctctgcagtctatcgatgttacgttgtttaggaagaacatgtggaatcacctaggtaggcgattgggaaagggaggagtgtttgtaaccttgagggcagcgtgggtgtccttctgcgacgccgcccaagcgtgccaggcagtggtggtcctgcaggccggctcctctggccctgtgagggactcgctacccactgtgcttgggcagcactgtgtgttggtcatttggaaaatgctgggtctctgagttgtgctcgtcttccagttgtggacacttctcattccacaataccaaaaaaaatcacatttgctgtcatcatctatttcatctgcagaagctgagtggaaatcagcatgttcatgtggcagcctcacatttttcaaaattctgtcttttacttgaaagctggaattttcccgttggcaacaaatactccagtaatttttcttgacacaataggcttagttcattcacttgggagaaaactgttgccagatacccagctttgcataaccatagttggactgtcagttgttatttcagggaaaaacgctattccatgagaaaacagtcaacttgcagctctcatggttctattcatggtccttgagacacagacagccaccgccacagtcccggacacagcagggaaggctcatgtgtcttcccactttttttttttttttttttttttttttttttgagacagagtctcgctctgtcgcgagactggagtgcagtggcacaatctcggctcactgcaacccctgcctcccaggttcaagcgattctcctgcctcagcctcccgagtagctgggattacaggtgcctgccaccaagcccagctaatttttctatttttagtagagacagggtttcaccatgttggccaggatggtcttgatctcttgacctcgtgatccgcccaccttagcctcccaaagtgctggaattacaggtgtgagccaccatgcccggccatattccccacttttgacttaaatttttatcattttttcttaatagacacggggtctcactgtctttcccaggctggtctcaaactcctgatctcagtcttcccgtctcaacctcccaaagtgctgggattacaggcatgagccactgccctcttttccatttttgtcacacacaatataaaaaaatgtatactctggttgagatttactatactcagtatacgtcaattacagtatacatcagtaccttaactgctttatcaaggacagatgtctttaagggaaattggctgtttttatttaaaaaggtgagtgtggtggtgaagataccgtcttatttagagatcttcctgatgccaggcttagggggattgccagtcccaccaggtacgcagtgccctgcggcaggtgcccagtgctggctccggaccagtgggctgagctggcagctgcaagaacctttccctccttgggggttagggggatgaccggttcctggggaggtcactctgtgtgggtggggctgttgtccaggagcagtgtttttgctgtgctcaaggcacacgtcctccctccttcctctatagtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggtgagtggcaaggagtgggccgcagcgcaccctccctgggacctgtgccgaggggattgggagctctggggcctgggcggggcttattctctcctggccaggttttccttggaaggcatgtttaactctcctttaaggctctccattaaggcacttgtcacttgcagccacacataggctgagtctctggccacaatgctccaggcagccggctagcgctatcctggtcttgccggtccagccccaggacccgccaacctgccctgccctctgtccctgagctgacggcagagtcttgtcggcttccacctccacggggctcctgtccaaatgtcagcctgagtctcttctcacccctccccctctggaagcccctcctttcccaggtggaagtttggggtttggaggggactctgtgcagaggcagcctgctctcggggcctgcttctgcttggccagcccagccccgctcacccaagcccctgggctgtggagaagcgctcccagagaaagatgccagaagtgcacccctggcaggggcggagcacgagcctgtgtctgggtgctttgggtctagcctgggtggcttgccactgacaaggactttccttgtgctcagctggatcaggggggttgtgaatagagcctgaggcctacagatgtgtgtgtgtgaagttaccaggtgtggttctgcagctggggcatctgcagtgtggggcaggcccagcctgtctggaagcctgggcttctcctatccaccccaggccctgcccctgcagggccacacaggacgtgctactttgggtgtttaacctgtggatggcatcaggtgacgtgggaatttacaactgtcctgttggggtcaagcaaggccatagatgccaggaaccgtgctagggtctcaagaccaggggtggttttctcttcaaaaagacaagacagcactaccattgttcccgttagagcaaggccgcctgcagagggagaggagggaaggggtttggagtggacacctggggttcagatcctgcctgggcagctccctggccagtgtgcctgtgcctgccacctcaccctcagactcagcgtctggcactggagcccacaggctgtcagtgagtttcctgttgctgccgtagtcaccaccacacacagcacacagctagtgtcttatagctctggaggtcagaggtcctcaaagatgtcagcagggctgtgttcctcctggtggcccctcggccctgtcttcccatctccagcctctgcttttgttgtcaccgcccctcctctgtccctcacactcctgcctccctcctctcaggaccttgtgattacattgggtccacccaggcagtccagagttctccccatcacagaacccttagtttcatcacatacacagtccctccccatggggtctggggactgcgatgtcagcagctttgaggggctattatcctaccccagttcatcctttggcccctaaagcttcatgtccatcccatgtgcaaacatactcagcccattttaaggtccccaaagtctcaacccattgcagcatcaactcagactcccaaatctgtgcctaaactatctaatcgtgtgtgggcgagaatgagctgtggcccagtcccggcactgtcgcgtcactggctgtgtgatctcggcctcagagcacacctgcccctcgaatcctgcctaggtgctggtgggatctgaggcttggtgctccagctcccctgcccctcggatcctgcctgggtgctggtgggatctgagacttggtgctccagctcccctgcccctcggatcctgctggggtgctggtgggatctgaggcttggtgctccagctcagccttggtgtgggtgttttccactcctttccccagagcatgcctagagcttgcacacgatcttctgaaacacggcaggcgtgacagtgcagagtgtcatggcagcattctgattgctgtttgttttcaatcacaggagcaagccagagccaaaacgcaaacgccccctgtgtcgcccgcacctcagccaaccgaggagaggctgccctcgagccccgtctatgaggttggtgtctttggtgtttgaatgagcgtgagtgacttactgccagagcccaggtcctgtttgtggagtggaggaagcccttgcaggcaggcagtgtggcgtgggtgtagagggcatcgctgcattccacgcccggagaggggtgggccaggagcgcctggggggtgggtgacatgcctcagtgctgtcaggggatagctgtgcaggcccacatgccatcctttcacccctctgcagcctgttgtagtctggccactgtcactgcagtccctgctgtagtcacctgctatcagataatcagatgggggtgtcttcaccccacttgctctctgctgtgcaggacgccgcctcactccctaatggcagtgctgccctccttcatcactgagcccctgcctcccgcacaatctgccttctatgcctgccccattcagctctccagccttgcagcccctcatgagtgtggctgcagacatgctgtccggcccctccctgtgctgctgaccccctctcatgggtcccccagtgttccgtccccatccctgagttacggagccgcctgccgatgccccgcccatccctgactttgggtctcctgctccccgccagcacctctgcgctaaccacaccctctacctgtaaccacctctcctgtccccagcccttgccctttctccatcccatggccatcatcctggtctatgcattcatctctgctcgcccaggagccagtcagttacaggggtcacactccagaccatggtagttcaggagcccagagagagccctggagacaggccgggtctgggatctgggcctcgatggccgtggccttgtcaccacccgactgtccctccttggctacgctgctgcctgctgcctttaccctgccgggccctggggggatgtggtaagtgaggccttgcagcttgtcaggaaccggcctccccctctagtccctccccttggcagccagcgccatctgcctcaaggaagctccgaccctgcccctcccgtgcagttcagcccttgtgtggttcctggtgcctgtgctgagggtggagtcgctctccctgcccgattactctccctggctagcagctctccaccactggctcttcccagatctcctgggtgcgcggttctgagctgtcggcattgctttctttcagtcactgccggtgacatcaggtggaccctggtcagaaacattgattaaagccactgtcggtgataagcagttcagaattttcgctggggctccgaagcggcagtggttatagatagagaggtgttccactgcgcacctttgtagttgaatgtgattctttggcgatgccctgtctgtaggctcagctgctctggagccacgtggtgaagccgctgtcaggcagggccagggtcgagcagcacaggcaggagggtggccgctcggcccaagggtgccttgtgtggccttggagatgaggcctaaaaaaagaaatcagccaaattaacccaacaaagacaggctctacccccaggcaacagtgtgggcaggggcgtgtctcctaacctgctgtgtgggcgtggttattgcaggactggagtgtcggtggtgaggaccgggtcatcatcgggaaggaaatggcatgtgggcactcaccaccatggtgaacacaccggcaggcctggccttcctataccgcgtctgttttctcagtcctggctgggactgagaattagatggcccgtgggtttctgctggctgtggcagtacagctactgctctctagaagccagcatgggccccgtgccatgtgcgtgtgacccttccccaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcaggtactggggccccacgctgcagcgccctgcccagggcagggagctcccgggacatcctgctcgacctgtggcgtcgttgcgaggagcgtgggtttcccactgacacgcctttgcttgcttgctatagggtcttcttgtccctggagggaagtgctctaggcacatttggggcatcggctcctgtgctgggtcccaggaagatccccattgtgctggggacgggtgggcaggggcagaggaagggagggtttcagctgccgccctgtgtccttgagacaaaatcttaggaagtgtcgtctaaaacttgagaaggctgggaacctgtgtgggactttgtattgttcagctctgtcatggctttcttttagaggacagcacctacgatgagtacgagaacgatctggggatcacagccgtcgccctgtacgactaccaggctggtgagcggcctgcaaaagcacttggaggggagacccaggcagctgcgcctgcctctgcttgttttctgagaattcacttctctagcgttgttagttttagaagtaatttatgttgagataatttcagagatatagaaaagttgcaggtatagtgccaagaactcccatgttccctacccggattccatctctgcacacacacgcacacaccccctgttatctttagtattctctgaacccttggagagctgcaggggtgctgccacccccaaagactccagcgtgtttcccaagatcaaagatgctgtcccacagggacaccccaccctccaggtgagggggccgcacagatgccttgatgttcgagaccccattcctgcctgtcctgccccggccgccagctcccgtgtggcctgcacgttcccctgagttccctttgcggccttggcagtttaagagcagcctcagctcctgggctggcctcagccgcccgccccgtgttccctcagggccaggctgagctgtgctctggtggcggtgaggtcttggagaccatgcggtggggctctctgctgggccgcatagcatccacttgtccctctgtctcagccaccacctggtccacaaagtcaccaccacccctctgcagttgacaagcatcttacgggtggcgtgggattcccctcagaacccccggcctctgcctcttgagtgcttcccgtttgcaactttccatcagcgcggaagctggcattctaccataagtgagcgctggccgtccccgttcagtgccttttgcacacgtgcatttgcgtacacgcatgtgggtgtgtctgtggcatctcggcacctgtgcgtggattctcatcaccgtggcttttgccctccattcccatttcagccatcacctcgggcttctctccgggtgtcccctggctgtccttccactgcggcctccgcagcccatctccccaccccctccacagacacgtctgccagagagaggggaagggagggcaggcggggctggagttatgtggtggaaacctgctcctgaggaaggggtccgggtggggttggtgcttgtgtgaagggctctgtgcctctttgtactctctcggttcatgttcacaaatcctggccttggtggcatgggagaggcagcaggagcctccgcggtggtccgcatctctgcagggggcatctctgagcaggctgcctgggagcttgctctgggttgtgctttttttctggcagaccaggaaacgcttgcacttcagcatctttctctgtgttctcttccccagcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttgcgtg

SEQ ID NO: 35759 - DNA, 31193 bp, Homo sapiens
gcctctggctcctcagggcattcccggcggctccgggtttggcaacgaggacgggggagtgcgactgcgtctcgggcagcatggccgagaagcggcacacacgggactccgaagcccagcggctccccgactccttcaagggtgagtcccgcgtcccctgaccctcccccgtggaccgagcccccgcccgcagcgtgcgctccgaggtctgacagccgggctcctggccagtctccgctgcttcgggctgggcgagatctcaaagccgcggctcctccctagtaaactgagcatcacgaaccctgtttggcagactgaggtcacgatggaggggtggcgggctgccaacggcacgtttcccatcgcacgggccctggttatctcgcggccgccagatgccaagccccatgccagggctgcactatctcgtgtcacgcacgcggactaggaaacgcagagggaactggcagccagcgaggcggggaccgggaccccacatctcaccctttgcccactccccttctttcccgactcactctctcgaaggccgcctcctccacccagccctggcctggccccagggtgaaccccctcctcccccaatcccacctcccgaaacttagaccgatttgcagaaggaagaagtctctctggctttcttcttacctctctttctagctccactttctgccccatttttccccctccgctttcctctgcgttttggagaactctccttcccggcttttgttcctcgccaggaaccctgagttctcccaccctcacccccaccctcccttcccagtcttcaaggcaggagctgtaagtggctcagtctcgttcccctgtggaggaactggtactctggggagggggttccaataaagagagatggtggacctctcaggagtcctggtacccactcaggagctcttagtgatccagaggaattacagtgtttctaaagatggaatttcaggcaggatggcagtgaaagcaatttagagggctgggtggtcctttccaggacccctcaaagaacatgacattggagtcatctattctgattatttgtaaagccagctttatccacagcatcttagctataagttccatttcccttgtccagggatccctgtgttcagttccttcccaggagcatcaaaggaattacagaaatctttattcctcactttttgtctactaataacgttgcaggttatcttcccaaatggagagtgtaacagggaggagttgatgagaataatggcaaccacaacaacaaaaattgaaactaaataggtcaggctccgtatcacttttttttttttttttgagacggagtttcgcttttcttgcccaggctggagtgtgatctccgctcactgcaacctccgcctcccgagttcaagtgattctcctgcctcatcctcccaagtagctgggattacaggcgtgcaccaccatgcccagctgattttgtattttttgtagatacagggtttcaccatgttggtcaggctggtctcaaactcctgacctcaagtgatccacacgcctcggcctcccaaagtgctgggattacaggcatgagccaccgcgacccccccagtgccacgtattttatgtatatattattttattgaatcttcacaacagatgatgtggtaggtattcttatccccatattatacttgatgaaactgatagtcaaagaagttaaattacttaaagtcacttagtttgtatttaaatctagatttgactgattctaaaacttgaatagggaaaaaatgggtggtaactgcctcttcgatagttagttgtcttttcctagataaaaaggtgggtattagcatgcattcctcaataccctgacctcctggtgggaaactgcagtggcaaatctgcttggagttctttgagaatcaacatgatctttgtacttaatgtttatttacagacaagtggtcatagatgagtttttaacttccagtttttttccttggttctacacttaactactgtttagacagaaatctttcaagatctaatgaaaaccaccacttcctctcaaaaattagacatacaaataaaattttgcatagtctgtgtttttttaatgtaaacctaacaaatttgacgctactaggaaaggtattgctggaatttattaaatagaggttattgaatgctttccctgtgccaaaagacagtttaagtgctttacaaacattatctaattgcattctgtaacagctctacaaggaaaaagtcattattcaccatttcacaataaggatactgcggctcacatggcaaaatcacagtttctaaaattttcagccctgtttcaaaccccggctatctgattttctgaatcattttccctatcccagagatggataccaaaatgtagaaccttgtctaacttcagtactttacttaagttgagagacaataaacaaaaaaagcctggaggaacacagcttcagtgatgacttccagaaggctgcttgtgaaagaagcagtggaattttaaaagcctaaactctgcctctttgtctttactgagaattagtcctaggtaggtaaatagcaccaggcctagggcaagactagtttttcttaaaggcgatgcattcactttgtaatgaaataatgcaagtaattgcaaagaatgtatcactgtaattaagagccatgtcaacaaataaaaccctttgggagactgattgtttatttcagttgttatagccaatcagattggagagaactttgtaacttcttcaataattaatctgagttattccatcagtggtcataaattaacttatggaagaccaagtctacaaaactggcatatttattcatgattaaatagatttttggtgccatttgatggtataaattttacctagtaaaagacagtcactgattcctagtcatctttgagggaaaaaaaagatgttgataaagtgatacagatggaattcaaaatcagtttttttaagaaggcatggaaaagcaatttcctgaaaactattgtaactacaaaaaaagtgaataccctttccctgcgtctgcctggtatcctgtgcatatctctatcataatgtttattacataacatatttatcagtttgactcatctgtcccctcccctcccataattaaactacactttttctttttgagaccgggtcttgctctgttgcccaggctggagtgcaatggtgcagtcatagctcactgtagcctcaagtgatcctcccacctcagcccctcgagtagctgggactacaggtatgcaccaccacacccagctaattttttttttttttttaactcagggtctcactatgttgcccaggctggtctcgaactcctggactcaagcgatcccactttaccctcccagagtgctgggacaacaggcatgagctaccaagcctggcctttagaccacacttttgaaaatagagattgtgtccttcttcactgtagtagcccagtatcaagtacatagtaggtatacaaaaacatttgttcaaagaaaaaggaagcaggcagggagataaaaatccccctggagtaaataacattgttaagtgtttgccttagccttatgttggtggagcagtttttctgtttaccatttattttattaagtttgttataacttaagctgttgattttagggcatggccattatgtttattatatattattacagatagactatttgtctgggtttatattatcaataaaaggattataattgccaagataatatattgtccttaataagaaatctccttttatttattaaagcatggaaagagaagtttagaggtcatggttagtagaaagaaggaagtgtgtgtcaatagataattttctattgacacacacttgttgataattaaaatagatcatttcaattaaaataattttctattgacacacacttgttgctacattcttttttaatctttctctgtctgctgggactactaaagaaacttgaactccaagcatttggcctcacatttcagaagattatccttgaagatacaaccaataaagtcctaaagtctcagacaatgaaaactatactgaacttgtggtccagttaaagtgagcactatggtaaggtagtagaatatagtgaaatgagagtggaatttataattaaaagatttaggttgagatcaccctaccatcacttaagagatttgtatgaaggatggtccaagaacatttagaactctgacttactgccccaagtgtagtctgtttctcctccagagatagagtccccaagcagattgttagttgatattttctccatagtgcccagatcccaaaaggtaattcacttcataaaaagtttcttcctctaaacttatcaatagtgatcttaaagttgtggtaataataatggctactgcttgttgaatacttcctaagtgtcaagccctttacatattttctcgttttatctccacaacaactgagtgaaataaatactgttcttttccccattttactgataagaaaatttagtggtagatttggaatctaacaccaaaaatgcaagcttttagccactgcttagctgttaatcacagtgaagaactgagaactttatcatctagttttcttctgcttccatttcccatttttaaatgaaaacgatgttaccctccaaagacttatatgagaaaaacttaattgtgaataattttaagatgtccaagtaaaagagctgggaaaaaaaaaaaaaacctaaaaagtgggagggtttttgttctgttttcatgtatttcaggcctagatgaaatttaattaacttaatacccattatgaaattgtttttctctccaattttcctgaacataaatgttttggtgcttccagacatgggccatgttcagcccattcttctgctttcctgaattctctaacgtcatggttggaaaaggtctgattttttttttaaaaagaaaatacttgaggaaagcagttgacaactgcttgggcaggagatggttctgtactgtatcccaggatcctgtctgctgtttcagtttgtcttatgtgagaggcagtcttttttttttcttttccccaaaaaaacaacacactcaactcatccagcaactatttaacaaatgttttttgagtacctgttatatacactaagtgtcttccatattagcttatttactcatcacactaacctgaggaggtactcttattagccctatgtttcaatgggtagactgaggcacagttgaataataaggtactttctcaagatcacacagctagtaagtggcagagccatctgtgaacctattatgctatactgttttcataaaaccaaaatctcatgaagacacacaactgaatagaataattacaagtgtgataaatgttgttttaaaagggtaaagggctattgcagcattattttagactgagaggtccaaatttaaaattattgctgttgctctcacctatttttttcctcttgtatggcctgaaacatttgaatgcaggaaaactacagaaaatccttaaaatatttaggaaataagacatttatgcttatttactttccttattctttttgagctaagcaaagaataactgttattgcaaatctttcttagaagtattagtccatttgttttccttagtatttcacagtaaacacattttaagctttgtaattcaaaccacatagtgcttcatcagtatcagttcttttggtctagcatttataactatagatggattttaatagggaggaaaagttacagtcttcactcatggtttttaacttgataccatctggcctgtagctactctagccccaagaataatttcttctctagagatttaaggataagggcattcgaacaactaagccgtgcctaattaaaatactaatttgaaaggcaggctataatgtgtgtgtgcttgtttgctttgaaatcttctgccttaaatgaattgcaagttttgatctctaatgaaacactatcattttttaacatacgtttatcgagacgctaccatgtggtaaactctgcctctttctcacttctagcttttttaatctatctctctttgtaggattctgtcttcatttttgtttctcccatttttactccttctatttctcttattttccttcgcttctgctatgtccttcccttctttgtctttttctcctaaaattccagtcatttgaaaaacttagttatagtaaaaatttgattaattgaagaggaatttatattcacttactctacctgcccttttgcttattttcaccaggagtttttgtttatcaggccttataaaggccttgcttcaaaataagcaaaagggagaaactgagaagctgggaaatgtacccttatttgaatagctggaagaaagatcaaatgcattatttaatttatgcaagtcttcctcctcaaataaatagttggctgacataaaacaggaacagcgtgtaacagcccattgtccaaatctagctgactctgtttctgtatgtcccacaagttatgaaatagctcttatatttttaaatgattttaaaaaggcaaaagaatactttttcattacacatgaaaattatgtgaaattcagatttatgtccataagttttattggaacagctgtgctgtttatgtaggtactatctatggcttcttttgcactgcaaaagtagagttgagtagttgcaacagactgcaaagcccaaaatatttagttcctggttctttacaggaaaagtttgccaatcctgacaaagaatcactgatgaagaatcatagtggccaaaagtaacacttaatcctgaatacatatgtttttaagaagaaagttcaaaaattgccaagacttttcaatttggcctactgttacccctaaaaagtgctgctgcaactgaatagcatgtgtttttgagactaaacttccagcctttctgtcttgccccatccaggcaggactgctctcatcaatttacaacatgaagtgttttatttgcactctgtgaaggcagaaggaaaaaagtgtccgttaaaaagtggcagtttaggtatttcagtaattccttagcccatcctttcttattgtgtaggataatgcttatgactcacagtcagattctcagcagaggaaatccagttatctgttgaactttacaataataaaatctcagtgatgagtggatttattactccacatgatttccagtagtgctaaggttaatagatctgaaagtaaatcagctgatggggaacggggacaactacagccctctggactaatcagcctgtgttgtcatcttggaaagaatgtttaactgcctttccagaaacttacccaacaaaaattactacacaacaaatttcatttgtttcatggtttgcttggttttcttttgtttcttcctacaaggtctttagccttattactttagaacttcaggaggcatattttaacacctacttcacagatttttgtaaacattataaatactcatgtatgtaaggaggagctacatgtggctaacatgtcataggaattcataaatggtagttattaggagtagtaacaaaagataccttcagaatgagagaattttaagagttgtataatttcatcttttcagaaaaattaacttacacaggaaataagcaggtacagaaacactgctaaatatatattcaatgcagcagtttctaagtgagaaatttggacacaacagatttcatcatataaaatggaattaattaattaatctttaataatgataaagaatatgtgctgatatgaaaaaatgttcataacatggatgggagggagaagattttaaatcactgtgtataccattctttcattattgaaaaaatacaggctagaaaaggtttaaaagacgtatatcaaggcaaaaaacatccagagataaagtatagataatgtttctgtttgttgagctatcatttctaatttttatagtaacttttgcttttaaagtaaaaaagcaattttagaaaatgtatgtgagtttcctggaggtaagcccaacttgaatgttcaatacaaaaattcaaatgtacaggcttatgtccatattcagacccttctttgattagttaaaagtttattctactgccattttggtaataaaagaaaaaaaaatactctaaaccaggagtccccaactcccaggccacagacggatcagatcagcaacattagattctcataagagcacaaaccctattgtgaactgcacatatgagggatctaggttgtgtattccttatgagaacctaatgtctgatgatctgtggtggaacagtttcatcccaaaaccatgttccccaaccctttcctgtggaaaaattgtcttccacgaaactggtccctggtgccaaaaaggttggggaccattgctctaaactatggcaaagtagtatttacaaccaagtatcataggatccctaatttttaggaacattctcaaccagcaaaatacccacaagtggccgggtgcattggctcacgcctgtaatcccagcactttgggaggccgaggccggaggatcacgaggtcaggagatcaagaccatcctggctaacacggtgaaactccgtctctactaaaaatacaaaaaattagccaggcatggtggtgggcacctgtagtcccagctactggggaggctgaggcaagagaatggcgtgaacccagggggcagagcttgcagtgagccgagatctcgccactgcactccagcctgggcgacagagtgagattacatctaaaaaaaaaaaaaaaaaaaaaaaaaaagtccacaagtgtattaaccaaaatatcactatttgtccctttccccataaaactggtaggaaggattcagtcctaaagtaatacatgggaaacttgaaggaaatgaatttcctgagattttagtgagtgagaatttcttttctcttattcccagaagtggtagatgactaagggttcatttataagcctgctagagtttaagcctcacctctgagctatgcatttatagcacaacatgctataaatagacacagctggaattaagagggcttcctctgtaaaaacatcagatttcagtctcagaactctagtgatgcattcccaacttagatactgtgtacctttttgaggggtaaccaggtggggaagaattttgagaggtgaaggtaggatactttcattttaaagtcattagaaaaatatgaaagtgccattttcccagtgtatacactgattatttctagccaagcatttgatatgtgaaagaccaaatccagttttcaaaatgtgtacttaattccttgttcctggtgatttgcaatcccatatacacatctggggttctcaaaaacacaatgtgacatgggaactgacacaaaaaaaactgggctgaactttttggcttgtcctcatgtagatcataaatgaactttttgagagtctttgaatgtcccagcctagccagactgggggcaggtatgaagcaaatggcaaattaaattgtttaagaggcttttgatcaaaaagggtaaatgctattttcccatttttcttcatgaagatacaaacacttaagtaaaatagaaggattacagaaaactatcatctacatttactgatcattttatctgtattctacaaggccagcctaataatctttactttccaccggtaaggaaactaaggttcaaagaggtaaagatcatgcaactaagaagtatcagaagtgaaattcaaacatagttactcctcgttctcagggaatctcagtgtaataagggatataaatgcacaagaaattaaaatattagattaaaaaataataaaagattaaaatcctacattggaaggtcaattaaaaataaataaaaaataaaagattagacaagatataagtgccataagataattttcaaaaaatgctatcgagattcaaaggaaagaaaaagacatatctagctagaaaacttgctgagaagtattttattttatatctattctactatgcaggatactgtgctagacattgagaatataaaagtgaataagcaacatccctgccctcagggagtttttactctagtatgttatgggagacttggacagtatttgaaaaggcaccaaatgctgtcagataaataagtatttgtggtcagtctgtccttgtttggaattcatttcaccctggaaacctagacctgtgtctgtcacagagccttgaaactatcttttgctataaataggcatggctggcattaagaggacttcctctgtaaaaatatcagatttcattctcacaactccagccatgcttttcagtttggatactgtcttgagaaagtgctcaaccacgaaaacattcttaatgaggattttttttattgaggggtgaatttggaacacgggctttggagtaagatgacccatatttgagtcccaggtcttccattgtgtgactttgggaaagttaaatgttgctttaggtaactcatttgtaaaagggatttaaaaataccctcacagggctgttgtaagagttaaatgagatacatgtctaaagtaactttaaaaaatgcctggggtatacacaacccctcaaaacagccactgttgctatgatcagtcatggtaatactagataaagctttcttcacaaacagtactatggccctgctttgaatattctctcaatgaatatgtctgtaccccctaaattataacttagaaacctccaggattactttagatcattttatttaagtatacatgaagacatttacctcacactataacacaggatcagaaaactaccaagtcacatacaacccaagtactcactatatttctgatttttcatcctatgttttagagcacttgacctgggtgccaacatgtgtctctcttctcccatgttcccagcctgaacactctgcttatttcttggcctcctatttattccaagccccatcttactgccattttgccctttcttctgagcagtaacatgtgcctggcataccttttctcccctctgtcattaaaatagctcctgaaaatacagcagaagccttccaagtggttgataagaaaacctactatatcccttggccttctcagtccctatgtcctctacagaaagcaaaagcaaactaaaaatgaggatgacacttgatacagaaaataggaacacaacactgaggtgatgggagttcccaggatgatagtgaaagcaattgcagaatgatagccgtgcacaccagatgaaggaagtccacacaaggctctgagagagaattcttccagaagataaaattgatagtatacctgacctctttgagaggaaatttaggcaattgatttaaggttggatcaataagtacgttgaaaaccgaacaaagggaaaaaataagacagtaattccagaaaaaacaaaaatagtacaggaagagaaaaccagtgatacctcactacttggcttagctttaaattgcacttacaaattcataatataaaatctcatattgatctaaatgaagttatgatgtaattatattggaaagctgggtataagtatgtggtgggggtaacggggaggaaagagaactaaatctttttctgtagtagaaagttaatagtcctcaaaactgaaaaagcaagaagtaacaaaacaagcatttccttccttccttccttccttttctttctttctttctttcctcactttgttgtccaggctggggtacatcacagctcactgcagccacgaacccccaggctcaagcaatccccctatttcagtctcctcagtagctgggactacaggtgtgtgccaccacacacagctaattttttttaagaagtttcaagtagagatgggagtctcactaggttgcccatgctggtctcaaactcctgagctcaagcaatcctcccatctcggcctcccaaagtgctgggattacaggcgtgagccaccatgcctggcagaagcatattattattattattttttttttttttaaagtagagacagagtctccctatgttgcccaagctagtctcaaacccctgggctcaagggatcctccctcctcagcctcccaaagtgctgggattacaggtgtgacccctgcacccagctgcaaagcgtattatttagaaatatggaggtagatatcaaaatggtcaaaatagcaaatgtttttgaggaggaggaaattggaagaggtgagcatgggaatgccctttttttgtactaatcatatagaatggtttgactttttaaactttatgcaagtgtaacttcaaaaacacaaatgcataaccacgaaggccaaaaaagaaggtgaaagagaatagctacagggaagaaaaataggttacacattttatttatttatttatttttaaaaatatgatttaaggccgggcgcagtggcttatgcctgtaatcccagcactttggaaggccatggtgggcagatcacttgacgtcaggagttcgaggccagcctggccaacatggtgaaaccccatctgtactaaatacaaaaagtagccgggtgtggtggcaggtggctgtaatcccagctactcaggagattgagacgggagaatcgcatgatcccaggaggtggaggttgcagtgaggtgagactgtgctgctgcactccagcctgggcaacagagcaagactctgtctcaaaaaataaataaataaatatatatatatatatcatttaaaaatatggtgtgtacactaggaaaattttcaaagaatataccaaaatacctctgaatttaaagtaatttttccctcctttgttatacttctgtgaattttttgcattattacctttgtaatcagacggaaaagctgttgcatattacaggaacaggaaacaattagaaatgtgagaggaaagccgtgtacaaagatgttcactacaacactgtttatagcactaagaaatcaaacaacctgtgtaatcaggaagtgggcaataaatgatgctgcataaacctagtgaaatattttacaggtgtaatttttaaaaagaggctctaaacaactttatactcatatcatatggttttcacctttattcgtactgtactcctagctaaaatgctctaatgccttttccctctttcctttttcttttcttttcttttcttttgacagattcttcctctgttgcccaggctggagtgcagtggtacaatcttggctcactgcaacctccacctcctgggttcatgcaattctcctgcctcagccttcccagtagctgggattacaggcactcaccacaacgcctagctaatttttgtatttttagtagagacggggttttatcatgttgatcaggctggtcttgaactcttgacctcaagtgatccacctgtctcggcctcccaaagtgctgggattacaggcgtgagccacgacgcccagcctccactttcttttcgtcgatattttcttactattacatccttcaggaaaccctctgacagccacctgaatcacctccccgccccattcctttctcacctccatcctaactgcgtgagttaactcattctgtgtcttcaaaatattctgaacagatactctatatctgtacttaccacctaatattataattatgtgtttgtctgactttcccactaaactttaaccctgaaagctgggattgggtcttactcattgttatcatttcagtacaaagcagagggcctaataaatagtagatgcttaataaatgtttgctgaataaagtaatgagtaatgtggaaatatacttgtgttatgacatcacatagataagggaaagtagtacttacacttcagggctgtatgaggattagatggggaaattcatgtaaaacagctggtgtagtgccaagcacataggtattcagcgaatggtaaggatgaagatggtggtgattatgctagtaacagttgtgagagttgtatattttttgttttcaacagacagccccagtaagggccttggaccttgcggatggattttggtggcgttctcattcttattcaccgttataactttcccaatctcaatatggatgtgcataaaggtaaagaacatttcattcacttctgggaaggggtcaactcctacctccataaacctacttcgtgtgtgcctgtgtgtatgtgagaaagaaacagactgtctctctctcttataattcttatttcttcatctttctttggaaaatttattcttctacccacctattaaaatggaaccttaaaacttcttttcagccattgcccttccccgtgggctaaagtaagtttcaccatcaaaaatttcctggggccagggatgtgagatggttctgagagaacaagttcttcagagttaggatgatagggtttgactgctggctttactgtttattgtgtgacctttgctgtttcctcacctgtaaaatgggagaaagtaacagtacctacttcataggagtgttgcgaggattaaatgaattatgtgtctaaatgtacttatcacaatgcctggcacgtcataaataccctcagtgctcgttattttttctacaaagttgttaatactttgatatatgactattatttacatatttctaagaagataaaatatgctccaagcattttcagatcaatttattcttaagggaatcagaagaaaaactgtgaagacttcagctttttgtgtttctgaattaacaatgcatgagtaatttttttttttttttttgagccagagccttgctctgtcgcccaggctggagtgcagtggcgcgatctcggctcactgcaacctccgcctcccaggttcaagcgattcttctgcctcagcctcccgtgtagctgggattattattattattattatttttttttttttttttttgagacggagtcaccttgtggcccaggctggagtgcagtggtgcgatctcggttcaagtgattctcctgtctcatcctcccttgtagcttggattataggcacccaccaccatacccggataatttttgtatttttagtagaaacagggtttcaccatgttggccaggctggtcttgaactcctaacctccgtgatctgcccacctcggccttccaaaatgctgaaattacaggcgtgagccaccgtgcctggcctgcatgagtaactgaataacaatgttaacagctgaggagtgaggttatggatttgtttctgtatactattctgtccttcctaaatttatacagtgaatatctattgcttttgtaatcagtaagaaaataataaataagctttgagaaggtaaacattggacatgtgatttatagatatgatctggttctaaagaaaaaagatgaggcatctaatctgtttagagcagaaatatatatttaagaagccatgcatgtatatatttgtactcttcatgttaaattattattcatgtttttattctagattataaaagagtatgaaagagccatcatctttagattgggtcgcattttacaaggaggagccaaaggacctggtcagtactgggattctagattgtttatctgaaaactaaagttctttttattttttttatttttaggtagttgtttttttaaagacagggtttcattccgtcgcccaggctggagtacagtggcatgctcatgtctcactgcagccttgaactcctgacctcaagcaatcatcccaccccagcttcccaaagcactaggattacagacgtgagccaccgtgcccagtctaaaatttttttattgacgtgatttcccttatgagggcctcttctactctgtcttagataagagttcatgtagcaggagttgtataacaatagcagtggttctagccaatcttttgttaccctttccttcctacccttcccctccccttcccatttgagctgataagattaccacctaggccaagaacagtacagctatacaagtttgagcatgagaatctctaccaaagaaagactttcagtcattcatttggcaaacttcaattaagctcctactgtgttccaggttctgggaattcaagggagactaaaacacagtccctaccctcaaggatcttcctatctagtggtaggaaccaacaaggaaacagatagctacaatcctatgtgataagtattatgatcaagtactcacagagagctgtgagaaaagagaaaaccagagaagtgttactgatctgaactagtcgtaggctgagtcaaggctttctggaagttacatcttgactgagtcttgaggtctgaaaaggtgttaaccaacaggaggtgtttgcggcggaaatagcaacatacacaaagcaacaaagaggagagtattgcagattcaagaaactgcaagtagatcagtccagcaagagtgcagggtgtgaagagagaggaagtggctgaagaggggaacaaaggcgggttatgcaggaccatgcgtgggggagggtttgtattttaggggggattgctcggcttgcagcttaggaaatagattataggagagaaactacaaaaaatagaaagatggcctgggaaacgattgcattggtcccagtggggcggtggggagaagagtgatagcaacagtagattaaggaaatgaactccacagaccttagtggagacagtcaaatgtgggaagtaagcaagaggaatcaaagttatcattcctggcttctggctcattcacgaagatgaactggtgacttttcagttcactaggttgattttcttaaaactgaatggagaagtgaactgattaggttgctggtgtctgtataatgtgtgtatctttgttgcaggtttgttttttattctgccatgcactgacagcttcatcaaagtggacatgagaactatttcatttgatattcctcctcaggaggtaaggttttctttgaataactgaggtatcatatgtgaaagtgctttacaatgagggacagaatagttagagtgtaggctttatttatttatttattttaaatttttgtttgtttgtttgtttgttttaattggaatcttgctctgtcacccaggctgaagtgcagtagtgtgatctcagctcactgcaacctccgccgcctgggttcaagtgattctcgtgcctcagcctcccgagtagctgagactatagatgtgcgccaccacgcccggctaatttttttgtatttttagtagacacgggattttgccatgttggccaggctggtctcgaactcctgacctcaggtgatccgttctggcctcctaaagtgctgggattacaggcatgagccaccgttccctgccagagcacaggctttagaccttgactgccttcagcatttctagctcagtgaccttaagcaagttctttaacttttctgtgcctcagtttcctcatccagaaaatagacatttgtaatagtaagaactactgtataaggtggttctgagaagtgagatatatgtgccaagtgcttagagcaatggctgacaaatagtaagtgctatataagttcttactgttactattacagttggccctttgcatgcatgggttttgcatacagggattcagccaaccgcagactgaaaatattaggaaaaaactccacaaagttccaaaaagcaaaacttgaatttgccatgcatcaagcatggcattgaatccacatgaataaagtgatgtgtaggtattgtattggataatagaagtaatctagagatgatttaaagtgtacaggaaaatgtacatagattatacggttggctccatggatcaaaaatatttagggaaaaaagcaattgacaatgatacaataatacaaatttttaaaaacggtgtagtatagcaactatttatgtagtatttacattgtgttaagtattataagtacttcagaaaggatttaatgtataaaggaggatgtgcataagttatatgcaaatattgtgccactgtatataagagacttgagcatccttggattttggtatcctctgagggtcctagaatcaatctcccacagataccgaggaatgattattacaaaacatagtgtaatgctaatgtaagtataataatatcatcattgttattactatcaacatttttactaccacatttctcttctatgggtttctgatagaaaaccctattagttcattattttttttcttaaggttttattctagataaattggttagaaaccaaagaattagaaactgcttgttgggcattttagataaaacataatattttatactagtgattattttgtgccttttcaaactacttcacaagtattatcatagatgaaactcatggcagaatccctagaaagtatatagttgcagtgaaacaaaggaattcctccagattacagtggcagagccaagactaaaattgagctcttcggattctttgtatagtgctgttttttccacagctccatgctaaatgcattgtacatgagctccctcatagcccccgaaaaagtgatggccatcctgggaaccatgtccttaggagacttaataaccgttgcatacagaaaacctgaaaacatcatgaagggggaaggacagaagaatgctgtcagtgtttcctggccaaaggccagatactcagcatggtgatggagcctggccatgttgccttctcatgtcacaaataccagaaaccagcttaggaacttccttgttggtactgatccaagaagtgggtggggtcagactttataatccacccaaagttagtgatgccaggaatcattttgcccacattttactcataagaacaagactgagagtatcactgtattctctgtgtgttttcccatcgtctaaggaagattgagtctcagaaggagcccttcagggtagctggacattctggcattttccactataaacattacagacatctggcagagttgctgtttaagcttctgctttccagtggccctctcctattctgcaagctgctgaatgcaaagcagattggaacttggcagcaatcctttttctgatcccctgtgaagtttctgtgaagggagataaacccttgccgatgataaacagtaggcagagaagctgtagctttagaaagaagctgtggcaaagtcaaagtggcaagaatttgggaatgacacacattttcccatcatgtcatgggaaataattagttttcatacaagatggtaatacactgtacatttatttataaatcctccacttctcttccatgttagaagtattttgagattactaaaaaaggatcactgctttgatgtctggcagggctaaacagccatgttacaacattgttattattaccttccattttcatagctgtttactctttcaaaagggcttcattcacaagtatgttcttatttgatcttcacagaaatttggatagaattaggcagtattattagcgccatctcacaaatgaggaatctgttggtcaaatgggttaaaaaccttgctagaggccatccagggacctgaaggcagagatgggactcagttcaggtctcctaactctcactgctgtgttcctcatcggtcactgttctcaggaccacatttcagttcagctcctctctcatttattgactacccgctatgtttcaagcactctgccagtgttagagttacaaagaattgccctgaagaaattcatagtctaagagagaagtagaaatgtgaataaataatgtcactacagtaaggtgcagtggatgtgcaagggaagagtgcttaactctgccaagtaagccaagaaagtttcacagagagaaggacatttaaatgatcagtagaaaggtgccagcctgatgttgttagtgagagaggctggaattcccaggctggagcaatcttcctgcctcagcctcctgagtggctgaaactacaggtgtatgccatcatgcccagctggcttgtttattattatctaaattaacttattacagttaatcaagtcagtgttttattcagtaaagttaccaccattatccaagatgaaataataagacagctcttacgtgccaggaacttttctgagcacttgaatgtatttaacgcattaattctagcaagaatgcaaagtaggtactataattaatctctactttacaaatgagaaaactgagtcccagtgagttttaagtgatggatgtaactattttcctggagcctctcactcagataacttcttagcttaaaacaaaaatatgtcatgtttagcatttttatgtagcatgctgtaaaatatgttttgatgctgaccttgccctttaaaaacattccccatgcactttttgttccagtaatattgtggaacttgtagtttatcaaaccttgactctctagtgcctctctcttgaatattcttccactccacccaacaccctcagaaaaattgtattcctttcttcaagattcaattcaggtatcacccctgccacccacagctgcccctaagagtttcctttgattccctaacctccttcaaaggaggaaccaagtttttttcctaccttaatccctggtacctagtacagtgcctgctgttgagtgatatctcaatattatttgtatgattgaatgaattaatggacttgaataatttattttattaaattttaaaagatataattaactttctgatgccttactaaagaaaatcagctagtgttataagatattctgtagaataacattccttacagttatgttaaaaaaaagtcgttgacagatgtaaaattgcttccttcatcttgtagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcaggtggggagtacgtcaatgctgttaccccccagaagctgaaaaatgaagcaaagagtcaatggttgtttgagaaccttttattaattcaagttgtgggggtctgtgaccgtttttttttcttcatagtaaaatttttcaaatttggcaggaggggacatttttcacattagcagttcatgagttcataacactcatgcgtacatttttttaaaattttcttcagtgtgtatttttttccagaatcagtaataacctttttgtttagaacagaggctattctgcaagatagtgtaggtattcctaaagctttattctgtgtgtgagtcccatgaattataactgttgtgctttccagtctttcttgagtaacagatattcagttaagcatagcttattcaaaaaagataaagtgctataactctggattcttattatttgtatagacttcatcgtgggtaaaatctatgattgtatttgatatgcacaacaacctatgaaatagatgtgtggtttcattcctgacattctaaagggaggaagttgaagcacaaaggagtaatatgacttacacagagtcacattagctcaggagttggcaaactgtagcctacaggctgtagtttttgtaagtaaagtttgactggagtatagccacagccatttatttatatattatccatggctgcttttgactacaacagctgggttaaatagttgagacagagactacaaataaacaatcactatatggcccttttagaagaagctgctaacccctgcattagcttgttagcaacagaatcaggatcagtgagccagcccctgcgtcaccattcgttccaccgtggggtaactgtctctccacaactctccccagcaccttatctcctccaaatcccaatgaatacagcctctgtcagcatctgggctgggctgaggagatttagcttgccttctctcttcctaacagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggtaactttttttttaaacttgtttttcttactgagttttctcttttattaataattataaaaaaacgtaaaacatgcttgctgtaaaaacttgaaataatcttgaagtggtaaagttagaagtgaaaaccctccccgtaacttcaaatcatattcccccagaggtcaccactcctaacagttgagtgtatttggattttatttgaccaggtttttggattactggcttgtttgttttacaaaagtagggttatactgcacatgttgttctgcgctctgcttttttcatttaatattaatatctatggacgtatcagtacatgtagagttacctcattcttttatgactgtgtgtaccatacttattctcccgattccatattaaggtcaaattaacagttccaacttcggagcaagtgggtcatcattccatccataccacccatctcttacttatttttggcttcttttttgttctgtttcttttctcaggctctttttcccttttactgtttcctattcctcattctctcttttcctcttgtttatattctcttactttgacatctgccttttttcttccttcttttcatcatcatctgcctatgtcttaaccctgcatgggtggcatggcccctctgggaggcactgaggaaatatttgttaacctaacctagaaaagagtatctttaaagatgataatgtgtaaaatttcagggatatctcaccaaacccaaaggtaggaagtaggggcaagtctcaccaaaattggaaccagaaggcagttcagggaactagtcattccctttcctgtgccacatctcactgtagatagcttgtggtggagaatgtctagctcccaggtttagatgtctgccaggtgaacactaaagaacacagaccagccctaattccacattcacagaagagacagtctttttggtccaactttggtcaaagtgcaaagatagcataataatatggttccacagccctatgcctgtgaatgggctgaagaagaagagcagttttcataggaggagttgctgtggacttgacaaatctcccaagacacaaggagcaaaccaatttgttgttagaaaatagtagtagctggtcatcactggctgaccacagaacgctgttcttttcttaggatgccctttaagccacaaactggtcactataatttcttagccagcatcaaataggatagtagctcatttgacatgcgacttcagaattttgcattaaccaaaatgtttaggttttcctggtatgatgattgttgctttgtgatgataacctggtagtactacagaaccctctagtgctttctttcaaaactgttacgtttagaagattaaattatgtttacgatgttattaaatgtgccctatcatctccttattttgaaaattaggaattgcttttaactagaatatgttattaggcaaaagcctcatttccaaaccagattgaatagtagaatgtaccatacatatactacgtagaatgtcagagcccaaaggatcctcagagattatcttccataggtggcaaacacttagcccagatgctagcactccatcctgctattcccatgctagtaattaaccacagcactgttttcctctgagcttagacttggcctcagaacccttctatagcactctgggtaacaaccctcaactgcttagagttagctctaaaaaacaaaacttgaggccaagcacagtggctcacgtctgtaatcccagcactttgggaggctgaggtgggtggatcacctgaggtgaggagttcaagaccagcctggccaccatggtgaaaccccgtccttactaaaaatacaaagagtagcctggtgtggtggtaggcgcctgtaatcccagctactggggaggctgagaaggagaattgcttgaaccctggaggtggaggttgcagtgagctgagattgcgccactgcacttcagcccaggcgacagagcaagacttcttctcaaaaaaattaaattaaataaaaaattaataataataaaaacttaaaaaaaaatgaaacttgtttgccatcccactattcaaaggaaaaattgaagctctgaaaagttaagtgacgtccgcaaggtcgcacagttgattagtagcagtggaaattagaattcccctctgctcctcattgcctcctctagtactgacttcccaggatgggctatgagcctcttccatagcattcttaagagtttggaaagaaaatttctatcttccctttataacagtaagaaaagatagaagaaaccgcttagaattctgaattgccatgctcccacttggacggggctgtagggttagtctagaagcagtctcatgaacctgggcagtgactgtcttggagttcacacatagaatcacaatgagcctagcccttctgtaaaatacagtaaccctgcaacaaccataggcttattgtattgaaattctcatggaaaataggggggtcacagtttcttcaacaaataaattgcacaggaaaggtgagatagagtggaataatctaaagattaagagactttatagaaaaattccttaggctaattagccatcggggaaatgcaaattcacattataagcggatgtcacactagacagctatcagaatggcctgaaaagaacggaaaagaaccaagtgtgggtgagagaggaactagaactctcatattctgctggtggcagtgtaacttaatacaaccactgtggaaaacagtctggcaatgtctattcatactgaacatttgtataccctatgagccagcagctccaactcctaagtatgaatctaacagaaatgcactcatatgtttaccaaaaggcatgtactagaatgttcacagcagcacattgacccaaactgtagaatacccaaatgtccattcctagctgaatgaatgaagtctggtttattcacatgtaggcatactacatagcaaagagaatgaatgtaagtgctcacacacataatttgagtgaaagaagccggtcacagaagaggacagattctcctacgtgtttctctgtatgttaggtttggtttttaaagtgtttagaccagctcttagtggcctgaaatgtaatatcttttgtgtttgcatcagcttttatttccttttcataactctcagaaaaacacctggcacatgcttttgggctcatgtttctgggtgtagaagtctattaattgagaggatggagtgcagaaatacagatcacctttctctgccttttcctctgcccagaccacctggtctgcagaagggacaggtagcaccaatttcacatacatgaaaatgccagactttaaaatgatgttctataaatatgaaatgttgattgctatgagattactgcacattcgacaaaagccgtgcacacccacaaatagcttgctttgctctctaagatcctatcaacggagtgtacttggcctgtatttagacaaagccggtggtgttgtttacatctttggcagcttgctcagtgtggcttttctatgaacaaaatgtgtgcccagcccggtgggtctggcttctcagccaagcgattgtgtattgattggtggtgggaaatgagatatcttttcagttggtccatgtccaaagaaaaaagtgcctaattggacatctgagatgatatggaaaaaatgagagcctgctgctctcatagcaggggatttctgatgtattctctgtagtgcctaccttggaatacagttctgtggttttctttgagcaaagctggcacttgtcccttctcacagacctaggcaggacatgatgtgtggctttgataaattaaggtttttatcctataagctggatcctttctctcagtgagtactatattctgtatcctatctccattaatggcactaatctatgcaaccaaaacctggaaacctgggtctcagcctgtgtccccctttcctcctcctacctagtctccaaattccactgattcgccctccttcggggagggagaatagctccccaaaccatttcattctctgtccccaccacctatgaatcgcaccggccactctaaagcagttccactagcagctttcactgccttctcttctaacctcagacatctgtcagagagctttttcaaactagatctgatggagtttacttacctgcttaaaatcattctgcagcttcccattgcctacagaatgaagaccaaacaccctggccctcactgcccttcagaacccggccccattcatcccccacctttcccctcttcctgccatagtattcagccattgacagttttctggaatataccatttttatacctcagtaccgtttcatgtgttctgcccaaaatattcttcctcatctttttctaaacagcaaacattttatcatttaatattcaacttctataacctcaccacgtcaccctctggaaaagttgctttcttctgtttgcttgcactgtgccttgtacatatgtctgtcagcatttatcacactagaatgaaatgatctacttccatgtctgccttccctacctgaccaggagctgaagaaggctagggattccactctatccttagcttttcctacacagggcttattaaccctagaaggcccccaaattttgctgtgtgagtgaatgaaatctcactgggcataagaccatcacctccaattctgatattcatggagtattatggaccattaattattcaagattcaagtgaggataataacctggagaaattgtacttttaatcttgataattatggtgtcttaatacctttccttcttctaggattatgaattaaagtaactaccttgaatcttttgtgcattaaagcatagttggacccaaaaatcaggtcttgtcacttgccattcctctataatagccccctttattcatttaacactttatatactttctctgtcttcctcacaagtggtcctctgaagtacatgttagtctgctttaagaatgggaaactgaggttcaggatgttcagtaacctctctgaggacattcggctggtaaatgttagatttgggatttgaactcaagtccatttgactccagaactcctgttctgtctactactcgagtgatcttcaaacttttttgcctgtgaaaccccttacagaatttagaaaaactataaagtccatcaaacattttaaatcggcatgtaaaaatttttcatcttgaatttatgtacttgccaagaatataattcctggcatgttgtaaatattgacatttttaaataaaactgttaacatcattcttttaaatgtacccaatgagaaataataatgatttagttatccattaaaaatatgtaagtaaactcttaacagtcaggagctttttattgtttttttcttcttcttcttaaacctaagttttttattgcatcttcacttccgccagattcttttcctaacatacattttgtcatgaattattttattaacatactgcaacatatttagtccataagttagaattaatttttaaaaatttcctgtaactaaaaacaaggttctacaaacatttcagaatttctcctaaataagaagtcaatttttttttttttttttgagacagattctcattctgtcagccaagctggagtgcagcagtggcatgatctcggctcactgcaacctcccgggttcgagcaattctcctgtctcagcctcccaagtagctgggtttacaggtgcttgccacaacgcccagctaatttttgtacttttagtagagatagggttttgccatgttggccaggctggtctcgaactcctgacctcaagtgatctgcccgccttggcctcccaaagttttgggattacaggtgtgagccactgcacccagtaccagaagtcaatttttactagaaatgcttgtctttataagatgaatgagaattaaatcgtacatgtatagatggctgttgtttaatgctagaatgagacacgattcagcatcaattttattcctatttttcatttttatagctataaggactttgaaaccttatttacataaataagtagatggaaatggaagttctgtttaaagtagtatcatacagttcttagcactttgaatttatgtgctaaaaaaatcatatcacagtctttcatcaaaaaatatttataatgacctgtcagctttcagtttagtaaggtactcatcagagaattggaaatgctgctgacttgcaaaaggatttgcctgcagtcattaaagttacttgctttctcaatcctgcacagtattttgaattatccctttgtttgttaccctggaaaatgggagaaaggctatagtaaaagagaatgtcttgatccaggcactagtcaggcaagtcagtttcagaaaaagaagcatatggaaactgagtatgtagaaattgattttcttaaaactactctggcatacgccctagaaagttttgtggaccacctgaggtatacatacccccggttgaagagtgctgtgtgtccccatgaggttttctccagttcaacccctcctttcacctgtccataggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaata

SEQ ID NO: 35760 - DNA, 31193 bp, Homo sapiens; identical to SEQ ID NO: 35759

SEQ ID NO: 35761 - DNA, 2448 bp, Homo sapiens
gcggccgcgcggaggaggccaagatggcggcagctgcggcttcgcttcgcggggtagtgttgggcccgcggggcgcggggctcccgggcgcgcgtgcccggggtctgctgtgcagcgcgcgtcccgggcagctcccgctacggacacctcaggtgagcgctgggccgggccccggcctccgcgcggccccgcatctccgtgaaggtcacggcggggaggctgcgggcgcgggcctgggcagcgcggaagcggtaccggccacccagcgtccccggtcccagctgcctgccgaccttgagcgtgtgggatcagggctgggcgcccacctctccgaacggcagagagcccgtccccagcgtgggggttggcgggacgggctagctgccgtggcggggctggggctttcccgaatggcgcgcccaggacggctcttgcggctggctgtccaaactgggcccgcgtcctgaagtgaccccagcctgatctcggccagctgcttgtgaccttggcctgtcccagcacccttggtcacttcggtctgatccccggctcaggatccaggaacaccctctcctgagagcgaatcacggtctaggggtcagcggcggagagggatggggtgggtagtgggacagggtgtgcgtctggtgccctgcaggaggaggccattgctgggtggagaggtgggcgctgagagtcagatccccaggtagggctgggtggtgtcctggcaggcgctgagcggagatcttgcaggcagtggccttgtcgtcgaagtctggcctttcccgaggccggaaagtgatgctgtcagcgctgggcatgctggcggcagggggtgcggggctggccatggctctgcattcggctgtgagtgccagtgacctggagctgcacccccccagctatccgtggtctcaccgtggcctcctctcttccttggaccacaccaggtgtgcagctggctggctggctggcagcgggaggttctgggtggagctggtaaggtggaatcttcagctttcctaaccctttccctccctccagcatccggaggggtttccaggtatataagcaggtgtgcgcctcctgccacagcatggacttcgtggcctaccgccacctggtgggcgtgtgctacacggaggatgaagctaaggagctggctgcggaggtgtggggtctggggatgcctgggacccagggctcagggctcccactgttgagatggcagggttgtgatgaggctctcggtggcaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggtacacgggctgcccatggggtggtgctggagagatgggggaagggctgacttgtgcttggaactaaggagccatggatctggtcctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggtaagaggcctccagtctggcagtgggcatgtggaatacttctccactacccccagggatgctttccctgtgttcctgggtccaggaggtcctgcccacttcttgtctggggcgtcttctgtgcatgtctcaggaggcttttgggctccttcagttttgcgtatgtccggtggagggtactgcccctttgatgccttgggtaggggcagtgtctgcttcacagagggggggcatgatcccaggttggacatgagcctgagaatagccctcactgcttgtcgttggccaggcaccccagctaccatgtcccagatagccaaggatgtgtgcaccttcctgcgctgggcatctgagccagagcacgaccatcgaaaacgcatggggctcaaggtaaaagggttgggaggccatggtgggtatcagagaagggctgggagctgggcagggctcctccccactcccttctctgagccttccttgtctgcagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt
